United States Patent 7,745,391 (HUMAN THROMBOSPONDIN POLYPEPTIDE) - sequence listing, part 45

SEQ ID NO: 113659 - DNA, 2868 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113660 - DNA, 2865 bp, Homo sapiens
  misc_feature (13)..(13): n is a, c, g, or t
  misc_feature (16)..(16): n is a, c, g, or t
  misc_feature (43)..(43): n is a, c, g, or t
tctcttcagtacnccncggggtattgtagcgaggctgggtggnggcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113661 - DNA, 2858 bp, Homo sapiens
taggggtcaggtacgaggcgggtgttgatcggccgaggcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113662 - DNA, 2861 bp, Homo sapiens
cggctagtgcgaggctgggtgttgaatcggccgagggcccgcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113663 - DNA, 3412 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgaaaaaaaaaaaaaaaaaaaaaaaaaaaaaaaaaaaaaaaaaaaaaaaaaaaaaaaaaaaaaagaacaaagaaaaagaagaaaacaaaaacaacaaagaaaaaaaaagaaacaacaggaaccaccagaacatgaaaaaataatgagagaaccaagatataagcgcgacaatcaagcacgagccaataaagaaagacacacaactaagacagtgtaaggaacgagtagcaggtcagccaaaggggacaagcaaaaagagagagaaatactaagaacggggctagcggagcacacatggagaagagacaacaggtaatgacacacgacgcgagcacacagaaatgagaaagaaaaagcagacgggggtccgacgacgcccagcaaaccaaggaccagcagaggaagagctgggagaagcaaatatcgacacaggggcaaagagcacacagagacgaggaacggatcgaagaaagagaaaaacataagaacgcggagacacagcgaacagagaagcaacacatcgagagagacaaagaaacgaaagcaa

SEQ ID NO: 113664 - DNA, 3321 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttcccta

SEQ ID NO: 113665 - DNA, 4428 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaatttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttccctatttctgcttttctgtcctcagtgtactggcttgtcccaaattctctgatgtagttctaataattatcatgtgctgacaacctgagcagaaaggcaactacatctttattcaatgttaagatttcccaaaagtcttccagcacatttcccttatgtttcatggatgaatgtcatatgccatgttcaaaagagtctgttatcaagatgggcttagaatatcagacacaatggctccttttataatgttttgtaatatgtagaaatgagattactgtatttccaaaaatcagtataagaaatcaatttaatttgcaagtatgaaggaagtgatttagacaacatttttggaagattcagtgcttgttaacacccatgtaaaagattcttgggattcgtgaaaaattctaggctcaggtttccaaccacatgaacactcaatgggaacattgtaggattatgaaggattgttatatggtgtgttggaaaataacttttagcatttttggttggcccttgcccactgcctctactgtctcctaaagataactttaaaagccctccaggatttccaaagtactccagttgagaactactggcttaatgctagtcaagattcatccttgggatcagagagaggagccaaatgcccaagcaaaatatatatttgagttctattaggagggagaagttgcttgggtatgggtggacacagtatttcagtcacctatcagtaaagctaatagcataaatagcaagaaggtatatggagatttcctacagccaataggatatatatctagaataagatttactgtaagaaagaaactggctcacaattatggaaccgaggtcccacccacagtccactgctgggaaagctgttggggtaaaatttcagtgaccaggaacacagtggtgtcctagtccgaggttagaagaatatggatgtcttagctctggcagttctatataggcccttaactgattagatgatgtccactcacatcaaagcagagcaatctccaattcaatactaatctcttctggagagagacaaatgtttaacccgttaaatggcatcaatggctaaactgacacataaaattaactatcacaaaaggcaaaaagaaat

SEQ ID NO: 113666 - DNA, 3708 bp, Homo sapiens
  misc_feature (1697)..(1697): n is a, c, g, or t
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggaaatatgcaaaaaaaaaaaaaaatgaacctggaaaaaaaaggtcctggaccaggtggatgcctcatatattaagaaatccccgaggccgggtacagtggcttacgcctgtaatcccagcactttgggaggccaaggcgggcggatcacgaggtcaagagatcgagaccatcctggctaacacggtgaaaccctgtctctactaaaaatataaaaaatttggtgggcgcctgtagtcccagctacttgggaggctgaggtaggagaatggcgtgaacgcaggaggtggagcttgcggtgagtggagattgcgccaccgcactccagcctgagcgacacagcgagactccgtctcaaaaaaaaaaaaagaagaagaaaaagtatccccgntactattcaaatggaactttatcactaataaacacaagggaagaccatgccccatgttagcaatgcaaattattgctacagctgcctatgataatttggtctttagttgataatatacaagagaatgtggacttctaagtccccttgccttgcatcctctgtttcaaatgatttaatgtgttgtgtaggaaagcagataataaaacttaggagaatccttcccagatttacaagggtcatgaaggagatacttctataggtataaagtgtatgagtgttagaagatcattagcaggaacccaagtacgaaatggttatttgaataaacattctcagatttgagttagcctgtcttgagatctggctgggagcgtaggacacgtgctcccttttgttctgctcaggtagttcccaagtgtgggccgacaggttctttttccttgatgttcaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113667 - DNA, 2792 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaacagtagatgggaaaaccttacttcctagatcttagtaccttagcctctgtaggacaaacccgggtgaatgttctcta

SEQ ID NO: 113668 - DNA, 4074 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtaagagccatcacttcctaccttgtcacatgggttttaggttctatgacggatgtaattgcagccactttcatgagttttttctagaaaacttcatttttatctgttttacagtttagaatattaaacagttaactgtgggtggtgagaatcctgtgttttgttttttgtttttttgttaccagaaaagttcttacatgttagctggtagtgatgattataagaaggacatcagtagtctcctccacaggattaacataatttgctaaaagggatctcagtcatttgagactgaatttcctgtagtcttctgttctcaaagacagtaaaaagggtagtctggaccagacttaggggagtgttcttatcttatggatgaatgaagggggtggtatgagggtgccgagataccaagcagggctacttggacatggcttgttcttgaagtaggaattatttctggctgggcaccgtggctcatgcctgtaatcccagcactttgggaggctgtggcgagaggattacttgagctgaggagtttgagaccagcctgggtaacatggtgaagctccctctctccaaaaagttaaattagccaggcatggtgctgtgtacctgtagtcccagctactcaggaggctgaggtgggtggatcacttgagcatgggaggcagaggttgcaatgagctgaggtcatgccactgcactccagcctgggcgacagtatgaagtgaggtcttgtctcaaaaaaaaaaaaaaaattatttcctgacttacccaatcttgtgatgtttttccataaaactatggttgttggtatatttgtgccgtgatgtatttgtcaacacatcactctgaagaaaagtatgtggtgactttctgtgactgagcatgatacatcttctttctctgatcccgtttccccagatgagcatgtttcaacattttagttccttttgaggacttctgtcctaatgctgcgtctttgtacaatgcatttgcttagctgaaacagttgctattgtatgcccatttgctgtactaatcctacttctattccctataaagacatcagcctttgttctgaacataccgtaaattaggagtcttccagtcttggaatgtaaacctttggctttcattttttctatagaaatggagtaggttaatcacattgacaacccaggagggtttcttcttccctaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113669 - DNA, 2814 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtatgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113670 - DNA, 2513 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggagggatgagcataggagggatgagcataaggagggatgagcataaggagggatgagcataaggagtggatgagcatacgacgggagagcataaggaggga

SEQ ID NO: 113671 - DNA, 2815 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113672 - DNA, 2388 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacactgggagtgatgcccacgcagtgatgcccacatgg

SEQ ID NO: 113673 - DNA, 2366 bp, Homo sapiens
ggctaggagcgaggctgggtggtgcagaaagacataaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113674 - DNA, 3002 bp, Homo sapiens
  misc_feature (991)..(991): n is a, c, g, or t
agtgtattcttgggacaggtggcacaaatatatggcccattctgctggggtgacctaaaagggagatgagattatatactcactaaagaattcttttctgtttgttttgttaaaattgaaaaataggccgggcatggtggttcacgcctataatcccaacacttcgggaggctgaggcgggcagatcacatgagtctaatttatatatatatatgtatgtatgtatgtatgaaaaattagggaggggcagaatttctttaggggcagtagcagggaggatcccgaactcagtcatagaatttttaggattgaaacaaagtttgaggtcagaggggaacataaaaccttggtaataccccgcccccggccaccatctttgtacatgtgtctttgcagcttagtgcatctctttgacaaagatttgtgcaatgatgtattttattcaacacatcattctgaaagaacgtgtggaaaactaatgactgagcacaaacctgttgaagatgcagttcttcttggtagcctaaataggattatcttggacctaagatagtgaccttgttttttttcttaatttttccattgaaatacatggccttaaggaaatatgcaaaaaaaaaaaaaaatgaacctggaaaaaaaaggtcctggaccaggtggatgcctcatatattaagaaatccccgaggccgggtacagtggcttacgcctgtaatcccagcactttgggaggccaaggcgggcggatcacgaggtcaagagatcgagaccatcctggctaacacggtgaaaccctgtctctactaaaaatataaaaaatttggtgggcgcctgtagtcccagctacttgggaggctgaggtaggagaatggcgtgaacgcaggaggtggagcttgcggtgagtggagattgcgccaccgcactccagcctgagcgacacagcgagactccgtctcaaaaaaaaaaaaagaagaagaaaaagtatccccgntactattcaaatggaactttatcactaataaacacaagggaagaccatgccccatgttagcaatgcaaattattgctacagctgcctatgataatttggtctttagttgataatatacaagagaatgtggacttctaagtccccttgccttgcatcctctgtttcaaatgatttaatgtgttgtgtaggaaagcagataataaaacttaggagaatccttcccagatttacaagggtcatgaaggagatacttctataggtataaagtgtatgagtgttagaagatcattagcaggaacccaagtacgaaatggttatttgaataaacattctcagatttgagttagcctgtcttgagatctggctgggagcgtaggacacgtgctcccttttgttctgctcaggtagttcccaagtgtgggccgacaggttctttttccttgatgttcaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113675 - DNA, 1672 bp, Homo sapiens
agaatatcgggctagtgaggccgcggttaatcgcacgagggcagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113676 - DNA, 2368 bp, Homo sapiens
ttcattggccggcgatatgatgtatggttgggttggtgacagcctgtcgctggccggcgatatgatgatcctgaagtacaggaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccatgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113677 - DNA, 2093 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagtgaaggaagagattcccaaatgaggggagctcctggtagaaaagaagggaaccggggaattttcgacgggggattctcctcttcagagggtactgaagcggtccggaggcctacaacgagggtttggggaaaggcgg

SEQ ID NO: 113678 - DNA, 2145 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttggtaggttattgtgaatcctgaatactatgcctccttcactgtaaagtgagataatattctaagccataaaaatattagtataaactgctggcatacacatacatactgagtagtcttgagaagaagggatgcaactagatacccatggcatcagtttttacctgaaagccttgctttttccttgtgccttaggaatttcctcagaaataaactcctgattactcatttaaaagacatttgatattgttactggtttctgatcagcattgcttattggttattggtgaggtgaataataggagatttgctatctgtcatttagtgtgtccacaggtacatacagccattatggttacttgctatagctaaacttcactggtataaaaccagttgatttcaggcagcgaactactactgttgcttataaactttgtgttttgtacattaaatcacttgtttctcccaggaaccaagtgacttgtttactagaaaaccatatagatt

SEQ ID NO: 113679 - DNA, 1758 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttcccta

SEQ ID NO: 113680 - DNA, 1305 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113681 - DNA, 701 bp, Homo sapiens
acattcagctcgtacccagcgccctagcctatacatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113682 - DNA, 4452 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttccctatttctgcttttctgtcctcagtgtactggcttgtcccaaattctctgatgtagttctaataattatcatgtgctgacaacctgagcagaaaggcaactacatctttattcaatgttaagatttcccaaaagtcttccagcacatttcccttatgtttcatggatgaatgtcatatgccatgttcaaaagagtctgttatcaagatgggcttagaatatcagacacaatggctccttttataatgttttgtaatatgtagaaatgagattactgtatttccaaaaatcagtataagaaatcaatttaatttgcaagtatgaaggaagtgatttagacaacatttttggaagattcagtgcttgttaacacccatgtaaaagattcttgggattcgtgaaaaattctaggctcaggtttccaaccacatgaacactcaatgggaacattgtaggattatgaaggattgttatatggtgtgttggaaaataacttttagcatttttggttggcccttgcccactgcctctactgtctcctaaagataactttaaaagccctccaggatttccaaagtactccagttgagaactactggcttaatgctagtcaagattcatccttgggatcagagagaggagccaaatgcccaagcaaaatatatatttgagttctattaggagggagaagttgcttgggtatgggtggacacagtatttcagtcacctatcagtaaagctaatagcataaatagcaagaaggtatatggagatttcctacagccaataggatatatatctagaataagatttactgtaagaaagaaactggctcacaattatggaaccgaggtcccacccacagtccactgctgggaaagctgttggggtaaaatttcagtgaccaggaacacagtggtgtcctagtccgaggttagaagaatatggatgtcttagctctggcagttctatataggcccttaactgattagatgatgtccactcacatcaaagcagagcaatctccaattcaatactaatctcttctggagagagacaaatgtttaacccgttaaatggcatcaatggctaaactgacacataaaattaactatcacaaaaggcaaaaagaaat

SEQ ID NO: 113683 - DNA, 3020 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggaaatatgcaaaaaaaaaaaaaaatgaacctggaaaaaaaaggtcctggaccaggtggatgcctcatatattaagaaatccccgaggccgggtacagtggcttacgcctgtaatcccagcactttgggaggccaaggcgggcggatcacgaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113684 - DNA, 2814 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccatgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113685 - DNA, 3403 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggtgattacttcttgtcttctgaactttaatcttagtaaagctcagtcttgacagtgggagtttggggctgggcgcagtgtctcactcctgtaatcccagcactgtaagcccactgccaaggtgggcagatcgtttgaagccgggcgtggtggtgcacgcctgcagtcccagctacttgggaggctcaggcaggagaatcgcttgaacaagaaagtgggagagtttggacatgtcataggttgtgggtaagagaaaacctaagataatctattcttccttccccgttgtttataccttatgtttgcagtgcctttattatttcttctgttttccctgtcacaattctgatgttacaaaatctagcccaaatctctctcaaagccatcccagactctttcatgccactctgatttctccctcttactctatttttatctgtaactgtatgtaacacatagcttattgtctgagtatagacattcagcaaactttggttgattggaaagtcttcgtttaaacttctaatttctctaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113686 - DNA, 2917 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattcaaaaaaaaaaaaaaaaaaaaaaaaaaaaaaaaaaaaaaaaaaaaaaaaaaaaaaaaaaaaagaacaaagaaaaagaagaaaacaaaaacaacaaagaaaaaaaaagaaacaacaggaaccaccagaacatgaaaaaataatgagagaaccaagatataagcgcgacaatcaagcacgagccaataaagaaagacacacaactaagacagtgtaaggaacgagtagcaggtcagccaaaggggacaagcaaaaagagagagaaatactaagaacggggctagcggagcacacatggagaagagacaacaggtaatgacacacgacgcgagcacacagaaatgagaaagaaaaagcagacgggggtccgacgacgcccagcaaaccaaggaccagcagaggaagagctgggagaagcaaatatcgacacaggggcaaagagcacacagagacgaggaacggatcgaagaaagagaaaaacataagaacgcggagacacagcgaacagagaagcaacacatcgagagagacaaagaaacgaaagcaa

SEQ ID NO: 113687 - DNA, 2276 bp, Homo sapiens
gaaattaggctaggtacgaggctgggtttgaattcggccgagggttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113688 - DNA, 1809 bp, Homo sapiens
gtcttctgcgacgactctcttaatcttccaccgctacacactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113689 - DNA, 1595 bp, Homo sapiens
  misc_feature (15)..(15): n is a, c, g, or t
  misc_feature (20)..(20): n is a, c, g, or t
ttatgagaatatcgnccccnccgagttattggatatcgtcgatccaggcgctcgatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113690 - DNA, 1500 bp, Homo sapiens
  misc_feature (7)..(8): n is a, c, g, or t
cggggannaaccaaaataaaggcaggtacgggctgtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113691 - DNA, 3351 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtaagagccatcacttcctaccttgtcacatgggttttaggttctatgacggatgtaattgcagccactttcatgagttttttctagaaaacttcatttttatctgttttacagtttagaatattaaacagttaactgtgggtggtgagaatcctgtgttttgttttttgtttttttgttaccagaaaagttcttacatgttagctggtagtgatgattataagaaggacatcagtagtctcctccacaggattaacataatttgctaaaagggatctcagtcatttgagactgaatttcctgtagtcttctgttctcaaagacagtaaaaagggtagtctggaccagacttaggggagtgttcttatcttatggatgaatgaagggggtggtatgagggtgccgagataccaagcagggctacttggacatggcttgttcttgaagtaggaattatttctggctgggcaccgtggctcatgcctgtaatcccagcactttgggaggctgtggcgagaggattacttgagctgaggagtttgagaccagcctgggtaacatggtgaagctccctctctccaaaaagttaaattagccaggcatggtgctgtgtacctgtagtcccagctactcaggaggctgaggtgggtggatcacttgagcatgggaggcagaggttgcaatgagctgaggtcatgccactgcactccagcctgggcgacagtatgaagtgaggtcttgtctcaaaaaaaaaaaaaaaattatttcctgacttacccaatcttgtgatgtttttccataaaactatggttgttggtatatttgtgccgtgatgtatttgtcaacacatcactctgaagaaaagtatgtggtgactttctgtgactgagcatgatacatcttctttctctgatcccgtttccccagatgagcatgtttcaacattttagttccttttgaggacttctgtcctaatgctgcgtctttgtacaatgcatttgcttagctgaaacagttgctattgtatgcccatttgctgtactaatcctacttctattccctataaagacatcagcctttgttctgaacataccgtaaattaggagtcttccagtcttggaatgtaaacctttggctttcattttttctatagaaatggagtaggttaatcacattgacaacccaggagggtttcttcttccctaggtattctctactgccgctgatggtcaaacgcaagtggaaattaaagtgtgtcagggtgaaagagagatggctggagacaacaaactccttggacagtttactttggtaggttattgtgaatcctgaatactatgcctccttcactgtaaagtgagataatattctaagccataaaaatattagtataaactgctggcatacacatacatactgagtagtcttgagaagaagggatgcaactagatacccatggcatcagtttttacctgaaagccttgctttttccttgtgccttaggaatttcctcagaaataaactcctgattactcatttaaaagacatttgatattgttactggtttctgatcagcattgcttattggttattggtgaggtgaataataggagatttgctatctgtcatttagtgtgtccacaggtacatacagccattatggttacttgctatagctaaacttcactggtataaaaccagttgatttcaggcagcgaactactactgttgcttataaactttgtgttttgtacattaaatcacttgtttctcccaggaaccaagtgacttgtttactagaaaaccatatagatt

SEQ ID NO: 113692 - DNA, 932 bp, Homo sapiens
ctactactactaaattcggcggcgtcgacgagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttga

SEQ ID NO: 113693 - DNA, 566 bp, Homo sapiens
cgagagccaccagcagctgtgctgccaacgcttcgagcgcctctccgactccgccaagcaagagctcatggacttcaagtcccgccgggtctcctcttttcgaaagaatctcattgagctggcagagctggagctcaaacacgccaaggccagcaccctgattctccggaacacccttgttgccctaaagggggagccttagagtagccagagctcagccagaccctaatctgggatctccagtgaccagggtatcccagacccctctctccggcaagatgtctccttccctagcagtgccactagccacaccctcactctgccccacatcctctcagggaaagcccaaaccccctatcaccaccaccacaggtgccaggccctgcaagacacagggcagcatgggcatcataactggccacagtcagcagagccccagggaccctgacacctctccccaggaagctgaggaacagcctctaccctcacccatagccctgaaggaatcatagctcacttgatcccggcctgttctccttcgcaaataaaaaccctggttttgtagc

SEQ ID NO: 113694 - DNA, 786 bp, Homo sapiens
gggcaaatgatatgtagaaatatttcaacagaaacgcacatagcaatcaaatgtatgaaaagatgttcaattttattagtaatcagagaaatgcaaatgaagaccataataagttaccattcttcactcacaagattggcaaagattaagaaaaccaacaatgccaagttatctttgtggatatggatcaacaagaatgtttgtgcactgcttctaagagtataactgattcatcaccaagttggagaaaaacttagtattagaaagttggagcttacattctccacaacctagcacatcctcccactcccacctcagtatttacctagagatacctttgcatttgtgcaaggtaatattgaacaagtgttcatagcaactcagattcccatcagcaagaaaatggatctataaattgtggcacatttatgcaatggaatattttatagcattaaaataaataagtataacaacatggaacaatatagttgaatcttagtaaaagtgaaggaaagaaactgcagaatactgcatacaatatgatactttataaagctcgaaaagaagcaaaactatacaatatataagtggtaaaactggaaaaaatgtttgtcacaaaattcaagagagtagttattttttgcacaggttacctgttgcataagtaaatgcaacggtattattaatgtcctattttataagttgaagggtggatttaatttgtcctcactacatatatatagttatatccatttgcagatatcaggttacacataaaaatttaac

SEQ ID NO: 113695 - DNA, 355 bp, Homo sapiens
tcatattctataattaggatgcagactaaaactctgcatttgagtataagcaagcttgtttgaatcttagaagctatggattgtctttgattatcctttgctgtatcagacatgtagcacacttttgagcagcttttactcaactcactagtattaggttgtgccagtttagagtactttctgagacatatctaaaagcaaaaatggtgacatggaaagattctcgctgtaatggggattaagaaaaatcctctttctctttctctatctcttagatagtcttagcatattcaataccttagggcaggaattgataatctagcaatgggaatgggtttaggggatctgtagatcc

SEQ ID NO: 113696 - DNA, 639 bp, Homo sapiens
ctggtggattttaatatttcacagcatgttctgtgaccttgaagtagacgccttaagatttagcagttagttcactgtggaaagatgctcccatgagtccccccaaagacactgatttgccctgggttatgcttctgagccactaattcttgggattagtttgacctaaagcatggctgtctgtcagagtatacctttgtgcatttccttccctcaccaaagtgccggcttgacagagggcttcttaattggtgtggacaaaaagtaatatccctgccatagtagtctacacatttcacaattcacgttcgatttcagcatatggattgctgttcaggtcaagtcaaatacatagctgtttaaaagcaagcaaggttaagtcacttaaattgccttctctttggacttggaatgaaagttaccaaactcgatgataaagtttgtcacaaaggaagtatatatagatgtggcacattgtttattttattattaaatattgtggaagtatttaaatttaatgctaatgttaccttccttccctgaacatggctattgctttttaaaggaaattttatatctgaatcacttctgactattctaagtccagtagttatcattctttggggagagccttttttt

SEQ ID NO: 113697 - DNA, 435 bp, Homo sapiens
gtgcacaatgatggtgggagtataatttgaaagggaatttcagacaactggatactacatatcaaaagctttagaatttatattaatttatcctgagaaaagaaatgtacccccaaaacatagttattaggatgattaaagccctgttgtttacaataagaaacatttagaaattatctaagtgtctggtaataaggaatagttaaacaaattagagtacaaccacatattggaattgaatgtagtgtacatataaaagctagcttttcataatatttaaggaactagatgagattaaaatgtaggactagtgatcaaagaatattttgaaacttatctcccaggggatctttattttggggtcatgggtgtgctaggaatgttgatgctgcttaagtcaactctaaatagaaagttcagtggcagcagtgcgtg

SEQ ID NO: 113698 - DNA, 784 bp, Homo sapiens
gattacaggcgcctaccataacgcctggctaatttttgtatttttagtagagacagggttttgccatgttggccaggctggtctccgactcctgacctcaggtgatccgtccaccttggcctcaaaaagtgctgggattacaggcgtgaaccaccgcgcccagctgtaagtttctttgatcaatcgaatgtggcagagggacatggtgctagttcctggcctaggcctcaagaggtcttgtctatttcttattgttctcttagaaggccactgctaccatgtgaacggctcacctgctgggggatgagcgatcacatggctccttcaaccctgtccccagagccgccagccagccgactgggagatatgggaatgaggacatcctagaccagcctcctcacctcctccccagtgcccgaatagacctgaccactgactgatggaaacactcaagtgaactagccaagatcagcaggtcctggcccagatcagcagaaccacccggctggcccatagactctgagcaataatagacagatacttcgtgttttaagccactgagttagaggtggtttattgttcagcaacaactaactgatatggatgcctaggaaaatctggcataaaaaggctgccactgcagtaaatagaagcagttcatttttctgtttgtttgtttgcttgtttagagatggggtcttgccctgttgcccaggctggagtacagtgtcaccattatagctcactgcagattcaaactcatgggctcaaaagatcctcccac

SEQ ID NO: 113699 - DNA, 217 bp, Homo sapiens
ccagatgcattagaaaatcgttatgaaaagagactttgagtcttcccatgctgatgttccccatgtgtgaaaggattgcctggtgctttcaccagtgactaatagagcctctgggcccaggcttctgcatggacattacctcaatggctctcagaccaccccagcgcgccgggccagggcttcgtgaggctggaagctggctccgagtcctgcagag

SEQ ID NO: 113700 - DNA, 378 bp, Homo sapiens
accggatggtgtgagtcggtgtctcatattagaatttagtgcatcttctcttcagatgagcaactacaggcgaagaccggatggtgtgagtcggtgtctcatattagcatttagcgcgtcttctcatgtcttctcctcaggggtggaacagtattttctttttcacagactttatttttagagcagttttacttttagagaaaaaaattatgcagaaagcgcagagtttccaggtacctccagagcacccacacctccaccacttttcctggaatgaacatcatgcattagtgtggtgcatttgttataattgctgaacaaatattgatacattattattaaccagcttccagagtttacattaaggttcactcctga

SEQ ID NO: 113701 - DNA, 235 bp, Homo sapiens
tcacctctgtgtgtcagtttcctcactgacggcagggtctcggggatgttcgtggcaaaggcctcacagccaccccagcttcgtgcctctgtgcgtctgcttgtgctggggctctcgcaggaactaggaggccttcctggagggatgcagtggacaagatcttttctctcgtcccttcgtgagtccctccccagggactgccattgtcggcgcattgccgcagtacacgcagcac

SEQ ID NO: 113702 - DNA, 757 bp, Homo sapiens
ggctgccgaggttgtagcaatctcgtcacttaaaacagtctggaaagatctagaactcaggccaaggtgaagcgagagaactcccaacgtggaaacgcccagcctctccatctttctgactactgaagtcatagcataacgtgaagacatggaatgtctgttccatcgcatcccccacatactgcatacacaagcagtacctgctaagtttctactcaggtcagtcctgttggaccaaggcgtggggcctgcccccacgaagccaggctctggcaaggagatatcttgacagaggacaaccagttagtgggaacctggactgtgcccgttttcccatagctcagggtaggctgagagtaggggacggagcaagcaaaactgggaaagaatacaaagaagagactcaatgagcaggttgtccccctctgatcatttctccatgtgtacctaagacactgcgatgtcacttggaaagacggcaggcagacaaccagttctgggtactccccccgaaccctaccctatcctgctgacccccaggccacacatgtacagggacagagtaggctgacttgtcatcagcccgttttctcagcaaaacacactggttgtgagcattcagactttccagaatttggactaagatgtgaagatgtatttgtgctgagcatgcatctttgcagagctcagggctgagtcagggcagaatgaatgaaggagggcaagggttcttctaaacctctccatgctccttgct

SEQ ID NO: 113703 - DNA, 318 bp, Homo sapiens
acccttcctcatctatcctccagccccagagctctgggaatatctacatcaagaggagagagtactaacacccactccccaacactgccagggctcaggggaagggccactggatgcttgtacgagtcaggtacatgctcctttaacccagccccatgtccctgaaacaggtgccaccagggcaaggcaggctgagggagaatgaatggatggctccccacacctccacaagtttggttctcggtctcgagatagagtcttgctctgtcgcccaggctggagtgcaacggtggaatgtcagtccattgtaacctcctc

SEQ ID NO: 113704 - DNA, 468 bp, Homo sapiens
acagcgtattaccattacttaccggtttactgggcgcgtctgtctttgatcccggcacaacaactgggacccactctggtaaggtagatggttcctcaaggctaagtaattgagttcttacatgtgctggtcagtggcacctacatcattggacgaggaaagccctagacatggcgcatccactgctccccttcctcaggcagatgtgagtttcaggactctcactacctacctacatcaggagaccaatgggattgacatctagtagaattcttctctttctgctcccccatccccttcaccaaacccttgacaaaagttctgttgttggaagaaacttggtccttatagtagcttatttcttcactcaaagaagtatttggtgactatagtcacctttaggggaaaactagaagtcagtctgagtttcccattagttgtgaaaatctctctttgggaaagatgatt

SEQ ID NO: 113705 - DNA, 219 bp, Homo sapiens
ttccatacacctaacctactgaacatcatagctttgtcttctctaccttaaagaagctcaaaacacttatattagcctacatttggacaaactcatctaacacaaagctaattttataatagtattgaatatctcgtggaattcattgaataccataccaaatgtgaaaaaacagaaaggtttcacgtcattcataatgtcaaaaaaaaaaaaaaaaaa

SEQ ID NO: 113706 - DNA, 363 bp, Homo sapiens
agtctttatatataatgaaaattagaaaagatacagaccaattgtccaaatttcaactgtaaacaagataatagaaataaataacaacaggaaaataaaagcaaatggtcctgaataaaagttagacacttttaaaatttttccaaatgacaatatgcttttctgttcagtctctgaaaatgctatctgtaaatcttccccaactcttatgatcccacagactacatttctagcagatactaagcattaaagaagataaaagttatgtggaacaaccactatcccaaaagggcttataacgaaataaagttaaatattactccatacacattatatcattaattcttgattgcacaaggctaa

SEQ ID NO: 113707 - DNA, 728 bp, Homo sapiens
tataatttttagcagttaaatagttgttgtaaaggttctagcagtttacctctaccatctattcctgcccttacttcctctgcacttcttcttcccatggcttctctccctgtatgatgtctcactttatctggttagcctggaattccttatgtgacagtccagagtagcaagagagcaatagtggaagctgaccattctcagatagcttaagcccagaactggcacagtatcatttttatcacaatttatgggttaaagcaagtcccaagtctcagattccatgggtgaggcaatagattctatctcttgattgcatgtgcatattggatgacaggaattgctggaggtaatctttacaggcattttaccacaggaagtagtaatattggacccagtaggtgccatgaaccatatttttttaccctctccattctctccaaatctgtttcattggtgggattctctgggctttgggttcattgtagcaaaaaaaaaaaaaaaaaaaagaaaaagaaaaaaaaaagtcgtgtaaagttgaactacaacacgaaaaacaatcaatgtttttcttggtgctaggtggaagggatcaagtttctcttttccccaagccatatgttgaagaagtgcagaggaagtaagggcaggaatagatggtagaggtaaactgctagaacctttacaacaactatttaactgctaaaaattataaaaaagaaatgaaa

SEQ ID NO: 113708 - DNA, 459 bp, Homo sapiens
gtgtggtctgctaaatattaaatgaagagatttactctccccttcgcatttttgtgcatcactttctttgctcatgataggttcttagttcttaatttttgaaacatgtatttttcccatctcatgggcctggtatttcaattcctgggacacctttccccacctttgactgaaaatacctgctcattctttagtaatcagcccaaagtcacctcttcaaaattgtcccttaactaggtttccctgcgataatctcttattataatccttattgtacattcttatgaatctcttattatttatttttcactcctagaatttatattgccctgtatttgagagattgtatctctcacatctcatttcctagaaaactcaagccctgaagtttctctctcactcactctagcttttgttttctcctttcctaatgctagatacatagaatagtgctctgaa

SEQ ID NO: 113709 - DNA, 713 bp, Homo sapiens
tgtcttttaagccctcacataagctgactggatctcattcatttttgctcctcatcaatgatttagtagccaagaaatttgggcaaaaagttctcataatattgattatttaaaaatcttattataatgtattccttgtcaactgtgtttaaagatatgttcatgggagtctgtgagttctccttgagcaattttagatgtattaaatttttttatgagaatcttaaaaaaatgtgcatattttgaatcagttgagtgataatcttttcaaatgaacgttgccatgaagttttggttctcatgtttggacttaggattatgtggtcattaagtaatactagtttaattgcctatggacaatgaatgaagtcttgacaactggcagatatataaatctgtatgaaaagattagtatatattcatcagttaggctattctgtcagccagttaacaaaacccctttttccctgcttctgagtttctgtgaattctgcagtaatggccccccactcaaccttgcttactgtttcaagccctcacagacaatgagcattagagcttataactgtgtgattatactgttgcactcttataagtgtttataataaaagtaaagtcagaatggaatgcttggccatttggtaaagaacatgaaaagagatggaaacaaaaagaagtattgatgtaagtaataaagatagctcattgagatg

SEQ ID NO: 113710 - DNA, 235 bp, Homo sapiens
tagatgatgatattgctacgcccgtcgtcgacaacggctccggcatgtggaaggctggcttcgcaggtgacgatgacccccggccgtcttccccttcatcgtgtggcaccccaagcaccagggcatgatggtgggcatgggtcggaaggactcccatgtgggcgacgaggcctagagcaagagaggcatcctgaccctgaagtgcctcatcgagcatggcatcattaccaactgg

SEQ ID NO: 113711 - DNA, 276 bp, Homo sapiens
gccctgcctggtcccctctgggaaaccgatagcctaagggatgcgtgatgatggagaacaacccacagaccttagtttaatttataattatagctccttgtcctccacaaggtggggcactgaggtccaatttccaggggagagcaggctcctgaaacgcccctcagacaggttacagcctctgctttctcaggtgctcagcaccaccttgtatcatcagtaccccactcttatcctgatgcctaaggtcccgctagacacgcgggacacacttct

SEQ ID NO: 113712 - DNA, 365 bp, Homo sapiens
ttatgactttgtactcagggaatatggaataaccttataaacttaattatatttaattagtccttacttccttctacgtctacagtagtaggctgtgaattgtgaagaaataaatgacacaaggattatcttttctgcaggtgattagttgataatcctccctgggtagtctccagtctcacagattatcccctaggccaactcatgctatcctgcatgaccacattactcttccaaatacagaatttccttcccttaaactagatatgggtattttggcactcactgcttttagtaattgaccctaatgtctatacacatcctgcgtcaccttactctgtctatactcatcctgtatcactttg

SEQ ID NO: 113713 - DNA, 574 bp, Homo sapiens
aaaggcacctttaggggagtcaagcatatcatttcatctgtggccacatgtgaatgctagctatgtatatgttctaaaaagcaaagagtagacaaagaggagcgccgcccagcctcccaacaccagagtctcacttcctctcctcagctggcgctctggggccggactccagtaataacagcctcctggggagattaaagccctggcaagcacagtttatcttggtgaatgtatactttagctttgtgtgtatctacacatatacatacactgcagtatttatagctggtatacatgtgaggtagcgctggagacaaggcctggaatgggtgtacaacacctatgaggttggaaccaagatcttttaaacgcaaacctggtttccctgaactgtcctccacccgtgtggtccaaacacacactcaggtgtttcgggaagaacatcctccctccctgcaaataggggcagcagtctttcttctgtttccagaaagagttgagtattttgtggtggcttctttcatctctggggactttgcttattagaaaaatacacagaatcaccgctctcccg

SEQ ID NO: 113714 - DNA, 386 bp, Homo sapiens
ctattaattaattagcttagtaagcacttaatgaacacttactatagaccaaatgttagaaatatgaagactaataagacatgatccctttcattgaaagatttgctgtttactcagagatggaatgaaatgatgaaaacaaagaattataataatataaggtaatgtgctttacactctgggagaccaacctggccaacatggtaaaaccccatctctactaaaaatacaaaaaatttagctgggcatggtggcatgtgcctgtaattccagctacttgggaagctgaggcatgagaatcacttaaacccaggaggtggaggttgcagtgagtcgagattgtgccactgcactccaacctgggcaacagagtgagactctgtctt

SEQ ID NO: 113715 - DNA, 557 bp, Homo sapiens
ggatccctgaaggaggaggtataaaggtgggagtcattaacatacagacagtacttgatgtcataagagatgatcagataattactaagaggcaaaatatagatgagaaaaggattgagccgtgagcactcccaccctgaaagtctggggagttgagaatgacccaacaaagaatattgagaagtaaatattgaggaaggaaggaaatcaagtaatcagggaggcaaataaacaacgtgttttccaggaggaaggagcagtcgagtgtgccaagtagtactttaggtcaagaaagatgaagactgagaattggtcattggatttagcaacatgactatcgctggtgatcattgagcagttttggtagagtgttgggggtgaaagcctgaatggagtgggttcaggagataacaggaggagtggagctggagatatcaagtagaaggggttctttcaaggaatttcaaagatatggggtaatggctggagggagacgcgaagctgagaggagatatttttaaggtgggagaaataatggtttgtttgattgcaggtag

SEQ ID NO: 113716 - DNA, 199 bp, Homo sapiens
tggggccatcctctagggggaaatgagcaagtggtgacaggattctcacccagaaaataaatgatcaacagcagcaacttcttccacagcagagaaccacacaaggctggaaacttctaacctgacaacaaggctggaaattccctaaaattcacccccatgttttggttacccggtgataatctttaagaatgggttc

SEQ ID NO: 113717 - DNA, 694 bp, Homo sapiens
tggaagggaaacttccaggccagtgtggcaggctcaaatgctgcccgtcagtgacaacccagctgcctttttgtttgtttctgtttttttgagatgaagtttcactctgtcgcccaggctggagtgcagtggcaccatcttggctcattgcaacctccacctgccaggttcaagcaattctcctgcctcagccacctgagtagctgggattataggcacatgccaccatgcccagctaacttttgtatttttttttttttagtagagatggggtttcaccacattggccaggctggtcttgaactcccaaccttgtgatctgcccaccttggcctcccaaagtgctgggattacaagcgtgagccactgtgcctagcctgtactgcagattttctaaaatagtatagcctatgttaaaacttgtcctaatagacattataagattacttagacattgttttactttaaagactgtgtatggctttctcacaaccccagggccattactagtaagataagattttcatggaagacattaaaaatcatgttacactttaatagtgatattgtttcaatctttcatcacattaggtcatttccatttagaaaatttgatattcatatggaacctttttgtatcaaaaattatccacatgtgcttcaattttagaacttaactactttcatgcaagta

SEQ ID NO: 113718 - DNA, 235 bp, Homo sapiens
tttttttttttaagagacagagtcttgctctgttgccgaggctggagtgcggctgctggatcatagctcactgcagccccaacgttcaggctcaagtgatcctctcacccgcatagctgggactaataggtgcatgccagcacacccagacaattatttaattttcagtaaagggaggtctcaaactcatcctcccgcctcagcctcccaaattgctgggattacaagtgtgagc

SEQ ID NO: 113719 - DNA, 131 bp, Homo sapiens
ttacagtagttaggaacagctaatctgatgagtaaaactcagaatagctattacaaacaattgaagaaatttgacaagaaaaagtacctcaaagaggataacaacacagaaataaaatgattcagtgtatg

SEQ ID NO: 113720 - DNA, 380 bp, Homo sapiens
tgtttcatagatacctctatgttttgttttcaattttttttcttcaaattgctttgtatttaatttactcctttttctacctccttaaggtggaggcttaaattattgattcaagaccttacttgttttgtaatgtaagcatttcatgctgtaagtttctaaaaactactttagtagtatccctgattttttgtttgtttgtttttgttttttgttgtgttttttgttttttcaggagcagaggtttaataggcaagagaaagagaaaggaaaacagctctctctctaatgagagagaggggacttcggagaggaaaagaggacaggagatacggcaatcgtggataggaaaggaggaaattacgatagaaaagttggag

SEQ ID NO: 113721 - DNA, 304 bp, Homo sapiens
ctatgtacctgaacttataatcatgtaagcgaaaagaagatggatagtgatgagcacactgttgtgtctaccccattctctcatcaacttttcagttactatctgccacaacaaagataaatgtgcaactgggctggtgtgagctgtacttttctcagccctttcactgatttatcctataaagaaactatcttcagcttgggtttattcctgttgtattagaaattaaccatatatatcgctgtagtcaccttctgaggtccatttcagagagcttccccaactccccagcatctttgcatgt

SEQ ID NO: 113722 - DNA, 356 bp, Homo sapiens
tatcttctggagttataaatcagaccagcctctttccaaactgaagtgatggtacaatacctcatttttgagccactagcacctgcagttgcttttttactccaattttatgagaaactatggcagaagttgtgctgtcgaagcccccaacaagcaggtcaaatggcattagtagatctccatttgacagcctggcttttgttgggatttccatgggacaagaaaatgcagtgcccttcccttttcctctcaacaccgctgagaatatctgctgtcaaatgatgcaaataaaataatatggacatgcaatacttaaatatcctggatctctgagctcttggaaatgtacatgaagc

SEQ ID NO: 113723 - DNA, 401 bp, Homo sapiens
ttagcagtgagggcaatcccatcttattggtgaggaaacaggttcagagagtttaagtatcttgcccaaggtaacagtcactgagtggcacagttagtgatgaattctgttctctttgataggaatagaggcccactgatacctgtgagcttagcagtgtatcattctttattttgtcagaaatgagtacagtgtttggcacatcataggtgctccaggttttagagaatacattttttgccgagtcgcagaaggaatcagtactttcctttaggaagattagtctggtaattacgtgtattggcctagttagtaaatgttttttgtgggcatgaatcaattgaatccttgtttttgatgctggctatgtgccaggcactggtgtaggtgctggggaccta

SEQ ID NO: 113724 - DNA, 400 bp, Homo sapiens
caggggtgctggggaaggccccacactggtgtttcatgacggtgccctgtggtggggcagtgatggccagctgccagggtggcctgcacgtggcaggctaagagtgaccagcctgaggggcccaggctctcacctgggagactgagaagccgtgctggcactcaggagggacttccagctcctagtcgtgtgggttgcaggccgtcctgtcccagggctgggggacttccttcaggcccattgctgcctgtggaagctggcctggtgtcttgtgggtgtgctgcctggatggtccctaggtggtggcgagggtcacacgctgtctgggccaggactcggtgacttccctgggtcggctggttctgctggcctttcctggggctggatccccaggcctgtg

SEQ ID NO: 113725 - DNA, 537 bp, Homo sapiens
cagggcccagagccattaaatactgccttccgggcatttcagagcccgctgcttctatttttctattctcagtctgtcagagagaccagtaagtaccagaattttgacttcccagagcctaggagagtgtatggcatatgacaggtgtttattaatgtgtgttcgtgggaagaacaaattgtgtcgctttcattgtctttcaatacaatgaagatcagttcctctcctgggccccacttcatagaaatatgcattcctgacttcacaaatggaactgcccaagaatccccactcatgttttctccccggagcttcccctgcacccacattctctgcattggttaggaatatcctcataggcgcaacactcctgaatagcagaccttacacttgtaccccgacaggcctccttgttccctgaagctaaccctgggcctggctttggggtttgcagccggatttgtcatcttctgtctgccagtttcactgacttggttattccaaggaattcctgggacttccctttgttaaaaaata

SEQ ID NO: 113726 - DNA, 653 bp, Homo sapiens
ctggagaattgggacggggggcggtcattacagtacacattctgtcctgggcccatgccaaatgccagggggtcagttgttcccagaattggctaggaaaaggtatagccatttgaaggaatgatatgaaagtattaaaaatggtgttgtaaagaagctatcgatatgggaaaacgcacatagtaagtatattgctgagaggaaaaaaagcaggctacaaaggtgtataatataatcccctttgtataaaacatatataaaatgttggaaggcaaaacaatcaaaagttaactctgttgccaggcacgggagctcacacctgtaattccagcactttgggaggcagaggcaggaggatcacctgagcccaggagttcgagactccatctctccaaaaaaaaaataaataaataaaaaataaaaataaaaagttaactgtggtttttatctccgggtaatggaattgaagataatgtgtttaacaaatgtgtattaagtacctaatctgtatctgtgccaggcactggatcactgaagctaaagggatgaatgggacaaacagggtgattttaaaaattctcttatacttctgcctttcccaagttttctacattaagcatgcattactttgtagttagaaaaaaaaagttatt

SEQ ID NO: 113727 - DNA, 586 bp, Homo sapiens
ctgggtctccttatgttgcccaggctgctcttgaactcctgggctcaagcaatcctcccacccacctcagcctctcaaagtgctggaattacaggctgattatacttttaaataaatcaaggcattgttctggtccttcttgattcattttacaatgaaaactggaacaccaacctggtttcacataaatgtcatactgtgttagactggaccgctttaatagctaaaaataaataaataaagctaccactcactaaacccttacaacctaccaggatccatgctaaaaatctgtaaatatgtcatctcttccaagccctacactaactccaacttacaaacaaggcaactaaagcctagagaagtcaaggtcaatttagtaaacaatgaagccaggatctgaacccaaagcctgactaactcaaaagcctgagatctttattacaaaaacaaactgcctcccctataccattctcagtggtataaacttggaggttcaaaacccataaatgtttctcaattcaaagctagctatacctgagggatttcttgctatatttgcctttatcataaaaggtgaataaag

SEQ ID NO: 113728 - DNA, 271 bp, Homo sapiens
ggaaggccaatgtggggaacggtgggcttgcctccccctcttcctggaccgagcgcgcagccatcacttgggccatggagaccaagagagcttccctgtcccacacaggtatggaagcccagagctccaggatcaccacacctgcccaatcatccagaaagaggtgtggagagggaaacgatcacgacacggacgcccacggggtttctccctgatggactgggaagtcttctttgttgaagacgttgagccagactaagaagccgccagg

SEQ ID NO: 113729 - DNA, 614 bp, Homo sapiens
  misc_feature (136)..(136): n is a, c, g, or t
tgtggtagtatgagccagtaatctcagctactcgggagattgaggtgggaaggttgcttgagctggggaggtcaaggctacatacagtaagccatgactgtgccactgcacattggcctcgggaacagagcaaganccctgtctcaaaaagtaaaaaaaagaaaaaatactttcagttcattttgccaaaggaagagtgattatatttggaagattaagataaatagctaccatcaacgcaacagattggtactttggccaagtgcactaaagttcagttctcaaaacaaaactattttcttgattcatatcagctcattctaatactgctctgctaatgtggctataacaagttcttttgaataaaaggcatcttgtaaacaagataggttcacaatatagacaaaggtgaatagtatatagctagggaaaaacgaaatactttcaagcagggaaataaaaatcacttctcatttccagaaatacacacttaaaaaaaattaggtcacttttaactggaaaaaaatttgtgacaagccaggcacggtggtggctcacgcctgtagtcccagcactttgggaggccaaggtgggagaattaatcgaacccagga

SEQ ID NO: 113730 - DNA, 308 bp, Homo sapiens
attttaataaattccccaggtgagtcatatgcacattaaagtttgagaagcactgatctatactgtctttctacacacttttttaccttactttatccttcaggattctggcgtcaagtccctccctatcagtctttaaaaactgtagccttaaatcagtagggatatagaagacatgaacaatactttcatccatcttgacctaactgccatttatagaacgttctatcccaagacatcagaatatatattctttttaaacatttaatgaaaggatttaactcccaaactccaaagcaagatgttct

SEQ ID NO: 113731 - DNA, 411 bp, Homo sapiens
ccccgaccgggtggcacagaggtgtgcagctctctcctggtttagtgggggaccatgggtggctgcctgctgaactctgcggggcccacagaagagcctctggactcatgactctctctcggaagcctctctgcctcagtcccaggggacctctccttaagaccttctgggcctcacagatcccagctaaacctcagcttggacacctagattcttggtgacctcctccgccattgccatcctgctgtgggacttctctgagagactgcggtgccctcaggagatgccaagggcagggaggccccgatctccctgaaccctccaaccaggggaatcaggaccatgaccctgatcttccgccccttcctctctccctctccctccacctcccccaccccccagcaccaggag

SEQ ID NO: 113732 - DNA, 282 bp, Homo sapiens
ccatgcagacacaacttccttgcccacatcaggcgccacggccgcccctctccatgcaaaagccctgctcaccccacttgactccgccaccccactctaggcctccctgtggttcagcatcctcaaccccgcttcagacttcactattccatgcccggcctcctctactcttcacccctgcctacatggatgcccttctgatcttgtttgggcccagtctctatgtactgagctgccacctgccacctgtaatgacattcacctcagcttcaggggccccag

SEQ ID NO: 113733 - DNA, 454 bp, Homo sapiens
ctgaattaaagtagtggcagtgggagtgaagacaacgaggggagataggccaagaactatagttagaacagacattagggacataaggaacatgggtattaaagaaaggaagatgattcctaggcttctgataatctgagaccatactgttttcagtttgtatcccatttttttttttttttggacagagtattgctctgttgcccaggctagagtgcagtggcatgatctcagctcactccacctcctgggttcgagcaatctcctgcctcagcctcccgagtggctgggattacaggcgcccaccaccgcgctcggctaatttctgtatttttagtagagacggggtttcaccatcttggccaggctggtctcgaactcctgacctcatgatccacccacctcggcctcccaaagtgctgggattacaggcatgagccaccaggcccggcca

SEQ ID NO: 113734 - DNA, 464 bp, Homo sapiens
taagtctgtgtttgctttgtcagtgtcctctctttaaagaggcagtattttggctagctgagagagagaagctaagttcatctataaaacaatctatactctcagggggaggagaagaggcacaaaaatcacaaagatctatgtggagacagcaaactttggggaggtcattttgcagaagagtgttctgcagcagctaaaggataaaaggaattggagaggaaagggaaagggtgaatgggcccctctgatattctctaacaaaagcaaataaaagatttagcttgtgaattagctttctctgtctttttcattgttctgtcccttgcatcaggcacaatgcttggcacatagatagctctcagttaatatttattcaattaattccttaaataatatttgtggctgttggaattgtatccttcaacaaatgatgctgcccagactacaagacctatagtcac

SEQ ID NO: 113735 - DNA, 454 bp, Homo sapiens
agaggttgatctgaagccagcctgtctgagagtcagcaacagagtcagccgcactgggactgttcagatcttcagcctacccaagggcagactccccaaattaaaaattaccccccatttcctgcctttgggctactttagtgcctctcagaagtgtcctcagggaaacggctctggaaggaagtaaaactgaaggcagagctggtaaaaagttctgtgcacagaggaatgtgaggctactggctaaaaacgactgggtttcaagtagtcttgcacctgccgccctaaccacacataagagaagtgactattgggacaaccaaagctccttgatgcctgcacttcctcctgctttatttcttcatctccaaagggattcatccaatgacttcttttggcaggaacattctagctcagagaaggtgagctgaaaattaagaatagctgtttgagg

SEQ ID NO: 113736 - DNA, 773 bp, Homo sapiens
ggaaaaacaaactcagtttctcctgtgataccctctcaccacacaatcaacacagaacacttctgtgacctctggtcaccaagaagtgtgtggcaatttctctctggcagcaaccagttctctgggagatctttcagcagacaccagctgggtgtcctctaattcagttcaattttgacactatctaactggagatggtgtcagatcccacaggttgagtactcagtcccataagactgcctccaatttccactgccaattccaagccccaggttattaaacctgtgcttctgatgaccagctataaatcagggttcccacaatcccttccttgggtttcatgaacttgctacagcagctcacagaactcagggaaatacttatgttccctggtttattataaaggatataccaattatcaccagatggaaaagttgcacagggcaaataatgtgggaagaggcacggagtttccatgccctgtctgagcacatcgtcctccaggaacccccatgtgttctactctctggaaactcttgaacctagtccttttggatttttatgcacacttcaatacttagacagcattgattaaatcattggccactggtgatcaacttaacctttaagcccttctccccagttcagaggttgggggtggggctaaaagtcccaaccctctaatcttgtcttggcctttcctgtgaccagccctcaccctgaagctacctaagggtggatagccatcagtcaactcattagtatacaaaaga

SEQ ID NO: 113737 - DNA, 395 bp, Homo sapiens
actcttgggatccaggtgtaaggacttcagaatattttgggatttttcttttttctggcaaggtctgttatgtgagacttttatcagggtctgagttaactctatcaaacacgttaatgtttctacattgaaacacgtgaatgtcacgctaatgggatagacgataaataacctcccagcattcacagtgggttctgttgcaaaccaatgaaaaaaattaaaatttcaaagcttttgaatttcgggactgtaggtaagcgattgtggagctgcactaaagggcttggaattcatcctgtagagtgtatcctcgacattgtggactgaaggatgttcctggagggctttcatatcaagaggataaaaggatcagatttctgatccagaaagatcac

SEQ ID NO: 113738 - DNA, 374 bp, Homo sapiens
accctgtttgttcaatatggaaaagtctagttccctatgggatatccctagtgggagcctgccagggagtaagaaccgagaattgatgagctttggtgactcaaatctggaagcacaaaaaccaccagtcccagaatttagctattataccagtgtgcattctaaaatgtttttctgaacattttggggttttttcatagggggtcgggtgggtgtggaagtagaggggagaaggacagattggcagggttttaaatgttctgatgaccaggtcagggtcaaaggatgttaccaggattccttcccttcccttccgttcccttcatttcacttaggtaaggatgatatggtatgacttgatggaattatgtagt

SEQ ID NO: 113739 - DNA, 164 bp, Homo sapiens
tcaccgtattagccaggatggtcttgatctcctgacctcgtgatccaaccgcctcggcctcccaaagtgctaggattacaggcgtgagccaccgcgcccagctcagagtgtcatatcttatctgattcttctagcacctagacactattttataatgcagtaaa

SEQ ID NO: 113740 - DNA, 1139 bp, Homo sapiens
tagtatttattgatcattcttgggtgtttctcggagagggggatgtggcagggtcataggataatagtggagagaaggtcagcagataaacacgtgaacaaagttctctggttttcctaggcagaggtccctgcagccttcccacggtgtttgtgtccctgggtacttgagattagggagtggtgatgactcttaacgagcagcagaatcaggcccagctcccaattccctctccccagtcttctccaggtgtcccctcccacgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagaccccctggactccccgcgacctggtctcttcacagacccagacccagagctgtgtgcctcccactgcaggagccagacaagcccctgagtctccatctaccatccctgtcccttcacagccacagaactccacgctccgccctggccctgcagcccccattgccctggtgcctgtgttctgtggactcctcgtagccaagagcctggtgctgtcagccctgctcgtctggtggggggacatatggtggaaaaccgtgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttt

SEQ ID NO: 113741 - DNA, 1282 bp, Homo sapiens
tagtatttattgatcattcttgggtgtttctcggagagggggatgtggcagggtcataggataatagtggagagaaggtcagcagataaacacgtgaacaaagttctctggttttcctaggcagaggtccctgcagccttcccacggtgtttgtgtccctgggtacttgagattagggagtggtgatgactcttaacgagcagcagaatcaggcccagctcccaattccctctccccagtcttctccaggtgtcccctcccacgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagaccccctggactccccgcgacctggtctcttcacagacccagacccagagctgtgtgcctcccactgcaggagccagacaagcccctgagtctccatctaccatccctgtcccttcacacccgtcctctccccttcctgtccctctgccttccaggccacagaactccacgctccgccctggccctgcagcccccattgccctggtgcctgtgttctgtggactcctcgtagccaagagcctggtgctgtcagccctgctcgtctggtgggttttaaggaatcggcacatgcagcatcaagggaggtctctgctgcacccagctcagcccaggccccaggcccatagacacttcccactgagccacagggcaccaggggggacatatggtggaaaaccgtgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttt

SEQ ID NO: 113742 - DNA, 1246 bp, Homo sapiens
tagtatttattgatcattcttgggtgtttctcggagagggggatgtggcagggtcataggataatagtggagagaaggtcagcagataaacacgtgaacaaagttctctggttttcctaggcagaggtccctgcagccttcccacggtgtttgtgtccctgggtacttgagattagggagtggtgatgactcttaacgagcagcagaatcaggcccagctcccaattccctctccccagtcttctccaggtgtcccctcccacgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagaccccctggactccccgcgacctggtctcttcacagacccagacccagagctgtgtgcctcccactgcaggagccagacaagcccctgagtctccatctaccatccctgtcccttcacagccacagaactccacgctccgccctggccctgcagcccccattgccctggtgcctgtgttctgtggactcctcgtagccaagagcctggtgctgtcagccctgctcgtctggtgggttttaaggaatcggcacatgcagcatcaagggaggtctctgctgcacccagctcagcccaggccccaggcccatagacacttcccactgagccacagggcaccaggggggacatatggtggaaaaccgtgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttt

SEQ ID NO: 113743 - DNA, 214 bp, Homo sapiens
atttcattgttttttatggccgagtagtagttcatggggtgtgtgtgtgtgtgtgtgtgtgtgtgtgtgtgtgtgtatacaccacattttaaaaatccaattatccattgatggacactgaacagttttttatataccctggatacaactttatcacatgtgcttatgtagatattttttctcagtggcttgtcattctcctaacagtgtcttt

SEQ ID NO: 113744 - DNA, 228 bp, Homo sapiens
cataattagaaattattctgacaccaagatggaaagtgaatgtgctggaggctcttcacatggcagcagattaacagttcttgataaatcatcaccgccaactagttagaacaactgctccttttcaggattttttttttattgttttgactcttctacatggccttggcagtaacgtttggaaattgatgtgtcccagagactgggatgcatccaataatgtagtct

SEQ ID NO: 113745 - DNA, 578 bp, Homo sapiens
ggagcgacgactcccgtcaccggggagccggcggtctggggccgtggtgacccgagggcttctttttctccccctacgcgtttgtgccgccctggggcatcctgggagaaccgagcgctccgccttgaagcgctgtgggagtcggtccgctagtcgtaggcctggtgcatcctgggaaagagtgtcccagatccttgtcgagaccggttccttttatcccacacctgccgctgaccgtcctggaggcttggagcgcttccacacggggagtctgggaaggtggtcgctataggcctaaggcatcctgggaagaactgccacaacgaattgtgggaactggccgttattgtcccgtagtggaaggttttgccctggtctctttgctcgagcattggaacgggtgcctattgtgttcacgcggggcatcttgggaattgactgctataggcccagggcattgtggggtctccagcactgtgtttgcctttcagtttggctgccataggcgtggtaggagtgggacttgtgaaccaagggatggccctacctgacgtctggaatactctggaaggggcctt

SEQ ID NO: 113746 - DNA, 194 bp, Homo sapiens
aaatctttgatccctaacctaaatcaggttaatacagactcatatgctccaattatggtgatatctttctcttaaccttggcagaaggaacattatagtaggtcaaaaagtatctttgagtttcattgagaaattaacccataagggaattgtgctcatggttgtagtgttaattagtttcaccatgaacatat

SEQ ID NO: 113747 - DNA, 343 bp, Homo sapiens
ccaccacgtagctgatactgtagaaggaattcttttaaaaattaaaatcttttaaaatttattattattttttaatatagagacagggtcttgctattgttgaccaagctggtctcgaactcctggtctcaagcaatcctcagcctcccaaagtgctaggattacaggcgtgagccaccacaccctgcctaaaaatatcgaacatatcttgtatttgaaattgcactgcaattttatatgagttaaataaatgaatatattcaatgcaaacatttaaagtacaatacaacccctttgttgctttaagggtgcaattccctgaatctctcttaatctcccaata

SEQ ID NO: 113748 - DNA, 234 bp, Homo sapiens
ggattgcttgaggccaggagtgtgagaccagcctgggcaacacagagagaccctgtctctataaaaaaatttaaaaattagcctagtgcagtgtcatgtacttgtagtaccagctgagttaactgaggctactgaggtgggaagatcacttgagcccaggaattcgaagctgcagtgagctatgatgacacccttgtgctccagcatgggtgacagagtgagaccctgccttta

SEQ ID NO: 113749 - DNA, 337 bp, Homo sapiens
gaaactacacctgttttgtggcttctggccacatgattcctgagtagaaagggattatagaaactacacttacaggctgggcgtggtggctcacgcctgtaatcctagcactttgggaggtggaggcaggtagattacctgagttcaggagtttgagaccagcctggccaatacggtgaaactctgtctctactaaaaatacaaaaattagctgggcatggtggcaggcgtctgtaatcccatctgcttcggaggccgaggcaggagaattgcttgaacccgggaggcggaggttgcggtaagttgagattgcaccactgcattccagcctgggcaa

SEQ ID NO: 113750 - DNA, 211 bp, Homo sapiens
cctctccagcactcgtatgtcgcctgcctcttcatgtgaaatggtggcgtccggggttcctccacagcactcgcatgtcgcctgcctcttcttgtgaaatggtggcgtccagggttcctcctcagcactcgcatgtcgcctgcctcttcatgtgaaatggtggcgtccggggttcctctccagcactcgcatgtcgcctgcctcttccatg

SEQ ID NO: 113751 - DNA, 124 bp, Homo sapiens
cagtgtggctgtgggggcggcacgcagagggaatgggcactgctagcagaacacaggctaggaaacagcttgaaaactgagctggtaaaaccaccgacttgtgcgttttacatgaactcgctta

SEQ ID NO: 113752 - DNA, 417 bp, Homo sapiens
aacatgagagtggcagtaaggtcgactcttattcattttatcgtcaaatagcttttttgtacgtaggtcattttgccactgccactatgttaaaatagaatgaaaaagacattcttgaggcattattacttaaagacagtttttggctgggcgtggtggctcacacctgtaatctcagcactttgggaggctgaggcaggtggatcatggggtcaggagatcgagaccaccctggctaacatggtgaaaccctgtctctattaaaaatacaaaaaattagccgggcgtggtggcgggcgcctatagtcccagctactggagaggctgaggcgggagaatggcgtgaacccgggaggtggagcttgcagtgagccgggatcgtgccactgcactccagcctgggcaacagagtgagac

SEQ ID NO: 113753 - DNA, 641 bp, Homo sapiens
taggagtgagtctcggtgctgggacagagagcttcctctctctgaactgctatttccctactgaaaaccaagaataaacatacccaccagatcagcttcacgggcatgttgtatggtttaaagacaatggggtctacaaagcattttgtaaattagaaagctccacaaagataccagctgtattcatcagcccatgagatgtctaaatgtgatccttaaattccaaaaagcttgctaagttcactttcctaatatatgaatataaaacattagtgaattatcaaataaatgaggtgtttcattatgttcatatactttttcaatatgtcaattataaaaaccattgtatctgagaccctatgaagaactacatatgaaattacaaagaaagatctaattatatatgaaaaagtatatatattataaagtctaattatatgtgatttcaaaaaatataactagattattcttaaggaactactgtagtggcaattgattttttaaatgtatacagaaatatcaaaagttttacaaaaatacccaaagtccagagtctccatttcacacttcaacaagtagtgcatgctttactcctattttagactgtttcatctcagaattggatgttatgcgtctctgct

SEQ ID NO: 113754 - DNA, 351 bp, Homo sapiens
actccagatgttatgtaattgttgaagtttatgtgtcatactcatgtttaaatttatacattcacatttatttttaaattaatatttaaaaaccagaataatccatttttattaatttgcctttatttcttctcccttattttgaaataaaataattgtagttaacattataaaaacacaacttaatattctgtttttcttaactagaaaggaaaagaaccatgcaaaaacttactacattgagaaaataggatggcagtaaatgggtttaggttgtatgtatttttccactccatccaagtacctggccattattttccattagattgtaaactctcataaaacatggat

SEQ ID NO: 113755 - DNA, 536 bp, Homo sapiens
tggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggc

SEQ ID NO: 113756 - DNA, 418 bp, Homo sapiens
tggtaacaactaaaatgcccttccggtgaatagttaaacagcctgtggtatatacacaccatggaatactactcagagataaaaggaacaaactattgctgccacacaataacttggatggatggtgtgacactaagtgaaaaatgccgggttcaagaccagcctgggaaacacagtgagacctatctctacaaaaaatacattcgaggctgggtgtagtggctcacacctgtaataccagcattttgggaggctgaggcggacaaatcgcttgagctcaggagttcaagaccagcctgggcaacatggtgaaaccctgtctataaaaaaaatacaaaaattagccagacatggtggcatgcgcctataatcctagctacttgggaggctgaggaaggagaattgcttgaacccggga

SEQ ID NO: 113757 - DNA, 407 bp, Homo sapiens
ccccaacccgggtctccagctccacagccctcaacctgcaacactggctacccactgggtctccagatgcatggccctcaaactggaacatcagctccacccccggtatccagctgcacagccctcaaactggaacatcagctccctgccgggtctccaggtgcacggccctcaaactggaacatcagctccctgccgggtatccagctgcacggccctcaaactggaacatcagctccccaccaggtctccagctgcacggccctcatactggaacatcagctccccaccagatctccagctgcacggctctcaaacaggaacatcagctccccacaggatctccagctgcacggctctcaaacaggaacatcagctccccaccagatctccagctgcacggctct

SEQ ID NO: 113758 - DNA, 480 bp, Homo sapiens
gtcatatgttttcatttctcaggtatatacctaggggtgcaattgttgggtcatatgcaactccctattcaaccatctgaagaactgccagattgttttccaaagcagatgtactattttacattaacacatacagtgtattccacttttcctacaaccttgccaatacttgttactgtctttttgactatagaaatcctagcacattaaggtattgcagtgtggttttgatttacatttctctgatggctaatgatattgagcatcttttcatgctctaactggccatttgtatatcttctttagagaaatgtctattcaggtcctttgcccatttttaaatttctttttattcttgacttgtaagttttttatacgttccagattcaagtcctttctgaaacatattgtttgtacatattttctcccattttgtgaattttcttttaatttttgttgttgttgttctttttttttttt

SEQ ID NO: 113759 - DNA, 435 bp, Homo sapiens
gtttggaacatctactcatattttcatactgtccctctctgggcaactagcttttgtaatttacaaatatttacaaatgtttaacaaatttaaaggttaaaaacaaatttaaagaaattatccacacagaagtacaaaagagaaaaaagatggaagaaaaaaacaagagcgtcagggaacgaagggacagtatcaacaggtctaacattcatgtcattaaaatccagaaggagaggagattgggcacagaaaaaatatgtaaattaataattgccaaaaacttcctattattggataaagatataaatttacagatttaagaggcctgttaaacccaaacaggataaactcacagaaaggcatggtcagaaaaatcaaactgctataaaacaaatgtaagggagacctagtctctccccggatcaaagaagaaaa

SEQ ID NO: 113760 - DNA, 410 bp, Homo sapiens
ggacgtgcagggtctgtacttgcccagtcgcactgggacttcaaattggggatgcagacacggccctgctcctggtgtgcgcgaagcccgctcagccggccagctcgcctgcacgcccgccgcgtccctgggccccaggagggcccccgtatccagctccgaccaaacagcaagcccgcagttggcgagcatctttcccagaccgggagcggggacagagcagagcagacggatccgaccagcgcaccacggcgccccagggccctcctaccgtcctcggccctcggccccccgttccccggccaccgcgcgggctccgccgctcctgggacgcgcactggctccggcccggcgccaccctctgcccctctgtcaccccgcacggaggctcccatcacccaagccgcgcc

SEQ ID NO: 113761 - DNA, 353 bp, Homo sapiens
tagcagctgggcttgctttttcttttttaaatcataaacaagttctattagagtttggttatttagccaatagaaatgtgtatagttaaatatgtttggactttggggaaacagtgtttatcaatcttaagaaatactcttatcgggctgggcatggtggcttacgcctgtaatcccagcactttgggagtctgaggtgggtggatcacgaggtcaagagattgagaccatcctggccaacatggtgaaaccccatctctacaaaaaatataaaaattagccaggcgtggtggcaggcacctgtagtcccagctattcgtgaggctgaggcaggagaatcgcttgaacccagg

SEQ ID NO: 113762 - DNA, 748 bp, Homo sapiens
gggggggaagcaaattgagggggaaaggtgagttcaaacctaaattcggccactttccatggagttagtcacctgtgctcactcacttgcaaaggtttctcgtttctctgcctggcagctttttaaaaaacaaacaaaaaagtgaaccctttgagatttggaaacatgttcaatcgacacaatggcaccattcaaaattcaccaatgtatgaactgcagcatatcatttgtaaaaattgcttcagcctgagttacctttcaccagctctctaagtctactcactgggtcactaggagtgagcaagaacattttgataaattctgtttccatgacgatgaattaaccagtgaaaagggggaggtgctgaaagatctgtattctgtagaatactctcaaatgtttgcctgttttcatttttagccatttagttctcatggctctgttccaggactctttaatttgccagtagctgtttttcctacacagattacaggagtaattcatcagtgaatgtttcactcagtggtcccatctaatgtaaggaaacataaaaatgaatttttccaattatgccttttttgtttgtttagaaagaatgtagtaagcttttttccttttcttctctcacaatctagctttagtgttcttattctcccttatttattgaccatcaccttacacaggctacaactgcaatttgtaagatgttgggatccgcttttaaataccaataaatccccgaaaggc

SEQ ID NO: 113763 - DNA, 832 bp, Homo sapiens
tgaaacaaaaagctgtgtgaaaagatcaacaaaattaacaaacctctagcaagactgataaaggaaaaagagaggacacaaattaccagtatgaggaatgaaatagggcatatactatagaccatataggtatcaaaagaatcataaggaaatcctatgaacagttctaaacacaattaagacatgtagatgaaagggactaacttctcaaaaatcaaactatcacaactcatacagtgtgaaataggtaatttcagtagccctatataagtgttaaggaaagcgaatccatactttttaaactttttagatatatggatgaaaataaacctatgaaaagaggttcacataattagtcatttgggaagtgcaaattaaaactaccatgaaatattactccataaccatgaaaaaaagtaagttttaaaattatgtcaatagcaaactggcaaggatatggagaaactagatcacttggacattgcagatggggatataaaatggtacagacattctggaaaaccaattggctgtgttcctgaaaaactaaacatgtgcctactatgtgacctagcaattgtattcttgggcatgtattccagaaaaatgaaaatgtatattctcacaaaaacctgtatactaatgtttataacagctctatttgtaatagccaaaaactgaaaacaatcaaaatgtcctacagtaggtgaatggttgaacaaacttcggtacatttgtaccatggaatactcagccacaagaaggaataaactgtagatacatacaatacagagatggattttaaggtctttatgttgagttaaaaaaaaaa

SEQ ID NO: 113764 - DNA, 635 bp, Homo sapiens
ggtactaagcctaatactcaatagttatttttttctgcttctctccctcctcccaaccttcactttcaagtaggcaccagtatcagttgttcccttctttgtgtccatgagctcccatcttttagcttccacttgtgagaacatgtggtagttggttttctgttcctgcattagtttgctaaggataatggccttcagctccagccacattcctggaaaagacatgatctcatctatttttgtggctgtctatagtattccatggtgtatatgtaccatattttctttatctaatctgtaattgatgggcatttaggttgattccctgcattttgacatattctaaaagttattatgtacatatctataaatttgtaaagaaggatcaaatagaatatatttgtcaatgaaaaaataatgtgttatataattactcccagattggcgtcagacgaagctgtgtcttaatttttgctgtgcccacctttaggtcctttgtcctctttcatttgttctcagctagctaccaaaacccccctttcaaagtattgactgcaaataattaagtgtagtacatttgccaggaatatttgtggtttaatatatgaccacaaaggaaggtagcgttcattcac

SEQ ID NO: 113765 - DNA, 248 bp, Homo sapiens
gaggcggaggttgcacagtgagccgacactgcacctctgcactccagcctaggtaacagagtgagctccgtctaaaaaaaaaggaattcagataaatgtaaagttaccatagtgatagggccaggcgcagtggtcacgcctataatcccagcgactccggaggccaaggcaagagaatcacttgagtccaggaattcaagaccagcctgggcaatatagcaaggccccgtttctacaaaaaatacaga

SEQ ID NO: 113766 - DNA, 2205 bp, Homo sapiens
gtccctccaactcacttgtgtttacatcctccccagccacagcacggcttctgccctttggattgctgcacgtgtgttgagcttactgagatgataccatgcaaaagatagactggctcggtaaccaggcagacccttttgcagtttgttgacaattacgatgagttccagatgtcccttctttgatatggtagaagggcatttatttatatgagagcaaatgtgtgtgtgtgtttgcgggcgcttttaagtgtgtggatagatgagtgtgcttgcacataatgtgctatttctgtgagttttaaagtaggcaagggataataaccaaagaagaaaatttcatgaagactagacatcataaagcataattttaatagtcactcaaccaagtattttttattttttatggatactctgaatggcaattaaatgtgaaacccagtttcttgggcaagtcaaattctggaatcacatccacctaaattaaaatgactagctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacaccatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatgttttctgcactctcagtcatgaccatctgtatcttgttacctgctttctctctcaacaccacagttctcaaccctgagccttccagagagagctattgatgatacaagaggaatcaccagggcccggatctaagatgcccttagaagaccagcccaagtgccgtcttagccattcagtgaagggcaaacagcccatgggtagtatggcccgagcactgaattcccttgcgccttttcaaagaacagttaacttggtgctaatgtgccctggtgaaataaataaaagatgggcagtttctgtggcattttaggcataggtttgcaatccagatctgattttctccaacataaatatcagctcatgttcttatttcaaaaagatttcttattaccgactaaaagctattttttacctcacctggaaactaccattgtgagggccatcccccaggcactgcacagcaccttggctgatgctggaagaggagggcagtcagtgtcacttctgggatgtgccccagcactgagaacaaaatgcaggcatcccccggggcagcatcagagtgcctttctagagggagccacgcacagaatgtaacaggatgaaacagtttcaagtaagccttgaattgaaacctgagtaggttaaaacaattctatttcatagcacatcacaatactgctgctactctgtagccacccccatggctacatgatgccctattcctaaataataacaatagcattgtcagtggaggctgggccaccatggcagaccttccaaaagtagtgagctacatagactacttagggaaccccagggaaactggtaccctacacctgggagcagtatctgccactgggataaagtcctactaaaaaaggaacggtaaatgtaccctaatgattaaaccccgtgagatacatatgatttcccaaatagtccatttcattaggaacttttttgtttgaatgaatgtcacataggtatcctcagtaacacagaacgaaattacctttgtattattgtgattagttgttgcttattattttatactcagtaataatgtggtacactgttaatttttttgcttttgtaaattatattctaatttattgccatgtttcctaacacttgtcctacattcattctcctgcttgtaatgaaaatgaaaaaatcattgtaacacttgatggagtgaaattccacgccaggcacagaatttttttgacatagataatttagtaaaataaaaattcagcttataataatgatacaga

SEQ ID NO: 113767 - DNA, 514 bp, Homo sapiens
cagatcagtggcactggccgatgctgatgctgccgggggactatttgcctcacacaagaaaggaccctaggcaggagaagatggagagatgtataaaaaaggctatgacagaaggcagagcaaggcagttgtcccaagcaacaaagttataggatcaaaggagaagcagcagcagttctcaaagtgtagtagtccagagagctttgggagcctctgagacttttcagagtctgcagggctacaaccgttttcttaataattctaacactttatttgactttttcactttaattctctcacaagtgagaggcgttttcttttttgaggcagagtctcactctgtcacccaagatggagtgcattggcgcgatctcggcttactgcaacctccgtgaagaggcgttttcaagaggctacttgacatgttagactgaatgaagcagcgggcatgagaatccagctgtcttccattaagatatactgaagaaacttgcaaaaatatatttccactctt

SEQ ID NO: 113768 - DNA, 686 bp, Homo sapiens
gctatgtatatgtatttttaaaatgtaataatttgatgtagtttagaattgatattgccctgccaatggttaggaagaatactcatcccaagatattttaactttttttcctctattatttaagaaatgaagaacaatgaagagaaataaagaaaagctaatttattcagcagtttacaggttgatgctgttatatatgtgtgtgtatacatatgtatacatatacgcacatatatacacacatgtgtatatatgtacacgtgtacacaaatgtatatgtgtatatatgtgtatgtgtgtgtatatgtgtgtatgtatatatatggtgccaaaataacagtgacatcaatgtgatagaagtttatttcttgcttataaaatttttgtgtaatgtccaggtgtggtggctcacgcctataatcccagcactttgggaggctgaggagggtggattacctgaggtcaggagtttgaggacagcctggccaacatggtgaaaccctgtatctaccaaaaatacaaaaactagctgagcatggtggcatgcacctgtaatcccagctactcgggaggctgagacaggagagttgcttgaactggggaggtggaggttgcagtgagctgagattgagccactgcactccagcctgggtgaaagggtaagactgtctcaaaaaaaaagaaca

SEQ ID NO: 113769 - DNA, 219 bp, Homo sapiens
actctcagcccatctggtcattagcattccaagaccaagagctctgggtcttaaagcttatacccacagccagtaactgcgtgacctgaatatatctctcttctacttgccaaatgtcaagcatcaattaatacctggattctcactgcatttctcagatccccatcctctctcatctcaggcccagcaaataattcctaattaatccattaatctatg

SEQ ID NO: 113770 - DNA, 470 bp, Homo sapiens
ctttatctggcatatggtaagctctgaatcaatgtttattgaaagaatgaaatgtcacccctttgtgaagccttccagagttgtccctgaagaattaatttctcaactccaaggtcctttgctcatcctgtcatcatttttgtctagtagtcagttgaaaaccaataattgaaaagcttggccggacacggtggctcatgcctgtaatcccagcactctgggaggccgaggcaggcggatcacaaggtcaggaaatcaagaccatcctggctaacacggtgaaaccccgtctctactaaaaatgcaaaaaattagccaggcatggtggtgggcacctgtagtcccagctactcaggaggtgaggcaagagaatggggtgaacccaggaggcggagtttgcagtgagccgagatcgcgccactgcattccagcctggatgacacagcgagactctgtctcaaaaaaaaaaa

SEQ ID NO: 113771 - DNA, 573 bp, Homo sapiens
tctcccactttagtcacccctgcttcataaatgtctgtgccagaaagccacagtgagcccccagtggcccctgtattacccacccagagagacaacctctcccctccatgaaactcatttctgggacccacacctaaactttaacacaaatcagaaaagttgagactccttaaaaatgcgttttgcaagctcacaggttcttggttcataagtgatactatggaacaatctggttgggaagggtggcacacaatagaaaaagttaatgattatctggtgtagtttgctttagtctgtgagttcaaaagtctcctcatttacaataaccttaaaggataacaaaataaagtcctagaagaaatgtaaatttaattatttccattttctcaaaatattaattgctgatacaattaaatggattggcctaaactgctccaaagcttttcctatctgctaattaaatttgccctcgctgccataatacaaattctgggaaaccttctggcttctgggcacactatgtaggatgagagaatcaaatccattcagtcctaatctactgccccacttaat

SEQ ID NO: 113772 - DNA, 669 bp, Homo sapiens
cacgtcacccattgcacagttggagactggaagagcaggagttagacacttgcccaagatcccgtagttgttggtagagttagaaactaaaacaaagggtccaggtcataaacccagagttgtttcctaatacattggccttctactgttacagagccataggactctgcattcatgtttacccattcattcacaaactaagcgttcattcatacaatgtgattggtagatcttagaccaatggctttcgttctgcttggacattagaatcacctggagcaaaaaccaaagttgccaggtaggggggtgatttgatttacttttacctggacatcagtatttttcttaagtgtcccaggtgatctgcagaagcaacagggttgagcaccaccgtggcagacttggctggtcctaactaccagccgtggtgggcgagtgaagatattcctttggctgggtggtaagtgccctgacgagatgcccatgggcacccacctccttccctgcaccgttcctgatgccgaaggcccttggacagcctgcactagctggatctggctccggtagaggcgagggaaggataacaccataatgaccaggcgtgtgcctcggctgtctgctgcctctgtgcagacatctctgagactagctgcaatggggccagttagc

SEQ ID NO: 113773 - DNA, 219 bp, Homo sapiens
agcgtaggagggaggagcgagtcagggctccagctgacgagcagagccagacgatccccacacgcttcctgggagacccggctgcaaggccaggctaatgcgcgctccgacgtctttgtgccaagccggggcgcaagctcaacccccatctcaagttcagccgcgcttcctcccgcaaggtcacgcttaaacactcgcgcagagaaaggaggagcggaa

SEQ ID NO: 113774 - DNA, 333 bp, Homo sapiens
ttcatgagagctagaaataatattgtcatgacggttattatttaaatatttttggtacaatttgggattttttttctaaattctcatggcacatctgagaggtctcacagagcaccagtgtttcaaggaataggaagacatgaccaagagtgcaactcgtggatggctgagttcttgcttctgcctctggaacaatgtttggtcaggtcaaaacaatttcttaaggtgcttacaaatcttgacagcaaaaacatccattttttaaaaattttttaaaaagaatggaaatctgagaagtaatcaaattcaaagaaaaaatgttattttgacgct

SEQ ID NO: 113775 - DNA, 257 bp, Homo sapiens
gatgctgggactgcatgtgaacttcacagcggccccacgggccaagcacaggaagaggcgagtcccacttccgactgccactcagaagggggatgaaagcccccatcacgtggccctccgtgatctggtttgcttctttttagaaaaagaaggtgtggctaggagcggtggctcacgtctctaatcccagcactttgggaggccaaggtgggtggatcacctgaggtcaggagttccagaccagcctggccaacatg

SEQ ID NO: 113776 - DNA, 706 bp, Homo sapiens
cccaaatttttcgttggggaaatttgttgaaccaggttaaacaaattttccaccacagggataacagtcttatggacccatggatttcaccccaaaacttcttaattccgaactcaacttataggagaaaactttgttacgcgttcccaggtaaccggaccgagacaatcccagggtacacaacataccaaaattcgcggccgcgtcgacgggctttgcatagattatttcatttaatcctcataaaacctcatttacatccctgttttcctctgtcatcattcaacatgtaagcatccagtttgacatacctgctttgtgaccttgggcaaatcacttgagctctgtgcttgtcttctcatctgtaaaattaaggtctactcttcatgaggttttatgaggattaaatgaaataatctatgcaaagccctgttagattattattattattgttatgttttattattattgttgttcttatcctctaactgcattcccatattgctctgtgcttcttctccctgaacctgaccttccactttttttttttttttttttttttgagatggagttttgttgttgttgccctggctggagtacactggcaggatctcggctcaccgtaacctccacctcccgggttcaagcgattcttctgcctcagcctcccaagtagctggaattacagacatgtgccgccatgccc

SEQ ID NO: 113777 - DNA, 491 bp, Homo sapiens
taaaatcccgctctctaagttcccttgaaggaagtgaactccataaaattttgcctgctgacttatttgtccactcctttgaagtatttaacattaatttcacctataaatcattggcacctcaatttttcattgaagtatcaggactgttaaagacataccctggatgtgcctggaaaaaaagatttgggaagcagatccactaatttaactgttattcacgtgcatcgttttggttgaaaccaatcctagttaccgtcaaagttctctaactcaaagtccgttttctttctagtttgtatttgtttgtgcatataattacagaaaacacattttagatggaacaccagcttgcttttttcagtttctttctgttgcattgatacatcttctaatggggaaagacatatgatggtacttggaaaaatgatgacagccgtaactggaataataaatgctaccgggaagattttatcaaatgtaaaaaataa

SEQ ID NO: 113778 - DNA, 100 bp, Homo sapiens
attaatttttaattaaaccattcatctttaatttccttcaactacataatcaagatgttgttcatatctagtagcctaaaattgttttcaaacttggatc

SEQ ID NO: 113779 - DNA, 450 bp, Homo sapiens
attggaagccattatcctcagcatactaatcgggaacagaaaaccaaacactgcatgttcttacttataagtgggagctaaataataagaacacatggatagatgtggggaaacaacacacactgggaactaactgagggtggagggtgagaggagggagaggagcagaaaaaacaactaatgggtactaggtttagtacctgggtcaccaaataatctatacaaaatccctcatgacatgaggttacctatgtaacaaacctgtatatgtacccctgaacctaaaataaaagttaaaaaaataatccttggcctatctagcttagagaggctcttagtttgaaagagacaatggatggtgtgcaaattgaaggtcacattatccttctaggctgagatgttcatagttcacagttcttcaggagctggcctgggcaatacagtttgatc

SEQ ID NO: 113780 - DNA, 213 bp, Homo sapiens
atttagggctgcatttggctacaggtaattaaacacccaactgtaaatatagcaaatatctaaatattaagccaggtcaggtgcagcagctcaggcatgtaattttagcacttcggaaggccgagatgggcagattgcttgagcttaggagtttgagaccggcctgggcaacgtagtgagaccctgttctctacaaaacataaaaataattta

SEQ ID NO: 113781 - DNA, 346 bp, Homo sapiens
aaaggattttagctttactctgagtgtgataggaagcctttgggtttagagcagagtggtggtgtgaccgacttggattttaaaggatcactctggcagctctgtggagaacaaactgtagaggcaatgttagaagcccagagactgggctggagacaagtacagttgtcctggcaagagatgactgtggctcaaatcagtgatagaagtggtttaaagagcaaaaaagcctgtttaaaaaacaaaaaagtggtcagattctgtaaatggtctgagtgtacatttcagcagtccattgaaaggctcttagtcttaaacctgtggcctctgccacgtggttccctgg

SEQ ID NO: 113782 - DNA, 388 bp, Homo sapiens
atgtccctgaatccagatacttgtaatacatcgtaacagaaatcattgttgtgggttgtggtaaccctcaccacacacacacaccccccacaccccacacccccaccaggctcaagccatcctcccacctcagcctcctgagcagctgggactgcaggcatgcaccaccacacctggctaatttttgcaccttttttttttatgtagagacggggttttgccatgttgcccaggctggtctcgaactcctgagctcgagctgtttgcccacctcggcctcccaaagtgctggggtgacagatacaagccactgagtccagcccagttgtagtattcaagcatcacatagtgtgttaaatgaccatgactttcacaagctttttgactt

SEQ ID NO: 113783 - DNA, 490 bp, Homo sapiens
cagacggacaggatcccgtcgccggttctggtgtacaggccactatactggcgtagtaactaactcatctcttttatccacaccctacatctaatctatgggtaaatccttatttggttctaccttcaagatacatacagaacttgatcacttccactgtctctacttctattaccctggtctaggccactatcatttctggcctggactatggcaatatccccagttcttggtatggtggccagagcgatcctttctatgccctgctcaaaacaaaatccagtgttccttaaacctctaaggcactggcccctgtttatactcttaacctcatgtctcaagttagcaggatctcacacttctccacacacaccagaatactgtggtgtccttgcaaggtcaaggcctcacaggggcggttgtatgcatactccagcagtgcaggcagtgaatggcaggggcacacgggcatctccggtgactgcaacat

SEQ ID NO: 113784 - DNA, 747 bp, Homo sapiens
agacaatttaaacattaagtgggacagctaacagtttacatttacagttctactgtagggctacctatgttaaatgtcctgccttcagtcataatacacagtcatgcttcacttaattgcgggatagttctaagaaatgtgtttctaagcattaccatcattgtgcaatattcatagagtgtacttaggctaacctagatggtattgcctactatacacctaggctatatggtatagcctattgctcctaggctacagacctgtgcaatatgttactgtactaaatactataggctactgtaacacaacaataaatatttgtatatctacacatagaaaaggtaaagtaaaaatattatgtaaaagacgaaaaatgctacacctgtatagggcacttaccatgaatggagcttgcagtactggaatattctctgggtaaatcactgagcaactgaatggtgagtgaatgtgaaggcttaggacattactgaaccctactgtagactttcaaaacgcgtacacttaggctaaattaagttgatgaaaaaaatttgctttaccaatacattaactttagattactataacttttaaccttataaactaagtcattttttaacttcttgactctttaaaaaaacacatcttaaagcacaaacacattgtacagctgtacaaaaatattttccttctttgtattcttgttttatatgttttttctttttattaacttttaaaatattttgt

SEQ ID NO: 113785 - DNA, 811 bp, Homo sapiens
ggtctttgcaccacaccatgcagttggctctttatatcgcagtgctcaaaatacatccactcctctaggagatagtgcagaggtacacacccctgttggggatgaaggaacaagcaaagagaggagactttgcttttagctacacacttcaaagacatacaaactataaggcaaagaaagatatctctctgcaactgtccacattaatttgggattataggtccaggcctggaggaaattagctagtcattaaagaaatcagatgggaataaagaacagatcatgagaaaagtagaaactgttatctgatatggattcacttttttaagctgttgggaattcctggtactaaagcctctgttagccaaatgcagaagtcagtgagcattccgagggacttcagaatccagtgcagggcaacagatacattggacccttctgcaaagtggttttcctggtaaaatcatggaaattagtgaggtctaatcgtcactctactcgtcacacactaggaaacaccgctggtattttcttctcttctatagaggaagaaaaatagccagaaaagaatggataaccttcattctgagttacatctgacaaaaagccaaatgtagggcactggccatgccttgagtatagtgaccatccatcccagttcgctcaggagcctcccgatttatgcttgctgttccagtgcaattacaaaaaaaacactactctttcctctaaaaagtgtcctgattttgacaataaattgactatttgatcaccctacttatagagcaggtttcaacttactgctcctttg

SEQ ID NO: 113786 - DNA, 807 bp, Homo sapiens
ctcggtggctcatgcctgtaatcccagcactttgggaggccaaggcaggcagatcacatgagatcaggagttagagaccagcctggccaacgtggtgaaaccccaaatctactaaaaatacaaaaaattagccaggtgtgatggcgcgtgcctgtaatccctgctacttgggaggctgaggcaggagaatcgcttgaacctgggaggcggaggttgcagtgagccacgatcaggccattgcactccagcctgggcaacaagagcaaaactctgtctcaaaataataataataacaataaaagtaaaggaaatagattagaagcaaaaattttcttattagaaaattaaaccttgaaaataatattttgataaataaagccatgagttgattctttggaaagactagcaaggtctggcaagtctgagtaagaaacaccaagacaggccaggtgcagtggctcacgcctataatcccagcactttgggaggccaaggcgggcggatcacaaggtcaggagatcgagaccatcctggctaactcagtgaaaccccgtctctaataaaaatacaaaaaattagccgggcatggtggtgggcgcctgtagtcccagctacttgagaggctgaggcaagagaatggcgtgaacccaggaggtggagcttgaagtgagctgagatcacgccactgcactccagcctgggcgacagagcaagagtccgtctcaaaacaaaaacaaaaacaaacaaacaaaaaaacaccaagacaaatacaaacaatatttgaacacagaagagacagaatcttgg

SEQ ID NO: 113787 - DNA, 662 bp, Homo sapiens
gatctgcccacgtcaggaatctctttctaaaaaggtctccagaaactttccgattctaatctcagccaacgttggcagccatgtgtggaagggaaaaccatttatagtgtatcaggaagaacactggattcgaagtcaggagttccagaattcaaatcctggtttggctattgactgttaacttcagtttgcctctttgaggtttagttttcacatttataaaatgagaagataatgttttcagcattgtaaggactgtgtaagaaaatgtgggcaactgtttgaaaccatcaacaccctgtgtaataatgatgcattattcagtggcttttgtgtgtcctgcagtacaccaatgtttgccttatatcaccacaactagtactcacagtaaccctcttagatagattttattcccactttacagaggccaaaactgagatttgcagagattaggaacttttcatgtggttacgtagccttggaagaatatgtacctaactgctaccctatatcgtctctccaaaattgggtaccattattttgtcactggatagttggatcatttgttgatggcttgtcagcatgacagcattaccccactgtcagcatattctgcaggaggactggactgattttgtccaataaatctgggttcttcaagc

SEQ ID NO: 113788 - DNA, 290 bp, Homo sapiens
cccaggtggtactacatattgtagagggagctttagccaatgactgctgaaagatctgtctctctggaaaatagatgcatcagcctgttttagggagtatagctaaaatcagctaactctcttgttttatttgcatactcgcctaataacttctggttaaaattgggcttcttatatagatctacagggagacatttctctggttttgttgccacaagtattacagctctgtcataattatgtttattattgtaaattaaaagataggtgttgcagttctataaatgttt

SEQ ID NO: 113789 - DNA, 267 bp, Homo sapiens
gttgacagcacccaattcagagcaaaactacatttccctgagcctacccctaaatcactgaacacagtccaaattgtataatgagctcctcctgacatcctcttgctgagatctctgaaattctgcctgttgtagtgtccaccttgctgcagtgaaccaatgaacccaactttgtttgaccacaggtatgttcctggtagtctttaactggagccggtggcatagtcgcttggtgaataaaactttgtcctaggcatcactgtagaa

SEQ ID NO: 113790 - DNA, 344 bp, Homo sapiens
agaagttttctggaagctaggcaaagaccgtgtttttaaaaggaggcagtgatgaattgcatccaaaggtacttaaagatcaagagagggctgagaatgaaacttggttttggtgacttggagactttttagtgatttcagcaaaagtggtttcaatggattaatgtctttaaaaactgctgcttcctgtggctttatttatcgtcaaaaggagaggggaagctctggaattgaactaagttgaaaccaccgttctgacggtctgaagtttggcttaagaagggcatcctcttaatagctgtcaaagatgaagattttcccctacttttatatgtaagttttgg

SEQ ID NO: 113791 - DNA, 723 bp, Homo sapiens
ggtaaggacttcgtgctatctttgtacaattaacatatagggcaaatttcaataccaatgacagtagatgtaatttcacatatcaagtagtttccctaataatttaggacttttttcactgacttcttgtcatatatgattctgtcattacttttttatatagctcaaaatatggctgatggagtgcttgtgcccttccatggttttttcatttggtatcactagtattatatttatttattctttttttccaggacatttgcaagacattcgtcaagttttgaggtttatttaaggtataactagataatgtattatgtaaatcagcctaaccagcacgcataaactaaaccatgtcacaggatgccaatagtgacagacggagtgctgatgcctctggaaatctcttcacattgtggagtttctcctcttctcttgggatatcttctctattttctgtgacagatgcctatttgctagatcaactgagagcatcagtgcctataggtaatgaaatacaaataaaactcaatttgtgttatggtctgaatgtttatattcctccaaaattcatatgtcgaaatccggtccccagtgtgttggtattaagagtcgaggcttttgggaagtgacagggtcatgagagtggagcacttgtgaacaggattagtggtcttatgaaagatggagcgtctgtttttcccttcccccatgggagtggga

SEQ ID NO: 113792 - DNA, 333 bp, Homo sapiens
gtaaattagagcaaagtcttgcaaatcctacaggatggcactgaactgtgatatcaatcttgatgacagataaattagcaaaaatttcatttagtaaaaaaactctttgccaccaagtcattttatttaaaaaaaaggtatacatttggaactcataaaaaacatagggctaattttcctaatatgtaaagagcttttacaaattaatcagtaattgatcttgaatccaaaagaaaaatgggcgaagaatatagttaacagaaagggatacataagtgacaaacatacgaaaaaatggttagctttatttgtaatgcaaattaaaaccaatct

SEQ ID NO: 113793 - DNA, 284 bp, Homo sapiens
tgagcctttatgcattagtcatatctctgcaaagttcagcattaaaaaataaaatacacatgcatataaaatatatattatatgtatttaatgtgtatgtgtacatatatatgtacagaagcattaccaacattatgcattttgtttgcaggtacatagtatatacatgtaccccgcttttaaagtcatatatatacatacatttaaaaatatacaatatattccacctgactttctcttaaatgttggtgaagtatttttataggaaaaaaattgtagccctg

SEQ ID NO: 113794 - DNA, 396 bp, Homo sapiens
caaaaaaaaaaaaaaaaaaaaaaaaaaatcacaggatctgaacagagatttctccaaagaagacgcacagatggccaacagcgtgtgagaagatggtcggcctcattagtcatgagggaaacgtaaatcaaaaccactgtccagccgggcgcggtgcctcacgcctgtaatcccagcactttaggagagcagatggcttgaggccaggagtttgaggccagcctgggcaacatagcgagaccaataaatagatattagtggtggcgcctgtagtcccagctagttgggaggctgaggggggaggattccctgagtctatgaggttgagactgcagttagctgtgatggtgccactgcactccagcctgggcgactaggaaacggtctttaaaaaaa

SEQ ID NO: 113795 - DNA, 744 bp, Homo sapiens
tcaggtgattctgggaaaatggcaatcatattccgtttttctccactaataatttcaagctgtctttcttgctgctaatccagcagtctaatagctgctggatcataagagacattttgattccatggaagtctacctgaggctaattttggagccccggcaaagaactctaaactcatgagcactgagaagaattgggcattaggagatctgtgatgcccagcagatatttgagactagccttctactaatttgccttagtatgtctgtatccctggcctccaacatatcaaaataatgctgaaaggctgattattactttgcttaatacttgatattagactattattacagataagagtatattttccatatataaacacacatatatatgtccaagcagaaaaacaaaactttaacttgaatctgaatagtttatgagataacctcatagtgccctaagagaatcatacatgagaaaagaaaaaaaaatgcttacaaagaaaggaaatcacatggaaaaagactgaatacagtggagagtagcatggtgatgaggaccacagtgacagctgcatgttcagttcaatatgacagctaacttggccagtaataggatgtcagaagcaaggtgttagttagtcaaatggaaggcaggaaaagattgaggactagccttgccatctgcccttacatggactctgacagttaaaccttaatggcaaatgaagcccaaaaaggatg

SEQ ID NO: 113796 - DNA, 348 bp, Homo sapiens
cacagtgctattagtgtgtgttcagtgtgttccaggaacagaaaaaaacccaatgtggttggagtggattggtgggagaaaagcacgtgagtaagtcagaggttatgggaggacagatcgtgtaaggcctacaggcattgtaaggagtttggcttttactgagagaaatgagaagacattggaaggttttaagagcagtgccataatctgactcacattttaacaggattgctttggcatctatgttacagaaaataagctgtgggagtaggggataaggtagaagcagggagagcaattaggaggcaattgcaataatacaggctggatgtggtaagcatagtagca

SEQ ID NO: 113797 - DNA, 225 bp, Homo sapiens
agatacgttgtgcaggtaaatttttcaaattcagaggatagttgccaaagagtgaaagaatgaaagtaaatgaaagaatgatactgaaatttcataccataattctcttgaaggaaatttcagtatcattcatttaggattattacagtgagaaagtgtgattaacttttgtaacatttgtgtttcaaattgtagtcaagttgttatgtgtaacatagagtttta

SEQ ID NO: 113798 - DNA, 600 bp, Homo sapiens
tgttctttatataaatggaatcatatggaatgttggaatgttcccttttttttttttgagacagggttttgctttgtttcccaggctggagtgcagtggcctgatcatggctcactgtagcctcaaactcctggtctcaaggaatcctcccacctcagtcacctgagtagctgggactacaggtggatgccaccatgcctggctaatttttttatttttattttttgtagagataggatctcaacatgttgcccaggctggtctcaaactcctagcctcaagcgatcctcctaccttggcctcccaaagtgctgggattacaggcatgagccactgaacttggctgaatgtactctttaagtgtccattttctttcactcaacatgatgtttgtgagactcattcacagtgttgtgtttacatggcttatttttattgctgtgttatatcatgtaacttaacacaattcgcttatccattctactgttcgtatttggtttgtttcctgtgtgggtctattataagtggtgctgccattaacattctagtatatgccttttgatgaattatgttttcagatctcttgggtatatacacagg

SEQ ID NO: 113799 - DNA, 774 bp, Homo sapiens
gactaatgatgttgctgatcttttcatgggcttcttggccatctgtacatctttggagaaatatctgcacaaatgtttgcccattttttaattgagttgttcattccattgaatttttaagaggcatcttccgttaaatatgtcattgtaagcctcatttcaatttcagaaaagttaaacatataataaacacatatcttagaataataactaaggtgctatctctttatgtggcttattttaaaatgtataaatatttactttgtctgtaaaatatacatgaactggcttttagaaaattgcctcattgtggggatgataatcatcttaataaagtaggttaagttacctattaaaaattaattaacatgattgatttatgttccattacatgtaccagtatctgctccagttaagcatttactatttaaacacactgtgttcatttttggggggaagatgtaacatattaaacacagtattagatcactgcattacagggtatagtgtgaatctgaaaaaaatgaagtttttgtctcttaattttgaattctaattattacgggaatattcaaaatacactatggaaaataatgatcatattttttaatgtatgccgccctttagagtctaatttaaatcaatataggggctacgtaatgatccatgtctgtttttgtcttcgcagaacctggggtctctgttctccatccgtgttgtgggactctctgtggcctgcagctatttgtctccgaaggacagtcggcccctctg

SEQ ID NO: 113800 - DNA, 431 bp, Homo sapiens
gaattatgtttttctttttagttttctatatattcaaaataatctaaaatgaacatgtaacacttttattacaggaggaataatattttaaaatcagtcacatgaagttgagtgtggctgctccaaagaataacctgaatgtaaaagagcaaacattttcagaacagagctctatatactaagtataagtgataagagcttaacatgctaaaatactgaagtttaccaataatcctatgaaatagctatcccattctgtggactaagaaactgaggtttcctgaaactcttaacaaaagacacatagctatttaatggcagaggcagaaatcacacacaaaggctgggcgcggtggctaacacctataatccgagcactctgaggccaaggccaatggatcacttgaggtcaggagtttgagatcagcctg

SEQ ID NO: 113801 - DNA, 272 bp, Homo sapiens
ggtcggtaccctgctccgcccctctctggcagtgcctgaaaggcagcgaggagatgaggaggagacagggcatctgggttgctggtaattttctattcattttctttctttctttgatacagggtctctgtcacccaggctggagtacactggcacaatcataactcactataaccttgacctcctgggctcaagaatcttcctgcctcagcctcccaagtagttaggactacagttgtgcgccaccacgcctggctaatttttggtaactt

SEQ ID NO: 113802 - DNA, 198 bp, Homo sapiens
acctcagttttttgcaccaaaaatgacttggttatagacagagaaggagagaaggagatatggaatgatgtgctgaaaacatggcccttgctgcatttagcttctcaccccacatcctctcctgttttcttctggttctgatgaccagatcccctacctcagagattatgcctcccccatacctgaggcaagctccca

SEQ ID NO: 113803 - DNA, 101 bp, Homo sapiens
aaaaaaaaatgttggaaacagccctacccctgccaggctgtgggtgaatgacggagacatgcaggtggccgaggagttaaggccgctgctgcgcagccggc

SEQ ID NO: 113804 - DNA, 472 bp, Homo sapiens
ggcgcggtctcggggagccgcgtggggtacagggctggagctttcctccagccttgcggcattatacgctgaacccggcccggatggtggaggcgggcacggactaccaaccttatctcacatatgggaaaactgagaaggagacacttggccaaggtcaccccgcaggagcaggagtcccgtctccttcccttgggcggtactttgtcccacctccccattcagttgggaggtgctggagtatgagggggaggccttggattgggattgaggtggggggcgttaccacaggggcaagcatctgaacgcttcagtctaagagtggtggcagttctctgggtcttggtactcaacaaagtttaaggtgactgtcactaatcagttgttacctattgttgagggaacaccagacttcttgcttcgtactccacagcgacacagtagtgccatttgctaagactctaggagttat

SEQ ID NO: 113805 - DNA, 325 bp, Homo sapiens
cctgatgaccactggcctgaaaactgttgtctcgtgtatttttttttctggctttttggttgtgtcaggtaagagtaaatccataccctgtgacaccatcttgctagaagtagaagtgttacctttttaatatattatttttccttcaaaacccacattagaaggaactttcctctgtaacaacaaccgacagcttgacaaagtgtgttcccattgtcctgtgattgctctgcttttcaaagtaagcctgcgaggtgggtgtcatgtcattcccattttacagataaggggacagaacctcagagaggtgaagagacttgttcaa

SEQ ID NO: 113806 - DNA, 562 bp, Homo sapiens
atgcatagacaacaaatatctttaacttaagatgatagattgatatgatggcatagggcgaggggtggtggtgatagtgatataatctgtagcttcaacgacttaaatctatagctaagatgttgactggagtcgcttagaattagccagacgcagccaattaggttggatcagacagtccagtgagcagatgtagtgcacaattattttttcaggaggctgatggagaaaggcttagcgatgagcaacaaagatgaagacaatgaaaaagatatgtaagtaaaatatataatatgtaagaaagtaaattccaaggtgaaaaagatgaaaaaagggatggggagccagggaaggcccttctgaagttaacttttgagtgaagacctaaaagagaaatatctatctatctgtctatctacctatctctatctatctatctatctatctatctatctatctatctatctatctatctatctatctatctactcatccatccatctatccaaactacatatatatacccacctatagacacatttatatgcctttatagctaatg

SEQ ID NO: 113807 - DNA, 738 bp, Homo sapiens
tattcttttaaggcactgcagtgataaggaatgcagggttattctgtatttattttttctttttgagacaggatctcattctgtcattcaggctcaagtgcagtggggcaatctaggctcactgaagcctcaacctctccaggaggtgatcttcccacttcagcctcctgagtggcttgtgaatattttaacaatgatagagacaaaagcaacctctaactatgtataataacattactttaaatgggataagtaaagttgtctgtcctttaagccaaacctatgttccaaactgaatttactcagtaatacatagcttttaatgacatgtatttttttatgtatgtatagcttgagtattgagagatctcttagaaatgcagtttaccatactattgcaagaaaagtatttgaataagtatactaagaaaagttgccagaactatttatcagtgttttataaaatttactgaattcattgtttctctctattaattctgggattagttttctttttacagagcatgtaattctgtttgctgatcaatcagataatttatgggacaatatttatttgacataaagtctgtttttttttttattcagtcagttcataactattgaggattttacggtctgccagatagatctcatctttattataggatttcagtttgcaaaatattctagtatcaggttttctgacacttgtagtaccttttttttaaccacatagaa

SEQ ID NO: 113808 - DNA, 175 bp, Homo sapiens
tgatttccaacacaaagtcctgcctttagttttctattccaaatggattgtaagtgatatactctttcatacatgggtgtttctgtccaacatttttcttttcttttttttctttctttcccctttccttccttccttcctttcttccttccttccttccttcctttcgttcctt

SEQ ID NO: 113809 - DNA, 482 bp, Homo sapiens
ttctggcaggtcagtgaggccactgtggatcaggcttttaagatcatgggaaaacacacataacaaacatgcaacatcttgtctagatttatgtgcacagttcagtgctttagcacgttcaccttgtgtcaccatcaccactgcccccccgcagaacttccgcttcttcccaaactgaaactccgtcccgcttaaattctctcctccttcccccttcccgtagaccctggcagccccattcaactttctgtctctaggtatttgtcagctcaaatgagtgactcacacaggatttgtccttttgtgaccagctcatttcactcagcacaaagtccacaagggtccctgtgttgtagcctgtatgactccgccgttcctttgcatggatataccacgttttgctcacacattcacctgttgaaggacacttgggttgtttcctgcggcagcttttcctgaccgaaagcttctcaaaaggacta

SEQ ID NO: 113810 - DNA, 386 bp, Homo sapiens
ccagaggatggggaaccaattgaccatgactgccaacaaattatagtccagacttatgctgcccgagatgatctcgtagaagtccccttaactaatcctgaccttaacctatatactgatggaagttcatttgtggagaatgggatacgaagggcaggttacgccatagttagtgatgtaaccatacttgaaagcaagcctcttaccccagagaccagtgcccagttagtggaactagtgcatcaccctctcaccctccctctccccaccaccaaaagttgagaaggggcagatatgccagcaactcttctacaagctctaattttaatagtctgagctttcctttccagatgtgcatacccctctgcatgtgtgtgggggggaag

SEQ ID NO: 113811 - DNA, 593 bp, Homo sapiens
ggagtacagtggtgcaagcatagcttaccgtaacctcgaactctcaggctcaagtaatcctttcgtctcagcctcctgagtggctaggactataggtacatgccaccatgcctggctaattgttaaaaattgttgtagagacaacaaacaaggactttagaggcctgcaaaagaaaatatagtctatcctaggaaggaaaagagcactaaactaaatctaacacttaattcacaattaattctgatatattgatatgctcatgtgtgttgggggaggtacatgtataaaaacgaaagggaacgggagattataaagagaaaacattcctcctaatactagctcttaactgcctcggggggttatagagtagtagttccaatggagattcaaaggtatcagcttcactcagttgttagagaagattggagaggcacttttattcttttctgccattgtatgtatacataaataaatccgcaaataataatgagagtgcagaaagaattaagctgccaaatgtatttcctgttgtgaacaaataaaggtagaggtcttctctcccaaaaagaataatcataggctaggcacggca

SEQ ID NO: 113812 - DNA, 546 bp, Homo sapiens
agaagacaagctacagactgggagaaaatatctataaaaaacacatctgaaaaggaatattatccaaaacatacaaagaacccttaaaatcaacaataagaaagtgaacaactcaattaaaaaatgagcagaagatctgaacagaaacctcaccaaagacgacctacagatggcaaataaacacatgaaaagatgctccacattatatgtcattaggtaactgcaaatgaaaatgaccaggggataccactatacacacattagaatggccaaagtctaacactgacaacaccaagtgctgacaggatgtggagaaacagaaactctcatccattgctggtggaaataaaaagtggtacagctactctggaagactgtttggcagtttcctgcaaaactgaaaacattcttaccatacaatctagcaatcatgttctttggtatttacacaaatgagctgaaaacttaggtccacacaaaaacctgcacccaaatgtgtattagcagcattaatcataattgcaaaaagttggaagcacccaagat

SEQ ID NO: 113813 - DNA, 183 bp, Homo sapiens
ccatcagagaaatgcaaatcaaagccacaatgagataccacttcatacccactaggacagttgtcattaaaaagataacaaaaacagctgagtgaagtgcctcacaactgtaatcccagtattttgggaggccaaggcaggaggatcacttgagcacaggagttcaatatcagcctgggcaac

SEQ ID NO: 113814 - DNA, 346 bp, Homo sapiens
tggggagacccttggacatgagaagggagtctctccattctttttgtcgaaacctgtgctaattctgaagaggccatcagcaggctgaaaacatatgcctcagaaggcaccccctcccacctggggagaagagtctggcccactcacgatatctgtgacagtgacaggacgcatgaatggatacggacccagaacgacaggtctggctatcacaggttctaagacatggccaagatgagcatggtacctcatccttcaaaccagcagctccccgaagacgatgctcatggggacaggaactggtagcgctactccaaagaggcagctaagaaatgttcgattgcac

SEQ ID NO: 113815 - DNA, 306 bp, Homo sapiens
  misc_feature (31)..(31): n is a, c, g, or t
  misc_feature (49)..(49): n is a, c, g, or t
  misc_feature (60)..(60): n is a, c, g, or t
ggaaggagtttaggtaaaagatagcagtagnccgggcgtggtggcttangcctgtaattncagcactttgggagaatagacacagagttctaagtaaaagatctagcatatgcagaggcccagaaaaaggaaagagtgatccattagggaagcagaatacaggaagctcaatgggtctggaaaagagggtaaggagagtaacggaaggagtttaggtaaaagataagcagtaggccgggcgtggtggcttacgcctgtaattccagcactttgggaggccgaggcgggcggatcacaaggtcagga

SEQ ID NO: 113816 - DNA, 690 bp, Homo sapiens
gaacatttaggttttttccaatttttatcattataaaaaatgctgtaattaacatccttatttgttcatgtccacatttctttttatgaaaattcagagaaaggaaatgtctggaccaaatggcatgtacaatattaacacttctgttatgtggtttcatattctgcagaaatattactgccacttctacattgtacaagagatctcatagccctaaacatttgctttcatagataattttctgttttttagaaatcttttgtctctttggttatagaaaaagagaacctctttttaattttattttttaaattactagtcaggttgaatgtttcttgttcctaggtcattaacagtttttattttggcaattgtctacagcccatttttctgctgtgttcattttctaatcgaattatgggatttatcttgtaaaaagcctattaagcctttttcatactttacacaagagatcacatctacttactttaccttaaaataacatttacttattttcttataaaagtaatatattatgtttgaaaagaaaaataatatgcaataatatacaataatatgtataatcataatagacaataataaaaatgaaaaaacaccaaccagaggtaattaacattaacatcataatattcttccaggctttttcagatagacaggtaggtaagtagg

SEQ ID NO: 113817 - DNA, 547 bp, Homo sapiens
aacagcaataacagtaaaaacaacaaaccctggttgggggcagggggtagaatccagaattgccatattacctaaaatgttcagttttgacagaaattatgagatatgcacagaaacgagaaagtatgactcttacataggaaaaagcagtcactagaaactgtctttgaggaagctcaaatgttggacttgctagatgaagactttaaatcagctatttaaagtatattcaaagagctaaaggaaaacatgtctaaagaaataaaggagagctgaagaatgagttttcaaccaattgaaaatatcagtaaagataaaaatgataaaaagcagccaaaccaaaaacatggagttgaaaagtgcaataactgaaataaaaagtcaccgtgggggcacttgaacaggtgggagaaagaatataccaagttgaatgcaagtaattgaaattatctggtctgagaaacagaaagggaacacagcaacaaaaaatgaaaggagctggatagacctgtggcataccatcaagcataccaatatacacataata

SEQ ID NO: 113818 - DNA, 401 bp, Homo sapiens
tgccagggaccagtgagaggtaagtagggatgaatagcactgggcaattttaagagttatttaaggtgaagaatgacaagtttagtgattgaatatgggtaacgagggaaaggaaggagtcaaatagttcctagacccctggcttgagcatttgtggggatgccgtcattgtatgaagggcacgttagtggggaaggatcaatggtttcttttttggaaatactgagttttgagtgccaatgcaatgtccacatggagatatctagtaaacaatttgaaataatgttttggacttagaagggtggaatgggctggagataaaagtttaggaattgttaccctgtggatgttaattgatgctatgctaagagatgaaattattttggaagagagatatggta

SEQ ID NO: 113819 - DNA, 287 bp, Homo sapiens
tcctccccagtcagcaccccacatctagaaccagtccagcatctcccaccagccctgggccctctcctccatcttcatctacccaggaacgtgagaactgctacttccgtttcccttctccctcccggcagcggcacctcctgcaagagcatcctcccctgcaccaagcgcccacaggccagccaccgccagctccgccttggtccaggggcgagggcttcataacctgggccctgctgacattttgagccagatcattctctgtggtgacggcgctgccctgtgtg

SEQ ID NO: 113820 - DNA, 399 bp, Homo sapiens
aaaattggtgtggagcctttgaaagagagagacaatgccagagcctgagagtcaggagcacagaagaaggcaagccagctgcatcatgggattgcatttaccacaccaagacaccagagtccttgatcccatcctttttgcctagatgttcatttacagaggcaatatgaccttgtagggcccaaaatattcgtgtccactgttttctttcctttatttttttccagaataactggagaactgcattaataaataggtttcttggttgggcgtggtggctcacgcctgtaatcccagcactttgggaggccaaggcaggtggatcacaaggtcaggagttcgaggccagcctgaccaacatggtgaaacccctgtctctactaaaaaaatacaaaatta

SEQ ID NO: 113821 - DNA, 388 bp, Homo sapiens
ccccgtgtacagtaagggccaagcacataggtatcatgtcttttgatgacctggtaagggattatttccctgcagaaataaaagcttcttatcgtcttcatatcagtaacaactggcatcatacatagtgtatgcatttctttataatgaatctaatgacacctgagtgagactcaggataaggaaatgagatttcagactacctgtattgtattcaatttcaatcaagggtaacctatagctgaatctcaagccattccctaaaattgccaaagtctttcagttgtgagtagtgcctcaatgatccacaaacatcataacaccatacacagcaaccaaaaaataaaataatagaaaaggattgtctatttgtgcaatcactaaagag

SEQ ID NO: 113822 - DNA, 650 bp, Homo sapiens
gggctgaagcagtcctcttacctcagcctccctagtagctgggactcaaaggtgtgtaccatcatgcctggctgatgatcctccaccttggcctcccaaattgctgggattacaggcatgagccaccttaccagcatcttaatgtgaggtgaactcactcagcattaatcagagccagccccagaaaatgtatctagtatcaagcatccagcatccacctgcttcagctcagtgaccccgcagatatccatggagcagctacatctgtgccaggccaggcagagcacacatgaacagcatgcagccctgccctcaacctaaccagcttaaggtctagaagacagcatgacaaagtacaaagcaccaagtgatctatgcaaggaatgcaagagggaatccatgaaagaaaacctagctgatgggaattggaaatgtttctggaaagggtagcatggaagctggatgttggaggagagataggaagaggaggagaggaggcggcgcccagaagagtgcaccacattctgctagggagcagctccaggtctacttggctgagacccgataaacggaagtagtgaacacctgttccagaaatacggccttccagctccctaagactaggggcccaggattcatgtgaataaacc

SEQ ID NO: 113823 - DNA, 294 bp, Homo sapiens
cagcggaacaagcaatccccccgagtagctgggaccacaggcacgcacagccacgcctggctaatttttttgtagtttttttggagacagtgttttgccatgttgtccaggctggtttcgaactcctgggctcaagcaatccaccagtctcagcttcccaaagtgctgagattacaggcgtgagccactgcacccagccctctgtatttcttttaacatgatgctattttaaaaggtctgtaaactcacagtgggcattgtcacctgtaatgcttgcttatgttgcagtttcct

SEQ ID NO: 113824 - DNA, 268 bp, Homo sapiens
gtcacatgtcattagattcctgtggagtaaatccatgtgttaagttattgctcttggcatcctgtggcctgttttacatgcaggagctcattcatcattaccatatccctatgagatgttagtattcctactttacagatgaggaaactgaggcagggagtttaaatatcttgtctgagccaagtgtggtggctcgcgcctgtgggcctatctactcaagaggctgaggcatgaagattgcttgagcccaggagttcaaggctgcagt

SEQ ID NO: 113825 - DNA, 248 bp, Homo sapiens
tgccagtcaattggctacttttgagacctatgcagtcaaagtaaccagcctggagggcaccataccaccacccaaaaattatgccaggtgggctggggtgcatgagaaacatggggagatggagatacaataaaggatgtggttgggagagcaagtcagggcatattaatgaaagccttgaaaattggttaggtttgaaggctgtggggactcattgaagatatgttagcaaggtattacataaaatc

SEQ ID NO: 113826 - DNA, 601 bp, Homo sapiens
ggtgaaacggcgctgaggactgacgatgtggggccgggtcctcttcccccgagcctgaggggctgcagctggggatagggggcccatgccttctgatgtctacaggcgctgacggccacccctccagatctgctttgccacggcatggaggcagaagatctttcaaaggctgaagacagaaatgaagacccaggttccaaaaatgaagggcagcttgctgctgtgcagcctgatgtcccacatggagggcagtcctccagccccacagctctctgggacatgctggaaaggaagtttctggaataccagcagttgactcacaagagccccattgagcgtcagaagagcctgttgagtcttctccccctattcctaaaggcctgggaacactccgtggggatcatctgctttcccagtctccaaaggctggctgaagacgtgtctgaccagcttgcccagcaactccagaaggcccttgtggggaagcctgcggagcaagctcggttggcagctggacagttgctgtggtggaagggggacgtggatcaggatggctacttgctcctgaagtcagtgtacgtgctcacggggacagactcgg

SEQ ID NO: 113827 - DNA, 961 bp, Homo sapiens
ggtgaaacggcgctgaggactgacgatgtggggccgggtcctcttcccccgagcctgaggggctgcagctggggatagggggcccatgccttctgatgtctacaggcgctgacggccacccctccaggtaggccaccttgctcttggcccagccaggccagcctagaggtgggcatatgggcgccgcctgtcagcgtggggcctactggctgcctcctgggaggctgactatggggcacatgtgacccagtgcctggtttgggtttgtgaatgtgggagaggaggtgagctggggagcaggaagtgtgtgtggcgtggggggcccatgtggtcagggccactccagggcctgggtctgcctgagtgtgtgtcactgctgaagtttgggagtcaggctgggctccagcagcactcctcgacctctgacggtaggtcaagtcctttctcggggtcctgctatgaagggaaccctgggaagggctgacacgggctttcctggttgtcgagggggcggagagagcaggccgacaggacagtgaggctcgccctccaagctccctcataggcctctgaggagtgcagagttggagggccatttccaacgggcctcagagggagctggtctatcccggccctgtcattactccactgggttctggtaagtaggtgcctccctgggctcacttccctcatctgaattattacagcaaaccattgaaacgcctgcattttctgcctaagcagggccacctgctcagtaaggactgattcttcttttcccctgaaatgaaacttctagaacactaaaccgatcctttgtcccaactcatctaaagtgtgggggggctggtttgataactaagggctctatgcattaccctttccatggagcacactaattttaatatgagtttatgtatagtcattcatttagttatttaacaaataggtattgagaaac

SEQ ID NO: 113828 - DNA, 636 bp, Homo sapiens
gagagactaggattccttgggagtcctttctgaggagccccagataggagctagtgagaaaagagtgttgtctgtgtgtgtatgtgtggatgcatgcttgtgtacacacacacacacacacacgaaaagaacatcagttgttccttttctcctttaaaaactccaagaatgcatttcaaactcctgtctgccaatctctcgtcctcccccagaaatccttggttaagtctttagactcaacaacaacaacaaagaacaaagccacagacaatctctccctcccgacaatgtcagctgtgaactgaagatctgaatagcctttaaaattgttttattgttgtcagcgctgcagaatggtgtgtaatctttgtattctggagaatttttaattggcacaaaagggcagtttagccggcatcttgtaggaggtttgtcatgcaaacggttagtgcctgccactcacaacatatagggctatccaagctgatttacatcagcagctccctctggttaatagccttgtatatttcctgggggtctctgagcagaagtcaagggaagatgaggcttccctcccctcctctgcatccacactgcattgcaacgcattaggaacctcctggcaccttcccctga

SEQ ID NO: 113829 - DNA, 391 bp, Homo sapiens
caggctgtgcagagggcatcgctggggaggcttgacgaaacttaaaaaaatgacaaaaggcaaaggggaagcaagcacatcttcacatgtgaaaggagagacagagagtgaaggtagaagtgtcacacacttttcaatcatcagatctcatgagagctcactcactatcatgagaagatcaagggaaaatctgtccccatgacccagtcaccttccaccaagcccctcttctaacacttaagatcataattcaacatacaatttgggtgggaatacaggaccaaaccatatcattccatccttgacccctcccaaatctcatgttctcacatttcagaacagaatcatgccctcccaaaagtttctcaaagtcttaactcattttagcatt

SEQ ID NO: 113830 - DNA, 442 bp, Homo sapiens
cctcacagacatacccagaaatattgtttaaatttgcaccctgtggtgcaatcaagttgaccataaaattagccatcacagtcagctaattgaagttattactctacttatatgaccatcttcagtctagaatttagttaaacattcgagttggaccattatctgtaggaatttgggttccaggaaatacaagaagaactgaaaataattttttaaaaaaatttaaaccatagtcatgtttatgcctgaaaataatactttaaattttttcctaaatattctagaaattaaagtttaccaaacatgaaccatttgttattaatattatacttttgatgaatgacttgataaaatacaaaagaaggaaatgtattttttaggagaggaatttgaataatttttccccaaaaaattcatatgtatgtaaaatatcttcatctta

SEQ ID NO: 113831 - DNA, 344 bp, Homo sapiens
gctagcttgatgtctgaccagtccccaggtgtacgataaccaagagccactgagagagggaaactctgattttattctgactgaaggcgacctcacattgacctatggggacagcacagtgactgcaaatggcttctcaggttcccacactgcctccacgagtctgtcgggctagtcggggccccgactagcccgacagccccgactagcccgaccccccgactagcccgacagcgcgacttctgagtctcatgaccactcaacccaagggacccctccccagaccagaaccaagtcagctgggggctgtcgtactaccctgtcgggctagtcgggggggtacc

SEQ ID NO: 113832 - DNA, 696 bp, Homo sapiens
tacttcaaagcgtcctaagtgatacacaaggtcatgagccaaaacacatgtttaatcaatccatacaacaaacatttaatcagcacctacactataccaagtcattagacagactcaaaggttaatagaggccagatgcagtagctcgtgcctgtaatcccagcactttgggaggccaaggtgggtagatcacttgaggtcaagagttagagaccagcctggccaacatgaaaatacaaaaattagccaggtgccgtggtgcacacctgtagtcccagctactcaggaggctgaggcaggagaattgctccaacctgggaagttgaggttgcagtgagccaagatgccaagatcatgccactgcactccagcctggtgacacagcgagactctgtcttaaaaaaaaaaaaaagaaggttaatagaactctgccctcctggaacccactccatccagtaagaaagacagaaaagaacataatatcaccatactttgtgtggtttgatgtgatgtgatggatacattgggtcagcacctccttctagcatgctatgccagggtccctggcagccaggactctgacaattaagactcagccaatcagattcagtcacacaagatgtagaaaatggaaggaaggtgaaggccatcttcctgttgtttttgccatttctgctaacaacacagttgtgaaga

SEQ ID NO: 113833 - DNA, 746 bp, Homo sapiens
gacgatggttttgtactattttctacaaaaagacaggaaagataagtcctctatcatggtaggtggaaatctattttttattgttaatagttgcataaaacctgaaaattctcacgcacacaaatttgctatttgtagcactgccacaggtttgttgcatttgtaattgcatatactgcattattgaatatgtttctgacaggagagagccttcgtttagtctagccactgatggaaactgaatcctttgtttacaattttagatacctgatgattggaagaattttctacagactagcttgtggctctatacattttacatgctgtttctccttcactactcatatatttctggtgccaggcttggcaagaggtgttttcattgtgatgtgacctctgaccttgcagggtgagatggaatgaggggcagtaggaatattcctgcctttttttctagtctggaacagctatcaatacctatccctggaggtgaccccaaatccatataaaaaagccactaaaccaaaataaagtataattccaaagtcagtttgaccccccagattccaaaaatgtccatgtctccttcagtgcagtcaatttaaaggaatgtttgatgagaggaaaattgcagtggatggcaacagcagtcataacagatccagttgaaatattttatttttacaaattttacaaaagcagagccattgaacacatttcgaggatcccttttacgtcttggaaga

SEQ ID NO: 113834 - DNA, 353 bp, Homo sapiens
agatatgctcccctctgtcacccaggctggaatgcagtggcatgaacatagctcactgtagcctccacctcctaggttcaagcaatcctcccacctcagctccctgtgtagctgggactacaggcatgcacactgttaattgttaagacagggtctccctacgttgcccaggctggtctcgaactcctggtctcaagtgatcttccctcctcagcctcccaaagtattggaattacaggcatgagccaccatgcctggcctttcttttatatttttaaaatttatttattgtggtaaaatatacatagtaaatgtactacttcaaccatttttaaatgtatagtttagtggca

SEQ ID NO: 113835 - DNA, 398 bp, Homo sapiens
ctctcgctccgtggccaggttgcacgtgcagtgtacaatctcggctcactgccacttccgcctcccaggttcaggcgattgtcctgcctcggccgtctggagtggttgggattccaggcgcacaccagcacaccgggctggttttttatttttagtagagatggggtttcaccatgttggacaggatggtctcgatctcctgacctcgtgatctgcccgcctcggtctcccaaagtgctgggattataggcatgagccaccgcacccagctgatactccaataattttttaaatgaataaaacaaaaatggctgcagaagaacatgacagtgtgatcccatttttctaaatgagtaaaaatagtggccgggatcgcactactgcactccagcctgggc

SEQ ID NO: 113836 - DNA, 317 bp, Homo sapiens
gggattggggacacctgtattagaagatagagtacctaatataattttgtgctttgaatctatgaaatatctggattttggatccaatgtgttcttcaagctgagtgacttgtgaaagcctcaagcctcttttgtctaaagatatgaaaaaggccagggtatgtctttttcagatataaaaaaaatacaatttctaggataacgcattaaataacatttactagtttttattgacaatccaacagaatggcctataaaattatgaagctataatactatgcacaaaaatgtgttgtttcaaaagtgtcctactttat

SEQ ID NO: 113837 - DNA, 525 bp, Homo sapiens
ttcctgacaagaagagttggagatgatgaatacaaaacccctgggacactgcctggcccatagtgatgttaccatcagtagtggctttgccgtttccagattgacatccatgccctaaacagagaactttgctgagatgaaatttccttgttggtatacttttgtgaaccactccattgagaaccagcacaaagccattgccttcttgaacgtcttcattaaaactagaataatctctgcccctcatttgcccatgcacatggaaaacccacggatatgccttccctgatggaaaatatgaccactgactggagttcgagaccagcctgaccaatatggagaaaccccatctctactaaaaatacaaaattagccaggcgtggtggtgcatgcttgtaattccagctacttgggaggctgaggcaggagaatcacttgaacccaggaggcaggggctaccgtgagccgagccgagatcacgccattgcactctagtctgggcaacaagagtgaaattccatctca

SEQ ID NO: 113838 - DNA, 380 bp, Homo sapiens
aggttgtgtacaataactaaattgtagaagggaagcagaaacagcaatgtctcttcaggtggtcaagaagccactctgatgggcaggctgtgagcatgggtcacctggaattccaccttcatggtgactgtgataagcatctgagcagctcccaacttctctgccctatggtggcacgcatgagtccccagtcctaccctaggagttttggtgcccacagaaagtaagtactgcctcggactaatcacattattccaaaggaggtcgggccaccaggtaggggcaacacaaggaagtagctgtgatgtgtttaaaggtgagaatgacatgactactcaagtgtccacggtaggaaaatatccttgtaagatggctcttag

SEQ ID NO: 113839 - DNA, 527 bp, Homo sapiens
tgcacagtatatccaatctagcagcaaatttataaccaaatcagacttctcatcacctccaatgctaccaggtccaagcaccataatcccccatctggattattttaataatgaccctagctttttcttccccaaaatttctaaacattatagccagggcaatccttttctgctgaaaactcttcagttgtcaaaggtctcccaatcccttataaagaccaacaggatgtgtcttcctgttaccctgctgatatcatctctttctaatcttttcttcattctgttgaagtcacagctctacttattccaagaacatgctttgcatgttatcacctcagaacatttatacgttaactattcttcgtctggaattctcttctttcagggatccacatgacccattccttacttcctttactccaatgacatcttctcagtgaggcttcctttaaccaaccctactcaaaaagtgcaacactccgtttcccacacacatagacacatgcgtgcatccccctggggaactc

SEQ ID NO: 113840 - DNA, 304 bp, Homo sapiens
tgcatatatttgtcttatccaccattcagtcatctttaaataactatcacagaaatttcaaagcaactgtaccttcaaataaaatgttgtaaggaagaaaagcatgtatgtacaaaagctcattaaacatctaacaaattcttccatatgtcctaatataatatttaatggcaatataatatttttgatcccaatgttttcatctttgatgtgaatacaatttaactgtaattgaatatattttcaagtttttaaagtaataccagattttaaacagaggcatgtacaaatttcactaataacc

SEQ ID NO: 113841 - DNA, 455 bp, Homo sapiens
agcaaaggacataattagagttgggcagaaaaaagcagggcaaaataggtgaattattgccaccttgaattgaaatccaaaatgtaacaaatgttcaaaaccatcgaaacttgactaaaggacggtggtggctaactcagttcattagcttccttataaaatgaccagtgtctcatgttaaataccctgccattaagttagcttctgtgtgtttatcgaaaaatacagaatcaaactgtatctctaatcccagtgagtcattcggaaataaatgcgtaaaaaagacagagcgagagagtgtgaataaaccatcacagacacatactcctcctaaaaaaacaaacgcaaggcgtaaaaaaacttcacagtgcgtgctccatttcctttcacccaggacgtactcaataaacgcttgttaaagagttttattttggtactgggttaaaaatacaccc

SEQ ID NO: 113842 - DNA, 353 bp, Homo sapiens
cccttcagcacctttgtttagtattccccagaacacatttctaccagattcctgcccagctggctggcttcttctcattattcagatctcaattggctgttacttcctcagaggggccttcctttaccactctgtctaaagtgccctactaatcctctagtcacccatctatttcctttatggcattatttgtaacaagattaggaattatcttgtgttagtttgtatatatgcccacccactagggtgtaagtgtagtgaagccaaggaccttgttttttgattcaccactacatctttagtacttaccacaaagtaggtacatagtatgggctcagtaaagccctaaatga

SEQ ID NO: 113843 - DNA, 500 bp, Homo sapiens
tcccctctcagtgtaaaggatgcaagaaacaggaagcccctggtatggggacacagtttaatcagaactcagagcgcacctttccagctgtctgcctggactgcagagagaccttggctgaatatttcatcctcttgaaatatactgctgcgacctgactgaacattttcacacaggggctttaaattagaagagagtctgtgatattctcattcgtaaaaccataacaaactgtttcatttgatcagctgcagcaaaccaagatagcctggtatataccaagagtttgtctattttttttcttctcttaaagcaatgatattaatcataccttgcatattcactatattataggagataaaaatagaggtaaaaagaaaatgatcaattctttaaaaaaaaaaatctaattcttcccccatcaggtgatgtcatccgggccaagaaatgcagacatagaaaggggcaaagtcttggtggtgcgtgcctgtaatcccagc

SEQ ID NO: 113844 - DNA, 352 bp, Homo sapiens
ctgatcagcccagaaggagtagtacagtcggcacctcccccattaatatgggtcaaagggctgggcgcggtggctcacgcctgtaatcccagcactttgggaggccgaggcgggcggatcacgaggtcatgagatcgagaacatcctggctaacatggtgaaaccccatctctactaaaaatacaaaaaattagccggatgtggtggcgggtgcctgtagtcccacctactcaggaggctgaggcaggagaattgcctgaacccgggaggcagagcttgcagggagccgagatcacaccactgcccactccagtttgggcaacagagcgagactctgtctcaaaaaaaaaaa

SEQ ID NO: 113845 - DNA, 260 bp, Homo sapiens
ctttccagagttgcaggtgcttcaggaggacaggaggccaggtgagtggcccagcatgatgccctggctgcagggttgtctctgaggataaagggaccctgtgcaggtgatcaggtaggcagggctccgggctgcttcgtgaccttcagctgagactctaggaccagcccacacaaacccctttctcctctggagggttcttcacacagggtggggccagtgcagagctggtccttcccagctgagagcttcttagcagc

SEQ ID NO: 113846 - DNA, 480 bp, Homo sapiens
aggacacagcaaaacaacggccttctacaaaccaggaagtgagccctcaacagacatcaaattggctgctttttgatctaggtcttcccagcctccagaactgtaagaaataaatttctgttgtttaagccacccaatttatggtgtttttgttatagcaggcctaatggcctaagacaccatccactctccccaacatatacacaaacgaatacaagtaaagttggggtaaatttaaataagataggtataatttatcaatgtcaatatcctagttatgatattacattaccattttccaaaatgctgtcattgggagaaactgggcaaagtatataaaaacatcttggcataatttctcacagctatctgtgaatccataattatctcaaaaaatagaattttaaaaaagatgaggctgggggtggtggctcgcatctgtaatcccagcaatttgggatgccggggtgggcaaattgt

SEQ ID NO: 113847 - DNA, 888 bp, Homo sapiens
ataaaattgagagagaaaagaatcagctctctccattatacagtcagcactattgcaaatacttattcaattactttcagcaaacacaaggccctctgtggtggctgctccatgggtaatttgctctggaactctgacctttcagtttgtgacagtgaaaagaaacatcacattaatataggagaagatagaaggacctctcgaaagacccaagaaagtggtcttgataataatacctaccacttattatattctcaccatataccaggcttctcatttaattcttataaagggcttcagagatgggcattagcatccccattttctaatgagggccatggggctttgttggtttatataacctgcccaatattagtggtagaagcagatttctcacagaaatctgccttgctctggattgatgcttaacaattagttctaatgcttcccatttagggagtagcaaggtcagccataatttaaattccattcagcaaatattgttagtcctggctacactcccagagccgtgatatggttgctctcctctaggaatttgtagtattattagaaataattataggatataaggtggtatagaattcaattccaaattggataaaaccatgagccaatttactgagcgcccactgtgtgctaggcgctattctttagtctgacgaattatagccatgcataaatgctgcaatagccatacaagtctgactaaattaggcacataatagacattttaaatatttcttattgcccaatgtccatattctcagcgtcagggttcaacaaactgggtgtgatcaactcacaatagctatgagtctcccggatggcacattcttagtccagccttggtgaaggtggcatggtcgc

SEQ ID NO: 113848 - DNA, 739 bp, Homo sapiens
  misc_feature (728)..(728): n is a, c, g, or t
  misc_feature (730)..(730): n is a, c, g, or t
  misc_feature (734)..(734): n is a, c, g, or t
  misc_feature (739)..(739): n is a, c, g, or t
gaagagctagcaccgagcttcaataccctgcagattaaaaaaaaagtttggattcacgtggcttctgccacagaaaggtacctcccgtttctcattcagctcttcaaattccctttagtggtcttagctgatttttaaaaagggccgggcgcggtggctcatgcctgtaatcccagcactttcagaggtgaatcacctgaggtcaggatttcaagaccagcctggccaacatggtgaaaccccgtctctactaaaaataaataaattagctgggcatggtggcgggcagctgtaatctcagctactcgggaagccgaggtaggagaattacttgaacccagggaggtgggaggatgcagtgggccaagatcgcaccactgcactccagcctcgggcaagagagcaagactctgtctcaaaaaaaaaaaaaaaaaaaaaagatattaagcagagtttttgtggatttaaccatccctgctggcttcctggaaacatttaattattaatatcacacctgaatggtaaacttttgcactaagttccaaagcttgggcagctacactttcattaaaccctacacaagaaacgaactgcatgtttgaaagagaggctgtgagccgggcgccgtggctcaacctgagcagacatattttatagggctccaggatatccttacccctccccaccatcaccttcttaccatgacctgcagctgtaccctgcagatnantttnttccn

SEQ ID NO: 113849 - DNA, 483 bp, Homo sapiens
tggcttggggagggaggcagcctgaagccagtgggtctccatcctaaccctgggctcatgaaagctgaaggaagtgtttcccacccatctcgggtcttcttggctcagctcatccctctggctgggctggagtcaaggcggagcacagagccctcctggacttcacagtggtacccaaggcctgcgactcacttcaccctgaagctcattaacagggcaaggtcaaagtaggaccattcgcgccagtgtcagacccatgggaaggaggggagccagcatcgtggctgaggccctgacccagacgttggctcacagaaggcaggaaatgcagcccctggggctcccgggggtgaaaggcgccaagctcatgcttttttcgtacctcagagccttcttggaaaagcgatgacatccccagcctcaagacaaggatgggaaactaaggcacgggctccagacccaggcctgccacttgctctggct

SEQ ID NO: 113850 - DNA, 266 bp, Homo sapiens
tttccccactcccatcaaagtcctctcagtaatcagaatgccttgttccaatttatgtctttgccacagattttatctatgagtttctcttatcaaattagcagattagagtagttgcgtttccactgctgtgccattcagttcttttcattgaattattttgtgattaacattgtgtagccttacctttcttctcagtatactctagtagaaagcccagcccaatttaaagtaaaataaattgtatatataaggcagaaaaacta

SEQ ID NO: 113851 - DNA, 533 bp, Homo sapiens
taagctcattagaggaagactgctgttttgtttactgtgatattccagtgcctagcaaaatgcacagtaaaatataagtgttcaaaaatatttgctggatgaatacctgtataaccctaacacaatggctattaaaatgcatcccttcctgaaattctgggtttccagtttgaacatatatacagtatatgagtgtgtatgtgtgtgtgtgcacgcgcacgcacgcaggtgcacagctctcatctgaagcaaaaaaaaaggcaacttgaaaactacagtatctgtagctccaagaaccagttcatcagtctggattctacttcatatgtataaaactggtggagttggattagtctcaaggaaatgttgtagcagaaaatcaaagagtattgaataagcattcagtaatgtcacccccactgaaggtctttccactcttgctaattcttaaaccactgggtacagagaggtgatgtactttgggtacagagaggtgatgcactctgcattattaaaattctctctttaatctg

SEQ ID NO: 113852 - DNA, 364 bp, Homo sapiens
atggagttaaacattttatagacattactgaatttattcctcaaaacacccctattatgtagaagtaggaactaaggcttagagtgattacaggatccaagattacactggtagcaaacagcactggtacaagatctgtattctggggactatcctaatgcaaatggttctgtagggaaaataatatggtccttgcatgcaggatggaacagaagttggtgaaggtcataagtgactaaggtgggggatgattgggagatatggaagaaaccaattccagagaaatgtcagagaaaggtgcggtggtattgctaataggttagagagatgggggagggcaggcactcaagatgactagcagttc

SEQ ID NO: 113853 - DNA, 625 bp, Homo sapiens
gaaagagaaaaaatgacagaaagcttctgtctttctgaggctaagatcccagagttgaaattaagttttaaaaaatgattggcaggttttactgcatatgtagatagtgttgtcattctatttagaccgatggtaggggtggaactgttaggcatctaaaagtattacaatatctgtattaaggaggtagaggtgacatagtgttattgttaaaggactagactttggagtcagtctacttgggattagaatgttggcatttccactaattagcttcataattgtggagacattttctggcctctcagagcccaatttattcatatgtaatagggaataatgatattacctatcttatatagttaatgtgaagattaaattagaaaatgttttagcagtgtctggattatggtgactactcaataatgatggtaatgtcagatacttgtatgattaaatcttttgggaaggttttatcaacaggtttttgtaatgattgaagggacatattttcaataattactgtgttaatcttgattttttgtcttagaattcagtggaaaagtaggttaatcattttcagagcccatacaaaattattttgtcatattttagtaatgggaat

SEQ ID NO: 113854 - DNA, 345 bp, Homo sapiens
cttcttagttttagtagtggttgtggatacttgatagaaagctgggcttttttcttcagaatagttctgaaagtgaccatattacattcaaataggagttgaggcattatccctgtaagttttctttttttcccccccaaaccaaccccaaaatggtcagtgcactgtaagtttttcagataagcaagtgggcctgttctcgaacaccagtgcaaaatgctaaaccagacttccatttcctgtgacctgccctggaatttgaagaggagaatccaggtggatccatggacagaacagcttctgaacagctctgtggaaataaccaccatggacatgcattcctta

SEQ ID NO: 113855 - DNA, 205 bp, Homo sapiens
tgtgcttgcaccgacagggtgctggctgttagtcgagggacatcaggccaatgtctgtctgacccctagatcaaaattcgcatcctactgatagaaggccttgggtctcgagccttttggttgcaggtgtggggatggtttccaggtctggaggctgccaactatggcaacccgttgtgctgtcgggctagtcggggggggagac

SEQ ID NO: 113856 - DNA, 286 bp, Homo sapiens
accggctagcagctcggtactaaagtacactgcacaggtgatgtatgcaccacctgatggttggaaatgaagagaaatgtataaccacggctctccagaactgaacaactgtgaagcccaccttcaggatttggggctgtgggctggcatggcccttatttcaccacagagctttctaaacaagtcaggatgcatgaaacccctggaagggctgtcgagtggagacagctctcatcacagcgtcaccaccacctctttcccagagagggacacacataagccagga

SEQ ID NO: 113857 - DNA, 802 bp, Homo sapiens
ggcaaaggcagagctgtaaccaatctcactgtttctgtacctcacttccgattcctgtacgtcactttaccttttttgtctataaatttgttctgaccataaggcacccctggagtctctgtgaatctgccgtgattctgagggctgcccaatttgtgaatcattcattgctcaattaaactcctttaaatttaatttggctgaagttcttttatcaatggccatgattgattgaatcattagccacacgactgaactcaatcattagaccttttcctctccccacaagtagggctaatatcacctgactcaaagccccaaccctttaatcacataattggtctttctagcttggcagcccccatcctgaaattatctaggggcctaccatgagtagcttcattagctactcatttagctactcatattgtggaacctacgtgtggtctgagaatctaccagaaataatggagacttctatcaatttagaaattccaagggcttagaagctttcatcccaggaacctgggatgaggaccagacacattatttatacaacaaacagaaacttaaaaactgtttggtttataaattttattataggaatgctggcccagagataggaatatagcaactaattgaggccaaaaagtcctatgaagaaaatcttcacagtcaaagcacaagttcatctctttgttagagaggtagctgctgaggatacaagagaacaataaatgaaatgtgtttaactcatgtttctgattcaagccttttctggaagacatggcattgtagacac

SEQ ID NO: 113858 - DNA, 3045 bp, Homo sapiens
caggaccgctggcgccagcgggagaaccaggaagcgcagctctccccttagctgactctggtgctctctacaggtggccttcactatcaactgcacagcgggcagaggcagaggaacacagaaccttctcacacagcgggataaaagggtgaatttggagctgacagatgcaggcttctccacttcaaacgagtcaaccaactccacctgaagaacttcatgctgctgcctatgtgtttacaaatgatgggcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaagatgctgcagtcactcacagcatttgtgaagagaggataaataacggccaaccagtagctgataatgtcttgtcaactgctccaccatggcctgatgctaccatcgctcacaatatccgtgaagagaggatggaaaatggccaatctcgaactgacaaagtcttgtcaactgctccaccacagcttgttcatatggctgcagctggtattccatccatgagtaccagggatctgcattctaccgtcactcacaatatccgtgaagagagaatggaaaatggccaaccccaacctgataacgtcttgtcaactggtcccacagggcttattaatatggcagcaactcctattccagccatgagtgccagagatctctatgctacagtcactcacaatgtctgtgaacagaagatggaaaatgtccaaccagcacctgataacgtgttgttgactcttcgaccacggcgtattaatatgacagacactggtatttcacccatgagtaccagggatccatatgctaccattacttacaatgtccctgaggagaagatggaaaagggccaaccccaacctgataacatcttgtcaactgcttcaacagggcttattaatgtggcaggagctggtactccagccatcagcaccaatggcctgtattccaccgtccctcacaatgtctgtgaagagaagatggaaaatgaccaaccgcaacctaataacgtattgtcaactgttcaaccagtgattatttatttgacagcaactggtattccgggcatgaataccagggatcagtatgctaccatcactcacaatgtctgtgaagagagagtggtaaataaccaaccactacctagtaacgccttgtcaactgttctaccagggcttgcttatttggcaacagctgatatgccagccatgagtaccagggatcagcatgctaccatcattcacaatctgcgtgaagagaagaaagataacagccaaccaacccctgataacgtcttgtcagctgttacaccagagcttattaacttggcaggagctggtattccacccatgagtaccagggatcagtatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtatgctaccattactcacagtgttcgtgaagagaagatggaaagtggcaaaccccagactgataaggtcatatcaaatgatgcaccacagcttggtcatatggctgcaggtggtattccatccatgagtaccaaggatctgtatgctaccgtcactcaaaatgtccatgaagagaggatggaaaataaccaaccacaacctagttatgacttgtcaactgttctaccaggacttacttatttgacagtagctggtattccggccatgagtaccagggatcagtatgctaccgtcactcacaatgtccatgaagagaagattaaaaatggccaagcagcatccgataatgtcttctcgactgttccaccagcatttattaatatggcagcaactggtgtttcatccatgagtaccagggatcagtatgctgcagtcactcacaacatccgtgaagagaagataaataacagccaaccagcacctggtaacatcttgtcaactgctcctccatggcttcgtcatatggcagcagctggaatttcatccacgattaccagggatctgtatgtcaccgccactcacagtgtccatgaggagaagatgacaaatggccaacaggcacctgataactccttgtcaacggttccacctggttgtattaatctgtcaggagctggtatttcatgcagaagtaccagggatctgtatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtcttcggtggaaactgtgccaaatacaccacaaatatctcctgccatggcaaaaaaaattaatgatgatataaaatatcaattaatgaaagaagttcgaaggtttgggcaaaattatgaaagaattttcattttgcttgaagaggtacaaggatctatgaaagtcaagagacaatttgttgaatttaccatcaaggaagcagcaaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgc

SEQ ID NO: 113859 - DNA, 390 bp, Homo sapiens
cggagtctggtgggaacggcctcttcgggactgctccgagagacggtgtgcagagcctggcgtgctcgccgaggtctgacaggcagcccggggctaggtcctgttggatttttttttctaaggaaaatgggaagtggtggtagggtttgagcagtggagtcccgggcagttttaaaaggatccctgcagctgccggctgggagggcgtgggtgcgcgtaaggccggaatcacagagaccaggtagaagatgattacgagaacccaggaacgtggccctcaggaggccggcagtaccaaggggacagcagctgggaggagagaggcaggagatggtcaggggccagaccagggaaggccgcggagaccgcagaattcgctctgaatgagtg

SEQ ID NO: 113860 - DNA, 306 bp, Homo sapiens
ggagcaaggctttcaggctcttggctctcactgccaggtgagccaaaagttctggcttgctggtatccccttcccactctgcccagttcctttttctctgttttactctccatagctgatctcataaatacttagttttgctgtgtagaaggcacagcacttgaagccacttctgtggcctgtgtgccacgtagcctgataatgatccagcaagatcatttctagggctaatatgccgattcatgttgttatggatgttaggactctagagatggaagggaccatctgggccaattcccatcacct

SEQ ID NO: 113861 - DNA, 292 bp, Homo sapiens
gggggacgtgaggaggcatgtagtgactgactgcaggacatgggacccccctgctcggcttctgctcctaccccaccggtcactgggtcagacaagcttagcctgagccccgcgtcaccatccctgtcctagtggtagcctcttgctgtttagaaaaacagagttgggggagatgacagtagcttgcctgtgatctacacacagggcaggttgggaggggtcctgcacactctgtcacgtagtgctcatcccagctcctgcctgctaggtttgtggcaatatttgtggtaag

SEQ ID NO: 113862 - DNA, 620 bp, Homo sapiens
ctcctgagctcaagcgatcctccagccttggcctctgaaagtgctgggattataggtgtgagccaccgcaccggcccccgctggcttccaagggagggcaggctggattccatttgctgccatctctctgcctccaagtctcatcccaccctacctccacttccttgcttgcttacattgtgcttaacagacaaccctgccctcgaaacagccttgagatgcctctaaatcatcaactcctgttcctctttgaactctgtcccttcacccttaatctgctgggacagcctttttcctgatgcattttattaagatttcatcacccgggaggcagagtttgcagccagggcatcttcccgccagcttgggggcccagataagtggctttggaggagggctgagtcgccaacacctgcacacgagaaacctctccacttgccccttcttctgtcctgaaatgtcactggagcctcatcctgacacaactctttccaaactcgcccactggcttgcttgtgccatcattccaaacacctgctcagctctgctgggccaaggaagcaacacgctgcgcttgttagattctgcgtgacttgcaagcccccagtctctggtcctgg

SEQ ID NO: 113863 - DNA, 242 bp, Homo sapiens
gacctgtttctgcctgtttcaagttccatataggaattagatcagtagttggcaaatgacggcctgtgcgccaaaatctagcccagtctgtaaataaagtcatgctggaacacagctgtgctcctttgttgatgtgttgccgtgttgcctgtggctgctttcacatcacaatatcagaaattgagtagttgatacagagactacgtggacagcaaatctagaatatttaccatctagctctt

SEQ ID NO: 113864 - DNA, 322 bp, Homo sapiens
tctagatatatatctaataagaaatgtataaaatcgatatggagaaagtgataaaacttttaaaaacaatgtaaaagaagacctgaataaataaaaacataccatgctcctgggtgggaagactcaatattgtaaagatgtcattctcccccaattaatctataatttccaagcaatcccaatcaaaatcccaacagggcttttttttttttaatggaacttgacaagcagattctcaagttcatctgaaagagaaaatgtgcaagaatagccaagtaatttttgaaaaggaaccataagagaaaatttgccctatcagtta

SEQ ID NO: 113865 - DNA, 728 bp, Homo sapiens
aagtcctcctttgaggggcacagcacacggcagctgacagcgtgtggcagacagagggccaggcagagcggcggcagaggggccggcaccgccccagccccagagtccagctcccgacacacagggagacgggggccagggcctgggagccaggctggggacgacctcaccctgtgtgtcaccaggaggggcggcaccatcgggctctcctgctccccgtccccttccataccctgaggaccagccgcatcaaggggctttgagcaaaagcaggcgtcctgggaaaatgacaagctcaaactggcctcaagaacttttcacttcagggttctttcagataaagtactttatgcattaacaaatctccatcttcccggaaatctattctcacaattggaagcgtgctccctacaaaccggacagccccataggccccgaaacagtgcttgcttctaggaattattctagagtcaaaagtaaggtcctcttgagagtggatctcaggtaactgtaagcccagctggcagccaggtagccggaaaagccaggctgagccagcacatccccggtgcagcttcctgcagcgagcggccccctccccacgacgcccccgggtctcccctcaccactgtcccatcgcaggatctcagcaaaccgttccctcccacgtggcagcccaggttgcataaagttgattcgggtcagaccagccccgagaaagcatccct

SEQ ID NO: 113866 - DNA, 215 bp, Homo sapiens
tgactgcattacagtctcagccttctcctcggcagcactcccccgtcgctctcagataacatcccccatccctgccatctgggcttcagactcccacttgggggcacagggaagctggggtccacctccaggggcccatctgtttacttctgcaggtccaaatccaatggccaagatcacttggccagtgacctggctccccacaacctctcaga

SEQ ID NO: 113867 - DNA, 3506 bp, Homo sapiens
  misc_feature (10)..(10): n is a, c, g, or t
ggcgtgggcngacaagccgtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaaatattccaagtcttcagaattcattaaatggatcttctgctggcagaaagcacagctgagtacaagctaactggagtaactttgctgttttgctgcttgttgcatgcacactggaatggaaagcgagctcccttttccccttccccagcgccgtttgacctctcccaaggatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagcccaggttaaggcatttgggtattgtttcatttaaccaatttggggactaagatgggaaacactttttttattaagtttttaattcatagtcactaaagagataaatgtttcttatatacatttgtgtatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattaggaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttttagcatgtgttttctcctctttggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttcctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacctaaaaaaaaaa

SEQ ID NO: 113868 - DNA, 3455 bp, Homo sapiens
  misc_feature (10)..(10): n is a, c, g, or t
ggcgtgggcngacaagccgtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaaatattccaagtcttcagaattcattaaatggatcttctgctggcagaaagcacagctgagtacaagctaactggagtaactttgctgttttgctgcttgttgcatgcacactggaatggaaagcgagctcccttttccccttccccagcgccgtttgacctctcccaaggatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagcccaggttaaggcatttgggtattgtttcatttaaccaatttggggactaagatgggaaacactttttttattaagtttttaattcatagtcactaaagagataaatgtttcttatatacatttgtgtatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattaggaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttttagcatgtgttttctcctctttggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttcctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacctaaaaaaaaaa

SEQ ID NO: 113869 - DNA, 347 bp, Homo sapiens
aataatattcattctgactggtgtgagatggtatctcattttagttttgatttgcatttctctaatgattagtgatgttgagcaatttttcatatgcttgttgactgcaagtgtgtcaaaaatagctttttaatttattgagttgctattcacattgaattgaaaatatctgtaatttgcctcacagattctgatatatagtaagttttccacagatgttaattctgtttttgttgttgttgttgtttgaaagctctccacctaggaagagaattgcctccccacttgcaaaggcaagtttaatagaacataatatctttatcctgtgtctagaaattgctgtttta

SEQ ID NO: 113870 - DNA, 455 bp, Homo sapiens
cctcccaccattccctccaccaccttcgagaacagcaaccatccccaatgcccacatctcctcttggggtctcccccaggcagcaggtgaggtccccatgacttctctgtcttcaagtcagggtccacagtcagctgtttggggatctgccccagcatgtgggccactgaccattgggtggggtcctggtcctttccagaagggcaagccatacccgtcacttgcctctcataggaaacaccatctctaatgaatgcaggcagggatcacccaccacctatgcagagcttcctgctctcattggcttttctcagcctcactgtcctcttgctgacatccggttgggaccatttgcgcaactgcagactggcagggccaggcaaacacagcatggcgcctgccaagaaggtggtgtgagactgggcacagtggctcatgcctgtaatcccagcact

SEQ ID NO: 113871 - DNA, 491 bp, Homo sapiens
tcttaataaatgttagctatttttattacccatatttccttgaacaacaaagcttttcacaatcaaagaatagcttctcaaggagaagaattaggggttaaaagggttaaaagttctgaagaatgaatcagcatttttctctcccttgtctttccctgtctgtttagcaacactgattaacagctcagaggaagaggtccagaatgaacttgaatgacaaggaaaacaactaatcttccctaggcaatatccttattaaagtttcactttagtaacaaccaggttttcactgagacaggttggttggggtggggtgggtagaaaaggaaaaagtaggccaggcacgcgttcgtgatacagaatgtacgtgctttgattatttctctttttattgtaactttaatcaaatcttcaattcatccatgacccaaaagattaagcatcactcttagaagaagcaactccttcccttgattctgtgtatttggatc

SEQ ID NO: 113872 - DNA, 143 bp, Homo sapiens
cacacacacccccacacacagccagggcttctccactgcagcactagtgacatgttgggctggatgactcctgtcacagggggctgtcctgggcattgcaggatgttcaatagcatccttagcctctgcccacgagatgccag

SEQ ID NO: 113873 - DNA, 721 bp, Homo sapiens
caaagtgctaggatcacaggcatgagccaccatgcctgaccagctagctgtcagcttcttgaagtcaagattcatatatgatacatctctgtgttcctgctatgatcttatacatatttggagctcaataaatacgtcttaaattgagtaaattaataaattattatactagtggtttatgatgccctgtaaattttatttttcatttttaactgttttaattacaatgtttaactttttatttgaaatgaaaataatgaaagaaaagaaataaaatagtgaagaatagtacaaagaaattccatatatccttcacccagattcagattcactaattgttaacattttgccacatttggtttatcattaatttctctctatatatgtacacacacatacacatattttctggaaatgtttgagtgcatttgtaatgcccccttactctaaatactataggatgtatttcctgaaaacaaggacattctcttacattaccacagtataaatttctaaaccaggacattgatacagtactgtcatctcatctacagcacgtattccaatgggtaacatccttcatggcggtccctcctcctggctctgctcctctcccccatcatacattgcattagttgccatgtctctttagtctcatttaatttagagtagttccttagcctttatttcatgatcttgatatttttgaagaatgtaaacc

SEQ ID NO: 113874 - DNA, 770 bp, Homo sapiens
tatgacaataatattgagccgttttccatctcctgttttatgtatgtatatatgtgtatttgtttttattaaataataccatgcctgaccagctagctgtcagcttcttgaagtcaagattcatatatgatacatctctgtgttcctgctatgatcttatacatatttggagctcaataaatacgtcttaaattgagtaaattaataaattattatactagtggtttatgatgccctgtaaattttatttttcatttttaactgttttaattacaatgtttaactttttatttgaaatgaaaataatgaaagaaaagaaataaaatagtgaagaatagtacaaagaaattccatatatccttcacccagattcagattcactaattgttaacattttgccacatttggtttatcattaatttctctctatatatgtacacacacatacacatattttctggaaatgtttgagtgcatttgtaatgcccccttactctaaatactataggatgtatttcctgaaaacaaggacattctcttacattaccacagtataaatttctaaaccaggacattgatacagtactgtcatctcatctacagcacgtattccaatgggtaacatccttcatggcggtccctcctcctggctctgctcctctcccccatcatacattgcattagttgccatgtctctttagtctcatttaatttagagtagttccttagcctttatttcatgatcttgatatttttgaagaatgtaaacc

SEQ ID NO: 113875 - DNA, 385 bp, Homo sapiens
gaatcttttgaatttttgccagtcttatgaaggtgagaaatgatagctatttcattgttgtaatttgcacttctctctcactaatgagattgagcatcttttgagatgttcgtgggtcacttttctttgtccttctgtgaatcacctgtttatatcctttgcacattttcagtagtggttgcttttttcttattgatttatgatagctgtttattatggataaatataagtacttttatatttaaaaattgtgagagccaagtacaatggtgcacacctgtagtcccagcttcttaggaggctgagacgagaggattgcttgaggccaggagtttgagtccagcctgggcaatgtaacaagaccctgtctctgaaaaaaaaaaaa

SEQ ID NO: 113876 - DNA, 393 bp, Homo sapiens
tgccatccaaggttgctatgagggttaaatgaggtaagatccatctcaaagtgtctaactacaacctggcatatatatggtgggctctcataaaatgttaaaaattgttacttgaagtccaagattcaaattgttcttatctataaaaatttgaacaagtcaaccaaatcctcaagcctcacttttctcataggttcaataaaagtatcacacgcttcataggctaggactaattaaatttagcactacagacaggatttcttacacttcaaaataagtaactgttttcttgtttgtttttcttcccctaaggttctaataggggaaacaccaggactgcagtgcagaaatcctgacatgttatactgagccaggttctctatcctgccatga

SEQ ID NO: 113877 - DNA, 417 bp, Homo sapiens
ttaactaagaaaagtaaatatttgcaagatctacacatgagcaccctggttcttttgcattcatgcaccagtggggtctcccaactcatccaatttacgaattttcagtttgtctccatgtctttccacagtttccaattccaagtgcaaatatcctcctagctgatttcccattaaacagagccacattatgactcctggaagacacatcaggttaggattattagacttatcttcagggaacagacatctcagaacatatcagaatttatgaagttgatgcatttgattaactgtatcatcgctgcagtcctacagctggattattgttttgctgtcaacattcgtcagatcttgatttgagcatccttgcaacactattcctcctctgttcagttagctcctgtgtggagacag

SEQ ID NO: 113878 - DNA, 765 bp, Homo sapiens
tatctttcttctgctagccagctaattcaagagcaatcacttttgcttctttccgcatttcacatctagcacagtgccaagcaacagagcaaatgaataaataatttttcgtatttaaattacttttaaaatgtcaccattttttaaaaaagggaataattctgaaatgaactgcatacttcttttcctctttaaacatgccatactgcatatctattaactgaacatcattagtttattgatttatttatactgatgatgggataacgatatgagactgttttggtgatgtgttcaggcagaggctgataatgcgagatacaggagtgggcaatagcacatattttcttaaacctgttcgtgatgttgctggcttacaggtagtttgtctctttcccacaacaggaactgtatcatttactgctgcctttctgcaagatgagttagagtgtaattagtctccctaggccaaagtgggtttctcttgctccagaaaatcaccctctgtttttatcagtttcctttgacttgtcagcaacacttaaactatgatctacggtttctacgtcactagtaaaatagaccctgtctccttgtcactttcaatttattcttcatatcttaataaaaagtggcctgggggaatttgataacagagtatagttgtggccaagtttcccatggcagttagcttggaacaaactcttaacacaatgagcattaaacacttatgcttttgaatgtttgaaaaaggttgaaggccca

SEQ ID NO: 113879 - DNA, 169 bp, Homo sapiens
gtggcgtgtgcctatatttccagctacttggaaggctgaggcaggagaatcacttgaacctgggaggcagaggttgcagggagccaagatcacgccattgcactgcagccttaatcataaattataagttgagtttggtggcttatgcctatattcccagcaggttggg

SEQ ID NO: 113880 - DNA, 159 bp, Homo sapiens
ctggtgggggctgaacagcgtgggtggacaatctgagctcctgggcggcaggagcagctgcccaatggcactctcccccgaagatgctcctcctagccaggtgtgagggtagactgcgagatccccacaaagacagcatctgtgacactgtgctccctg

SEQ ID NO: 113881 - DNA, 2460 bp, Homo sapiens
ccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaaccttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttgaatatcagaaccatttttaa

SEQ ID NO: 113882 - DNA, 376 bp, Homo sapiens
tagatgtctggagctaggccagcagtctcacttctcttgaatttatcactttgggatgctatctaggaactatagttaattatacaaataatgctacacagaatgttccagataaaaacagtatagcatagttcccaacttgtctgagagttatgagaatttatattcaagtcaagggctagatgaagagacaaatctggacagtttttcattttttcatgttcttaaaattgaaccctttaaaattctgctattcaactttttcctctcaaaatacgctgatcagctctcaagaggtccttcattaaaaccttgggaaggtttggtccctacaggatgtaacaaagtacattcttccaggaactagagacaacgt

SEQ ID NO: 113883 - DNA, 849 bp, Homo sapiens
accaattttcccgtaggctgattgaaataaagaagagttaaattcctatggcatatttctggttacaaaaacattaccaaacttctagataaagacaaaaacacttctaatattacacattgaaataaatgtgagctatacgtacatttgagaaaagattaatcaaaacaagacgattatttacccagtggttccagttcagggtcacgggtggccagagcccaccatctctgcagctctgggtgccaaatgggacccagcctggacaggatgccctcccgtctcaggacacactcacccatacccacacccactgagacagggaccatttagacacaccagtgaagccaacaggcagttttgggatatgaaaggaaagcggaggacccagagaaaacacaagcaggcatggggagaacgtgccaaatcgacacagacagtgaccctgccaggaacagatttctatattcacattgaagttgtaatgaaacaaagctgaatgcattgacgttatttgaggacctgcggcgctccaggtaacccaatttcaactcttccaaacatgagtgctaactgctatttccaccagggcggtacatcagtgccacttgtggccctccactggtggttgatatcaaggatagagggactcagggcgtcacagaagagggagcggaaacctgcctactggattctcaccaaatgacttcctgcgtcttttctccctgacacaattatgcagacatttctgcattgttataaggcttttctttttgtccaaagacaattaaaatgcttctttcataaaattagatgtttttccaaagggttgagaaagaactagagagc

SEQ ID NO: 113884 - DNA, 334 bp, Homo sapiens
taatcagctcggcccgcttaccgacggggtggcaggtaaggattcaaggtgcttctggaagactctccactgcccacaagctggggacctctccccactagatctagatgaagtccaagaagtggtccacatttgccagccctttcttgggttcttacaggcatgtggtgtgccttccaacagacttcatctttctaagtaagatgagaatccccacttactggaaccctactgagcgagctttggagtgttagttaaatttagtatttggaagccgggcgtggtgactaacacctgtaatcccaccccgtcgggtggaggaggcaggcagatc

SEQ ID NO: 113885 - DNA, 542 bp, Homo sapiens
aaacaccatgatttgtactgtgcatgggtcacattcttattctagaaatgcatcaccctgtgtttatccaagtgtgtttacttggtgtaatgtccagtagtaatagaatatgaaatatcaaggaaccatctttgttacgtgacttccaaaatgtgagatctcattgctgtcactgtgatatttgtattgtgtgaatctcttcctcctcttcctcctcatgctttctcagggaggagccctgatgtatatcatgaactcacagttcctagaccacagtaattgaggggcggtgggggggcctttatcggagaagctagagaacaagagtccttctcctccttatcccccaacaggacactaagagacaaggactgagtggaatcctggagaaaggggactcaggaactgacctcattggcctgatttgtgaggagaggagtataagtggagaggggccattcctgaggtttccgtgttttccagcctggtctcctggaaagaatctttatacagaaataaagtatgtgtttcactcaaaaaag

SEQ ID NO: 113886 - DNA, 202 bp, Homo sapiens
cagctgcttcctatcggattcagccagtagggggtgctagaaggacactggaaagctggagggaagccctctttttcttgtttacttctgttcttgtaagcggctccggtagtacttcttcaccccggcagcagcagttccttaccatagcagcagctaaattcagtttacaatctttctaacacttgtagaactaacttca

SEQ ID NO: 113887 - DNA, 384 bp, Homo sapiens
tattcacacacagaggtggtgaagtacaggtttgcctgccaaaggcagttatttcttcctaaaagccttcatgattagtcaccaccaccactgcatccacacacacacaccatagtcaatattctgccaatattctgcaccatacaacatggtagaaatgcttttggcatgggaaatttgaagagaaaatgttttcagcaggctgtcttaactgtaagtgtaaggtatcatggtaacttgtcttcgaactgggctccatgtttccttagtcttctagagagatgagaggaagactgagtgggcgggccatgggttctctatcaccaaccccatcatagcacacctgttttgaaccagacttctaatgtaagattccacctgaaa

SEQ ID NO: 113888 - DNA, 728 bp, Homo sapiens
atattttgtattctgagttagctgatacacaagtgtggtatggtgaaatgtatatttggtcattgactgtgcttactggcatacaactcctataaagtgatgtctttttgtatgctagtgagttgaccaatgtctggcagtccctaggagctctaggatgaggaattagagggttgggactttcagccccatgcccaaacttcagggaaggttggggctgaaggttaagttgttcaccaatggcaagccaacattttaatcagtcatgcctacataatgaaaacctccatgaaacccaaaaggacacggttcagagagcttctggctagctgaacacatggagggtagcatgcccgtagaggccatggaaactccctgcccctccctgcatacctcaccctatgtgtcccctcatctgcatcttttctaagggtgttccatttgccacaaaatatgtgagaagtccctaggctatggagctagatgaaagaattagggcctaggtaggagtaagcggcaaggaaccagggcaacttgctgaagcaagatgacgggtcctacctacactgtctccttataggctatggcatgaaatacccatgggattccatcctgcctcttacacactggccttgagggggtgggcaagatattataatctgtgaggcaatgtccccatttctaaagtaggaattagaatatttacactaaatacttgttatgaagaa

SEQ ID NO: 113889 - DNA, 157 bp, Homo sapiens
tctgaaggcagaaaaatatagccaatatgttgatgttttcctaatactaccaccttggtgggcataaggtctctaagtcaaggtaaaatatgtcacaattttaccaaacatgttgccaccacctaatgggggtgtcaaagtcctagctcttccctgt

SEQ ID NO: 113890 - DNA, 616 bp, Homo sapiens
tcaaatattcccagacattgataagattccagttctagtataggtttttaccccaaaggaaagaaaatatatgtccatatatatattagactgttttcatactgctataaataactacctgagactgggtaatttatgaggaaaataggtttcattgactcacagtgaaggaagacacatcttcccatggcagagcaggagagagagcgagtgagcaggggggagagtaccacacactcttaaaccaccggatctcataactcactatgatgagaacagcatgggggacatccatcctcatgatgtaatcacctcccaccaggtccctcccccaacactgggaattacaattcaacatgaaatttgggcgaggacagagccaaaccatataaccatacaaagacttgtgcatgtatgctcacacaagctgaatatcccttatctgaaatgcttggaaccagagattttggagtatttgcatatatccaatgacatatcttggaaataggacccaacgtaaacattaaattcatttatgtttcatatataccttatatacacagcctgaagataatcttagacaatatttttgataattttgtacacaaaaagtttt

SEQ ID NO: 113891 - DNA, 449 bp, Homo sapiens
actagtgaattggttcgaggcatagctaagaaaagaagatgagacacctattggggagttaaaaattacttaacaaatttgttttgccctgtttgccgtcaccacaaacatgaactgaagtgcgaggagtggcaaatggtagggaaatttatatctacagaaaatcacaagctaataaagagttccctaatggattctcttagattcccagtaggtagattatgaaatggttgaatttcacatcaaacccattggaagggtggcagatactctctgagttaaaaacacacacacacacaaaaacacctttcagcctggtgcagtggtgtccacttgtactcctatagtcccagctactcaggaggctgaagtggaaagattgcttgaccccaggagctcaaattcagcctgggcaacctaccaagacccccatctttaaatttaaaaag

SEQ ID NO: 113892 - DNA, 601 bp, Homo sapiens
caacgttgcaaataccatgcccaatgtgtattttagaatttactcatttaaatgagtgcatattaccattcctccatgtgagtactcgagttgataattccctctatctttttaaacccataaactacatttttaaaaaaatcaatgggagttttaaattttgactcatgttaaagataagattctgataatgactatatagtgactaatttcattgtttcagtaggaaacaaatcaaactttcaaaaatgttggtcatttcagtcaaattattcaaagatttcatatacatacatcctaagttaggataatttatgttaacatttttgaaagaacagccaatgtttatattgcttgttaaaatggaatgtattgtctatctcaaagattacttagctaaataatagtagacaaatggagatttaatttcacaaaatacttcataacatcactcctaattggcaatatagtcacaaagcaaaaaaaaaaaaaaaaactcgagttggggcccggtccccaatcgccctatatgagtcggattacattcactggcccgcgtttacaacgtcggaattgagaaaacctggcgtacccacttaat

SEQ ID NO: 113893 - DNA, 262 bp, Homo sapiens
gggtaatcaggggtgactgcacagttttaggcagaagcggcaagacacaattgtgctttagaagtatggtggaggaggtatagcagttaagatagcgaggccacaaatgaagcctttgaagtcctccagagaaaagatgatgggtaccagaaggggagtagttagaatttttattatctcctcttggaactgagaacagcctcaggaacttctgagaacttttgagctaatcaaataagcttatcactttttccactgtgct

SEQ ID NO: 113894 - DNA, 646 bp, Homo sapiens
caagtgttcggtgtatactgtgtacaaggcactatacaagtgctatggagtttacaaggatgaataaactatagattttaccctcaaataacttagattctagtgaggctggcacatccacacccgtcaatacacagctgaaaggtgtcgttagacaaacagttaatgtatgtgggagttcacaggaagatcactttaagcccagtgatgggaaaaactctaatgaagggaattaattgcctgctttgtgcattaattagtcacatatgagtgcctcaagctgccctggggtcctctttccacagaggcttgtgtgatgtgttcatgagaaaatactttaaattaagctaaaatgaacaattcagattaaacttgttttggcccacatcccatacttaccttggccataaaaaggaaaaaaaagcaaggcggtggaaagaagaaaagaaagaaaaatgataaggtattatcctcccctcagtgctgtgttgccttggcacccagccttgcatcctgttttccgaccttctcgttggctgtggaatcaggtaggtgtgtgagaagattggtttagattctacaagaagtagtcagaggccttgaaaataagttgattataccacagtggctcacacctgtaatccca

SEQ ID NO: 113895 - DNA, 208 bp, Homo sapiens
gagtcagagctgacaagtttcctgggcattatctctaacatgtccaatcagtttccccctttgaacggcagctgtcagcctgctgttctacccgtctccccacaagcccacacatttcagagaacagctgcgactgtcacctgcctcatttcacagagtttggacaggggtcccatttggggaccttcacccagggttgtatgcatga

SEQ ID NO: 113896 - DNA, 581 bp, Homo sapiens
tagttatctattctattctattctaaatttaatagaaatacattctcttggtttaaaggtgaagcaacagacttgaattcactcctttaaattacttttacaaaacatttttggccaggcacagtggctcatgcctgtaatcccagcactttgggaggccgaggctggcagatcatttgaggtcaggagttcgagaccagcctggccaacatggtaaaaccctgtctctactaagaatacaaacattagccaagcatagtggtgcatgcctgtagtcccagctacttgggaggctgaggtcgaggggagaatcacttgaacctgggagacagaggttgcagtgagccaagattgtaccactgcactccagcctgggtgacagagtgagaccctatctcaaaaaaaacaataacaaaacaaacatttttgttttatatcatgaaactcattaaatcaatatttaatagttgccttttagtaacttttaatatttggttcttcattccccttcctcttgccttggaataaataatataaaatgttttccttgcagaaaatttcaagatcacctacacttacca

SEQ ID NO: 113897 - DNA, 642 bp, Homo sapiens
ttactaaatggctgttgtcaccaaccgggccgttaaaaataataattgagcctgcagcactcctgagccccagattattcatgaaggggcaactggaggtggaacagctgatcccaaaggtcatttccagactataaaccgaagaagctaagcatatctatatacatatcttttacgttaagcaagattatcatagcaataatggttattgtagtccaagaaatataatgttattttttgatatattacccaagttctcaggctaaatccaaacatgcttcataatgctaaaagtagttccccaaccaccaccttaaaaaaagtaagcattacccaatcatttttgtttttgattttggtatttttgtttttaatttgggtgtttttgtttttagtttttcttttcttttttttttttcacggtcaactccatggtatctgggattcttcaaaacccttcacagaacatgggcgtggtcacacagataggttaaaggcttccttttaagtttcccccatcagttagcagacctctcatgaatattcccacttattaataacttgtcattaacaaagcttaaacagactagcctaggctttcagttcctcaaaagcatccatccactgatttctcaaaacact

SEQ ID NO: 113898 - DNA, 357 bp, Homo sapiens
tggagagttgcagccacctttttactgaccctcaaggcaagggaaatgggacttctaggagttgggttccaagcaaaatgcccaactccctttcctggcagagctgctggcagctgggctggtagagttctgccagtcctctcctcactataccattccattctggagaactagggtgtgtagatcggggacttctgcaaacccaggcaggcagaccaggctgttagtcaccacctcagggccaatgtggccaaataccagttagcacctggtaggcacggcatcagaatagccaaagtctcttcctctcaagccctaatcctaaatgtctacgcatgtacaggaacgctccttcca

SEQ ID NO: 113899 - DNA, 482 bp, Homo sapiens
taagagaccaactataaacctgtatgctaatttatttatttgcagtatcaggtagtgtaaggagatagattgcttacctctaatagcagctgcagtattttatgtttgggaaagttaatcagactgagatgtagtaatggttattctcagcacctgacacatgccaaaacaattcaaaagcagcagcaaaacactacattttgggtttgattcctcatcctgtaataataacaactttactctctcagcctttgcttaattaaaacccgttttgtttctaatgttgtattaggcattggcaaatacagcaaactgtatggcccagtttgtttgccaaaaatagttacagaaagagaagtactaagctcaatgattactgccctaaattcagtagaagtgtaaagatagagaattctgtgtttatagaaaaattgatccttgaattggagctttaagtaatggtggggtttggatgggtggaa

SEQ ID NO: 113900 - DNA, 175 bp, Homo sapiens
ggattctccagtatccacggcgggacgtgtgtgagtagaaggattctccagtgtccacggcaggacgtgtgtggcgagaaggattctccagtgtccatggtgggaagtgtgtggcgagaaggattctccagtgtccacggcaggacgtgtgtggcaaggattctccagtatccac

SEQ ID NO: 113901 - DNA, 839 bp, Homo sapiens
atggactcagactaaaaagttacaataggtattttaatatttagggtaaaggacagctttctaaaaaaataaacagatctttgtgacttgatgggatataggaaatgaggaaagaaatgttgattctggcatgagtgtcttagttgctttcaaccaaagaatgcaggaggaaaaggattttttgacagtgattcaattttgaacatatatgtatttctttcatcatcatcattattattatttatagagatgaggtctcaatatattgcccaggctggtctcaaattcctgagttcaagtgatcctcccatcttggcctgccaaagcgttgggattacaagcatgagccactgggcctggctcaattttgaatatatatttaaggtgctttggggacatttagctggagatgtctgacagggagtttactaatacaggtccagggtttggcacagatagctggacaggagggatagatttttaagtcatcaacattatagatggtggttaaaatcgtaagtatagatgaggttgcttagagaaaatgaaatgagatccacactcctttataccaaagtaaattccaagtgatcaaaacttaaacatttttaaacaaatgaaagatggtaggttttatcaaaatcttggagaagaaaagctctgctaagcaaaacccagaaaccatgattacgtaaactaaaaatcctacacagaaaactaatgaccataagcaaagtcaacgaactaggaaataaaatattttatttatatgttattaaacataatattttatctttacattttaataaagctctgtccatattgaaagaaaatcagta

SEQ ID NO: 113902 - DNA, 408 bp, Homo sapiens
ataagagaaagtgtattaccaaaccgttcaaatataaaggcgtttttcagcagcctcactgaatcattaatgcagcatctgaaatggaatatttgcaatctatgtattgaaggcaagagaacaaaatagaaacaggattatttaatgagcaagcaaacactggaagggaatgatgtcataatgtgctagtgaacagtaaattgaaatgcttttttgaagtattaaaaatagtaattgccaccactagctaatgaagcatttagtttcttgcattccacaggaaatgtaacattttagaagacttattggcaaaaattaagttctctagggaataagagaaaagtgatgggagtgaaaaaatcgtgtttgtgcgtaattttgaaatatatcctcacacctggaatgcca

SEQ ID NO: 113903 - DNA, 339 bp, Homo sapiens
  misc_feature (171)..(171): n is a, c, g, or t
  misc_feature (211)..(211): n is a, c, g, or t
  misc_feature (220)..(220): n is a, c, g, or t
  misc_feature (308)..(308): n is a, c, g, or t
gtagagacagggtcttgcccagggtggtcttgaactcttgggctccagtgatccttctgcctcagccttccaaggtgtcgggttacagttgtgagccaccgtgccaggcttcatgatgcattcttatcaaagtcactcttgacttctacatcactaaatctaatctttttncttttttaaaaaattatttatgtttttaattttaattttnatatttttnagagatagggtcttcctctgttgcccaggaggattacttcaacctgggaggttgaggctgcagtgagctgtgtttcgccactgcacancagcctgggtgacagtgtgagaccccgcctc

SEQ ID NO: 113904 - DNA, 257 bp, Homo sapiens
gagaaacagtggggcagtgggctttgggttgaatgggcctaggttcatgtcttatctctaccctctaatggttatatgatctagcaaagctacttgtcatctccgagcctcatttttctcacctttaagtgaggatgatggttccatcaggcacggcatatagctccaggtcatgagttttccttgggcctcctcctgggccattatttgagattttcttttctcttgttctcttttctcctccactttagggcctt

SEQ ID NO: 113905 - DNA, 790 bp, Homo sapiens
tatagatatatctttttctcattaaaataagcctgggcactgtggctcacacctgtgatgccagcactttgggagcgtgaagcaggcagatcacttgggctaggagtttgagaccagattgaccagcatggtgaaaccctgtctcaaataaaaatacaaaaattagtcaggtgtttgtggcgcatgagtgtaatcccagctactcaggaagctgaggtaggagaatggcttgaaccagggaagtggaggttacagtgagcagaaatcacgccactgcactccagcttgggtgacagagtcagaccctgtctcaaaaaaataaaaaataaaattaccagatttcagtggctatattattctcttgtataggtgcataataattggtttaaacatttttttatatttgactttcaatttttaaaattttgagaatgtagattacaaataaatctgttttatcttgattatatctcaattttcactaaaaattgacttaaaaattacaaaaaagatcaatttttgaaatcttattgattttaatttgtattacaaagtttttatgggactaaattaatgtattcttccaaaataatgtacaagaatagttcacaagcaaaaatgaaaaaaaaatttactttggtttaattgtggggattttctattacttctgatgttaatacttaaaacatttattaattatatccttcttatgtaagtaatctgcatttgtccttttctttatttttctgttggaatatttatttctattgctctgtaagaacatcaatgg

SEQ ID NO: 113906 - DNA, 540 bp, Homo sapiens
cggctagcagcgtgggagctggcaaggcttctgcaagccctctgctcccaccctggccccatttcacagacgaggaaacaaaggcccaaagaagagttccgcccgggacggaacgtggtatagctcgcaacagaacccagtctccggagatccctctcctctgcaccacttggacgttccacggagaggcagcggtgcgcggggcgacggggagctgccagagaagtcagtggggagccatggaaagtttctgaacagagaagcacttattgggaactgtcagagctatgcttcaggagatgaatctggcaacaacgtgggttaatattaatgccctgtacatcctgagtacatgtttccagaaagaggtgatccaggaggctgccaagtggcctgccaggtgacatccagacgggcacgaaaatgcccatgcagggtccacgtgtgggtccttaagccccttgcaggacaaatgggacggagaaaacggaccaaaggaacggctctcccctttcccttggatcccctttctacctccca

SEQ ID NO: 113907 - DNA, 632 bp, Homo sapiens
aaatcagaaaacatatatacataatacatataaaacatatctattctatatatattataatatatgtatattgcatatatatattaaatgctaaaaaatttggccaaaagtaaaatttatttgtcaaatagtgtcttctgataaaagtttacccaaccaaacaaatcaagcatcatttaaaataaaggaaattgaggtgggcagatcacctgaggtcaggagttcaagaccagcctggccaacatggtgaaacaccatctctactaaaaatataaaaattagccgggcttggtggcgggtgtctgtaatcccagctacattggaggctgaggcaggagaattgcttgaacccaggaggtagaggttgcagtgagccgagatcgtaccactgcactccagcctaggtgacagagcgagactctgtctcaaaaaaatatataagtaaaaaataaataaaataaaggaaatatgctaaaggaaaaggctgtagaaaaaattgttttataagatttaccattattggcttcaagaataaatatcatattaaatgatgggttaatatttaacccatataaccaaaatattaatcagtacatttaatctattttatactgtgggcaatggttaataat

SEQ ID NO: 113908 - DNA, 418 bp, Homo sapiens
ggctattagtcacaaatcagatatagtaatctaatcattgctaccttgtgacacttgccatgcaaagtgggcatgggtcaatttcacaatatcacatttagcattaagaatactgacaaatagtctttaattggtaaagttgaaattcaaaagtcagcatacaaccacagaagtcacccaatcctcactatgtcccacagagaagtgtggtggatgcacgcagtgagaacacatgtgtcccagtggtgggccctgcagtcccttcccaaccttcccagtgggaagagaaaacattacacaggtaccaggcaatctgggtttagatgccaacaatttatggtatttgtcttaaaaacatcagggaccctgcacttaaagattcgatgcataagaaaagctgaatttaaataaaattcct

SEQ ID NO: 113909 - DNA, 184 bp, Homo sapiens
aggttgcagtgagccgagattgagattttgccactgtactccagcctgggcgacaaagcgaggctctgttaagaaagaaagagagagagagaggagagagagaaaaagaggagaggagaggagaagaaaagagaaaagaaaaaaagttattgggctgggcaccgtggcttatacctgtaatccc

SEQ ID NO: 113910 - DNA, 504 bp, Homo sapiens
gtggcagctgtcatagaacctcggaggtagctgacctaaaaatagccccttcctctctccttccttccctaccttctccccaggcagccatttgcccaggcactattagtcctgatctctcatttgagggaaggatgaagaaagggagcagggagggaagatctatttttttccccaggctgttggggaagggagggtgaagctgctctctctgagttgattgatgttgcgcttggggatctaaattctctgatgtaattacactgtgtgctccgtgagataaggagattaatcagtccattacgcaggggctgttttacccgcagattgaacagagacgtcggacaccaccaggtcctagccagccagccagtctgctccagttataggcaggtggctggcctctgggcagataggctatcttctccaaataggaacaacttctgttgctaccactactaactagcttgtttttgagcctccctgagattccaggcacttcac

SEQ ID NO: 113911 - DNA, 190 bp, Homo sapiens
ttaaaatcttccccttcttcttttctgccattccactgcttttcctgataaccctcactcttcccgggggacagcacagtgtgcttgaaagagcatgactcctgcacaagaagggcctagggttaaatcctaattctaatgtttacttgctttatgatcttgagcaagtaatttttcattttcagttttt

SEQ ID NO: 113912 - DNA, 263 bp, Homo sapiens
cctggtaatgttggagggtggagaatccctcttcaaagaatgaggatgagtacagcagaaatccatattccaagtttcaaataatttagtgggttatttgagttatataaaatcttctttcaaccatttttcatgccaaatgttcaataactagactcgagtgtgtgggtgtgtgttgggggagtggtttgtttttgaagaaagccagtctgtgtgctgctgttggcagtttcgggctggctgcatcaggcaccccctggagg

SEQ ID NO: 113913 - DNA, 114 bp, Homo sapiens
aagttggctggttgtgtgtgtgtgtgtgtgtgtgttttgtttaagagacaaggtcttgcttcatcgcccagactggcatgcagtggggtgatcacagctcactgcagcctccag

SEQ ID NO: 113914 - DNA, 458 bp, Homo sapiens
tgcctttgcgtaagctacttcctctgcctgaaatgtccttcttcaccctattccagagtcccttctgactgggaaactcctgcccatcctgcaagactcagctcaactttccccttcaaagccttctgttgctctccaccaagcagcccctcctctctgatcccaagtacccaccagggagcaggtgttgtgctgcactgtaactgatggcctccccatctctctccatcactccaggcctctaggcaaaaaggtccaggatcctgcgcacacagaaagttcttgaggcatgctcagtgacagtacatgcatgcacacacaagcaagccctgcaccataacaaacttcctctccctccacctggagaaaaggcagagctcctgtcaaagtggaagaagggagctaagaagacagggctcccaggatccaggaggtgtgtggggcacagcagctccttt

SEQ ID NO: 113915 - DNA, 322 bp, Homo sapiens
  misc_feature (266)..(266): n is a, c, g, or t
  misc_feature (281)..(281): n is a, c, g, or t
  misc_feature (283)..(283): n is a, c, g, or t
ggtggctgtcaccacatggctgggtgccgggaagaagaacaccttgaagccaaatttctggtagaggtcgatgagctcaggggagggcgattcctcaccttcactcaggatgctgcccacggcacatcggcacttatcaggggccaccagggagcaggtgttgtgctgcactgtaactgatggcctccccatctctctccatcactccaggcctctaggcaaaaaggtccaggatccatgtgggggttgtcatagtagacagcganggagcggagcttggnanagatgctgcagctctcagtgaaaagccgcccagtctcac

SEQ ID NO: 113916 - DNA, 1087 bp, Homo sapiens
acacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacgatgacatctcctaatctttcttcttcgaacaagaaaaaaaatggttgccaacagtttgaagggaaaagaagataaaagaaaacagagtctgccatcagtgggtataggagacagttaaaaaaaaaaaaagaaaaagaaaagagaagacaaagattgggatatgaagtaaaaagcaaaaacccgaagcttcgaataaagctttgaagagggtagggattcagcaacggaaacctttgccttgcattttggagctggcctgggaaagcaccaaaaagctctccacagtctgtgcctggaggcccaggggggctgtcaaatttaaagctctcggactccactgcaggataaacagcttgggattcttttttaatgacaacagcgtatcagctttttttgaggttacagcatacataaacaagatctgcctcatattttccagttgtggaggagggaagggaaaaaaaggcccccacaaccttttccccagttaacaatagaagagacttgcttttacttgaatgcaagactgaaaaaagggaaggagaaccatggcgtgcaaaatggccacaccgaaaggaaacaggaaaaccattacttcctctgtgaaaacttcagtgggcaatcaaagggaaga

SEQ ID NO: 113917 - DNA, 308 bp, Homo sapiens
agaaggattagctcaagaagcttgtagagtttaagataagtttatagataagaaaagtcaagctcagagataaattgccccaggtcagtcatcaataggtcctggtttcaggtccaacgatgttactatcactgtgggatgaaattctccccaaatctataaattgcctttataattagttattaccatgttgtgtaatttttccgagaatttatattatagatgttgcttcatttaattcttgtgtaataaggaaaagaagataaaagaaaacagagtctgccatcagtgggtataggagacagtta

SEQ ID NO: 113918 - DNA, 1078 bp, Homo sapiens
  misc_feature (1078)..(1078): n is a, c, g, or t
acacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggctcgagatgcggtcctaggccattctacaggctgaaaaaatggaacctggtttgctgtaagctcagtatgcggtggtcactccaaaaagtgttaggaggtctccaggagagatgctttcaaagcgaaatctaaccctggggggaggacttcttgtgaacatggtgcgtgggcacgtgggggccacttagacttcgcaacccgggagctttgggaaaacccgggacccattggttgggcgacgagacttacattggaacgcatcatgcaaaagagaaagactccgggaggaatgtacatccggatagagccagagcgcacacattagcgttcctcccgaccctgtgctactctttctttgggn

SEQ ID NO: 113919 - DNA, 234 bp, Homo sapiens
gtttataggcctagaagccagagttattgctgacttgggaaggacagtcatgttctcaaggtaagttctccaaagagcaccaagcatggaggagaagagtggtgagctgagagggcaaatgccagaaaaaggaggatgtcagcaagaaaaataaggggtccacaggcaggccagtgcataatgtgcagtgcctactgccaaatgaaaatgagggaccctatgctccaaaattat

SEQ ID NO: 113920 - DNA, 513 bp, Homo sapiens
ccgcgcccggcccccaggcaattttaataataaatcttaatagatggggtaagagctgccttcatcccatacagagaatacaatggtgctagactaagtagagattttatttcagcttaaagattctgtttgatgtctgaaattacatgtttaggcggcatggggaacaggactgttctttagcatcagtttcacaattactttaatctactaggtttcattcaccttataattctgaaatttcatcagcagtgggaacagaaaaggatattcacatgccagccccaaattggctgtgattgaaactaatgatacaattacagcaatgagtgtttgcaacggttgatgatcaggtactggtgtgggatgaaatagcagataagtggtgcttgtgggtgatgtgagtctccattgatctgttgaattaggtgcctcttcctctggcatcactgacaattcttggtggggcccgaagatgggggtgggttacactctgggtcaatttcttctcct

SEQ ID NO: 113921 - DNA, 219 bp, Homo sapiens
cctgatccccaaccattactctgattattattatcactgattagttttgcttctattcttgaacttaatataaatggtacagtatgtattctttttttattctggtttcttcaactgaacattatgtctgtgatcattgtccatcattgtatgtagcagcagttctttttcattgctgtgtagtgttccattatgtgagtataccatgatttgtttatt

SEQ ID NO: 113922 - DNA, 703 bp, Homo sapiens
aacccaaatatatcaataatcactttaaatgtcaatggtctaaatacactaggtaaaatacagagattgctagagtgggtcaaaaataagaccgaactatgtgttttttacaagatacatattgattaaggaaagagatggagaatgatattccattctaacactaataaaaagaaagttaaattagctatattaatttcagacagcagacttccagcaatgagtgttatcaggaataaagtggagcattacataataataaaagggttaatttttcaaaaagacatgacaatccttaatgtatttgtgcctaacaaaagaatattaaaatacgtgagtcaagccaggctcattggtatgcatctttagtcccagctactctggaggctgaataggaggattgcttaagcccaggaggccagcctggggaacatagccagaccctttttcttaaaaaaagaacacatgagttaaaaactggcaaaactataaggagaaagagataactttcatttttctagttggaactttaacacctgtctatccgaaatggacagagacagcaggcaaaaattcaataaagacatagttgaactcaacagtatcatcagtcaactggatataattgacatttatagactacttcatcccaaaagagcaaaatacaaattctgctccggctaatatggaacattcaccaaga

SEQ ID NO: 113923 - DNA, 301 bp, Homo sapiens
ggaagggaaaattcagggattatactaaataatttgttttctctctttcaactctaacatttcaaaaattataatatccccaatcccccaaactaggatttgtattcctggcttgaacttttttcgctcaagaccctatagattggttttcccatggatttcggatcaaaagcttcctttgaattatgtattcctttgaaacggattcaaatgcagggggatctgaaaagacttcatccttgctgagtgaatcagcatcccgtgaacacaggtgacaagttctgacccatcccttcactgt

SEQ ID NO: 113924 - DNA, 3101 bp, Homo sapiens
cttggaggagaaggattcctgtaaatcactcactatgatttcccacagcaggcaagtggatcccctaaagaaagaaggcttatagagttccctcaaaagagctcagaacttcaacaatgattctattcacataggcatttctgtcttccaaattttagctttaagagtctgaggaagtacatgtttttatttagaaaacaaaaaaatcccaatttgtaacacttggactggctgcatttccaatcaggcaagcagatgaggggccatgctgaacttaaactgcaattgaggactgttataaatttgggagaacaaggaagaattccaggaccggctcctcccagctgcaaaatacacccaacctggtgatactgacacctaaagagaaaagagacagactgccgtcaagggctgtctcccttgctcttttcctaatttgtctcctctgcccacgaccagggagtaactgatcttcaagcacagagcccaagatactgaactataagtgaaatgttttgcaagacctgtgctgaatcaacaggtctcttggaccacgtaagactgcctggacaaggaagaaccatcaatggttagagacccagcacaaaccacatgctaagcagcaggcatttcctcttcattagctcattaagctcagaaagaaatctctttgtgaaggagtttgctaaaaaccttaaaacaaaaaagttttctgtctccagccagcagccagccttggagaaacacctttacaggcaaagcctaaaacacatctttctccaaagccaacatgttttatgccttcaccagtgttgtcttgaatatgtatttggttgctactttggttccagacatctctggctggtagtaggtagtttaatgaatggatgttgacggacaggtacatatcccagcttgtggcctgcggcgatgttagttaggcaagcatgctggctgcttttcaaggttgtacatttaataataaatataactggcttccctttcagatgcaatgcttggtgctagcaattaccacaaaatgagtgaattgatcaatataaagtgctattttctctggaagcttctctaaccaactctcgattgcctttccatctatgtgacttaacttgttgacaatcttgtcaaacacctgtgattgcaccattttaaaaatacattaatattaatttgaacagtggaaattatgttcctctaaacattagcccctaaaatagaacttcaattccagttgcaaataaagattcagatttttctttttaaagacaatcaggaacccagtacctagcaagtaattgtgtcaaaaactttagtgttttgttttgtttttttttaatttgggcagagagatctgtgtctaaaaaccgacagaaggaactttccctgcagctagttcttgcttcttctactggacttctctaaaagccacatccttctacagaatccgtctacacagaacaatatttgaaccaattcttgggtctcctgttggatgtcttcccatggtttgcccaggacactctagtgggtgtgaagatgtcatattatactggactgtgaagcgagaaggtgatatttaagccactaaagcttgtggcagccaccaaattttccaatgccttctgcaatcttgcatttaactggcttcaccgccattcccacccccacccagtgggaaaggctttaggagcatttggtcaggtgggggtgctgtcagggtttacggttcaccttcaaggaagccctgggtgcgctgactccggggtggggggcacctggcaaggtagcggggacccccgtaggcccggagaagctggggcagcctttgccacgtggacagcaaccgcgctgctgcaagttcccgggcgtgcccgtcgaaagcggccaggaggtcaactggggcggcttccctcagtgccttgggcaggggacccacctcggcagccgccccaccagggcccaggacgcagtggaagagcgtatggcgtcgcagcaggcagtccctaaggaactgcaccaactcctccaaacaccttcccaggtgctcctcgtcccagccttgcccaggggcccccttgcgcagcagcactgccagcagcactgtcttgagcacatatgaggataggatgcgtccccactgggtggcggccgctgagtccagcccacgggcccccagatcgcgcagagccttaagcaactgcaggcacttgaggtagcaggcacctggagctgcccgttcctgcagccaactcagcagcttctgctcctggcgtgctgtgttcacaccccacagtgcctccgcacgcaggccctcagggagctccaacaggggcgcgctgggcaagggtggcggtggtggcgccacaaggaagaccccatctcccagatggacagcggggatgagacgcacagccatagaaaggcggcagcagccgtagtcagtgcggcagggcaagatgtgtaaggtggggggctgttccaggccacctggggtcaaggtgacccgacagcgcccctccaggctgtaacgcacagtggccaaggagcgctgcagatgcgactggaaccagcgcagcaccagagtagcagagaggtgacgccgcccgcgcacatccacgcagaaggcatcagcaaagggtttgcagtcccgaagccagtggccccccgaggcccccgatggtgagggtggtgccttgagggcgcacaagaagcagccgcggaaggccggggccagcgctggctcctcgcccaggctccgtggctccagcgccacaagcggcgggaggcgcagtggcaccagcacgtcgaagctgtcgggccggcggattttatgttgctcgtaggcgctgcccacctggatgaagtctccgcggaaggccaaggccagcgctcccccaggaatgagaccgggggacccccgggcgcggccagcccgcaccagctcgcccacgatccggctcacgtgcgccttgctgtggcccaacacgtgcggagacaggcgcacctcatgctcgtagtaactctccagcaggatgctgaggcccggctctcggaagtgtctcgaggagaaggcggcgtgaccc

SEQ ID NO: 113925 - DNA, 306 bp, Homo sapiens
caggcatgtgccaccatgtccagctaatcaatttttaaaaattacatattggagtctcttttccaatgctgagttgccacgtctttccttggtgggagctgagggctctaaaatgactaacagatactcagggaagctggcagatgtgacttttagatggtggcacggagaatgaattctgatgcttactgctcctcccacttcattagggctgctagaactcccagcctgcttgagaaagagtcagaatagactggcgcaagtagagaataatataggatccatgttatctgcaactggaggtct

SEQ ID NO: 113926 - DNA, 832 bp, Homo sapiens
agaaggcatggcttctcagctgttcctctaagcagcggctctttccacccatctggagatttagattctagagttcggtatcacatttgcctgcagatttgttaagaatgcaggcagggaagacggattctgttcaatgacccccttcaagactccagtgaagttcaggatctggcagaggggatggatttatatagaagtggggcaactgacacacagaggtattaagcccaaggtcactctgtccatgaatgatgaagccagttgtgaacagcctacaaccagagcctgggctcttaaatatcaggctttgctggctttgatgagtagatctttatatgaaggcaagcaaacaggagttcacatggaggaagcagaagaggctgaggtctgacttgatggatggcttttcattgactgtctgaatacacaccatgaaatcagcaccattggcttcaaagacatttattaaaacgatgcatttgtaagaagaaattttatgagatctgtggcttatgaagtccttgatctatttaatccagatgattggatcctaatgtttgcagcaaagacaggccctaatgcttataggtccactcagcataaagttaaaagtgcttacatgctagacagctctcttggaggagtagcctgcaaaaactatatctttaaaggtgacatgcagaagctggtgcccttctttacagagctgcacttgctcctggctcaggatgcagagaagataaagaaggagatcagaaggaactactggacgtgcaggtcagggcatggccattgccacaagggagcagcagttcagaaagaatgtgtg

SEQ ID NO: 113927 - DNA, 443 bp, Homo sapiens
catctcctcacccccttctttacccggaggtactgctatctctccaccaacctcctaagtatattcccacctacccacttccttacatcccgaagtgtgcctttcccagtccaggccacattataggaaaaatctcttctgcagaagcctcttatccctcttacccaacgggcctactggcttttcaccttatccctgcatggtatattttcctccacactagagccaaagttattattttcaaacatgagttagagcattcaagtttcctgtctaaaactccccagtggctctctagcacccttaggaaagaaaatccaaacctcagcatgacctaattcctgttttcctttctgatctcctttcttaccattctccctttgctcaccccacagagagagcgtacaccccccacggagagcgtcccccacagagagagcgtc

SEQ ID NO: 113928 - DNA, 845 bp, Homo sapiens
ccaccggcaggttgtactccacctgcaggtgtactccaggattcactgcttgtttacccttagattctcagtatcaagtcttcaatcaatcagtgccccaaatcataccattgaggccgtataaaacgccaaacatataatgaaacatttctttgcattggcaagagaaaaggaggaattactacctgttgagtctgagcatattctgagtttctccctagccttgtctgtaccctgagccctggcacagttgcctacttggtactttctggggcaactcggcctaacaagtccaaaacagaaccctagatcccagactctctagttgcaaatcattccctccccagccttcctgaacccagtacaacctgccgtctgccttctccacatgccttgtgctgacatgcaggaagtcatccctgtgtccctctttttactccgtaagccaccaacctcctaagtatattcccacctacccacttccttacatcccgaagtgtgcctttcccagtccaggccacattataggaaaaatctcttctgcagaagcctcttatccctcttacccaacgggcctactggcttttcaccttatccctgcatggtatattttcctccacactagagccaaagttattattttcaaacatgagttagagcattcaagtttcctgtctaaaactccccagtggctctctagcacccttaggaaagaaaatccaaacctcagcatgacctaattcctgttttcctttctgatctcctttcttaccattctccctttgctcaccccacagagagagcgtacaccccccacggagagcgtcccccacagagagagcgtc

SEQ ID NO: 113929 - DNA, 436 bp, Homo sapiens
aggacttttactattttatgagttcagctttggtagagagagtgtttccttaagacagatatgacccaaaatagaaaaccagggaggcctaagcactttgaatgggttacctattgtgatatattccaggattcactgcttgtttacccttagattctcagtatcaagtcttcaatcaatcagtgccccaaatcataccattgaggccgtataaaacgccaaacatataatgaaacatttctttgcattggcaagagaaaaggaggaattactacctgttgagtctgagcatattctgagtttctccctagccttgtctgtaccctgagccctggcacagttgcctacttggtactttctggggcaactcggcctaacaagtccaaaacagaaccctagatcccagactctctagttgcaaatcattccctcccca

SEQ ID NO: 113930 - DNA, 1406 bp, Homo sapiens
gattgatccgccgtgcgcacgccagcgcgttcctctgtggcaggagaggggggcctgcgtgtgaccgagcgtgcgtgggaggacgcgcgtgtgtgtctgtgcgccctgatcacggtggtctgtgggtggggcggatcgtgcacgcgcgcccgatctgtgcgccccaagccagccttgccttactggtaccagtacctgcctgctgctaccaactagtcaacatgtggcatcttccaggccactgtgatgagtcagggatgagcatctgactctggttggtccaatcagcttgtccagggactttggctgggaagattggaaaggaggccagctttttgggctggggttgctgagagatgtgatgatgaaatgtgtggcctacctggcatctggccccagcttcagctccatttactgtcttgctccccaccctcactagcctgcattgaggcctcctctgtgccccccaacccctgagtttctcatccccagagagcccagctacacagaattgaagggttttctcattcatcttcctgcgctcaccctgaagactgggcctatgtcatctgctaaccactgtccccccagcactcacagtggaaaatggagtgttatgcagccctgcagcttgccttctagaacagttcacaggcaaggctcccaactgaaccctgctacagccagatggtgccagcaacacagagctacttgttacatcagctcagactaagccaacccaacaggagcatctggtgattccacagaaccacaagagacttgacctcctggaaatgaatttaaccaagattaatgaaaaagattaaggtcatgtgccctgtaaaaatgtccctcactggatgaactgtgacaaagtagggtactgcgtggtctccccagctgaccctctccatgggtcattctttgcttttatcactacctggcacaaatctttacgtatttgtttatcgtcttccctccaccagtagttaggtgtttgcccttgctgtatcccctgtgcctagaacagtgcccaacattggcaggtggccaataattgcaaaataagcaaatgtatgaatgaaccattagatgctttgtgttgtatacttactacctgctgggcacatttatttaatcctcatgacagcccctgaagtaggtgttactttttccatcttacagataaagactctgaggtttggagaggtgaagtgatttgatcaatgtcacatggtagtgagtgaggccaagaatcatagtttcattttattcgagaagttgggggccaggtacagtggctcatgcctgtaatcctaacactttgggaggccagggtgggaagatctcttgagcctaggagtttgagaccagcctggacaacaacatggtgagactccatctct

SEQ ID NO: 113931 - DNA, 371 bp, Homo sapiens
cctttaatctgctaatgacatggatttatgttaataagttttgaacattttaaacaaaacagccttcttgggatataccaagcttgatggacttaatttactaatacctttgaaaagacttctgtgtatttattcaataataagactgacttttttttttttttttttccttttggaggcagggcctggtcctgccacccaggcgtggagttgcagttgttcactctgtggctcacctccaccctcgtattctcctgtggccccaagacaaccttctgccctcaccctcccaggtatagggggaattacggtgtgcccacccccatgcccgtctaccttttggtttttgtagtatagaccaggtttacccc

SEQ ID NO: 113932 - DNA, 583 bp, Homo sapiens
gtgaaccgaggtgttcggaagcgaaatctcgagatggacgttctgatggtgcatgtgactggagtctagtcgaacaggatgtccaagcgagacgtgcgatatgctaagatgatcgacgcccggcactgagccactgcactccagcccaggcaacaagagaaactccgtctcaaacaaaaaaacaaacaaacaaaaaattatgaaaatccacagccaacattacagtgaaaggctgagagcttcacccctaacatcaggattgaaaggaagatgcctgctttcactattgctctctaacattgtactagaagttcttgccagagcaattaggaaggaaaaaactatccaagttagaaaagaagtaaaactatccctattcacagataacatgattctacatatggaaaatcctaaagaattcacaaaaatctattgcaaaaaataaacgatttcagcaaaattgcaaggtacaagatcaacacacaatagtcagttgtatttctgtacaatagcaatgaacagtccaaaaagaaaattaagaaaacaattccatttataataagttccaaaagaataaaatata

SEQ ID NO: 113933 - DNA, 350 bp, Homo sapiens
cgcctgagacaggcgttatgtttttctaagagaaagttatttttgcttcgctaaatgcctacaaaagtatcctgttaaataccaataacccattcttggattgttacaaagggcaccactgactatcattctgttttctgatttttaaatttttattgtaaatataaatacatatggccgggcacggtggctcacacctgtaatcccagtactttgggaggccaggacaggtggatcacctgaggtcagaagttcgagaccagcctggataacgtggtggaacctcatctctactaaaaatacaaaaattagctgggcgtggtggcgtgtgcctgtagtaccagctactc

SEQ ID NO: 113934 - DNA, 178 bp, Homo sapiens
ttataataggtattttagcctaggtccctcttcttgaaggcctcttggtgacctgctttgtatcccagtatgctcccaggcctgtgtcagtccttccttgtaccccaggaccctctgatttcctaagacagagatctacaagatcaaaaacagcctaccccaacttttatatttctat

SEQ ID NO: 113935 - DNA, 659 bp, Homo sapiens
gctgtcttaactgtggtctgtttgcttacttacagaatttatagtaagaaatatgagatacttacttagatttagactttctaaatttatatatagaaatactagatacaaatattgaaacaatgtatattgtttatactaagtattaagttaattgactagtttgtttatacacactttcataccacataccaaagtaaaggctctgggatctgggattttagcaaaagtaggaggcatgatttcatgggacagtagaaattgagcctcctacaaaaatctgaagttttaagtttctcagtccctgagaagactgggaaaagtttgcccagtaatcttggaacaagaaagtttgatgtgtgtttggtgtcttggaatgggaaaaggagatgcaagaggaaaccattagaaattgaaaccaacatattcaaattaggagtgaattgaagcacaaagacttgcctttgttctatgagaactccaatttgagaaactgatctaggactattgacatttctagatacagatatgacaccagttagaacactttctcagaagagagcacacaagaatcctgtagaaagagtaatttctgctaaaataacctcccaaaacttataaacttcacatggaaacaaataacgaaaagtcattaaaca

SEQ ID NO: 113936 - DNA, 694 bp, Homo sapiens
aaggattaattttcttaattgctatattttacaagaatcgatattattatatttaaagcaaaattaggaatgcctctgttctcaagatatcagggtgttaggacactcccagttctgggtctgtttactaaacattatcaatctgttcccttaaccgtaaacatctagaggctaggaacacctaactttctgggagtgcagcccagcaagttccagcctcattttcctagccctcactcaagattgagtcgctctggttcaaacccctctaacactactgtatccctacgatgcacagcgtgccttagtagatgtttagtaaataactgctaaatacatggatgaaaaaaatagttccaatgccatattaatacaatactgataaaaattatatatttttggatttcagtcacacaggcaaaaaacaactttctgatatgatttagccaataactgacaccaatataaaaaatgatctgtaacccccccaatggattatctttgcccaggtagagcttgtttatcaagacagaaatagagaaagaattgaatgcacacagagccagttaaatgggagaccagagttttattacccaaatcacgctctctgtgcatttggagactgagttttttttaagggaggtagggggttaggaagtgaggaatgctgattggtcagattggagatgaaata

SEQ ID NO: 113937 - DNA, 213 bp, Homo sapiens
tagtgattctccaagtgtgtcgctgggctggcagcaacagcatcatctggaaatttgtgagaaatgcacatctccagcccccacccagacctactgtattgcaccgttttcacactgctacaaagaactgcccaagactgggtaatttctaaagaaaagaggtttaattgacttacagttcttcatgactggggaggcctgaggaagcttaga

SEQ ID NO: 113938 - DNA, 601 bp, Homo sapiens
  misc_feature (584)..(584): n is a, c, g, or t
attttttttcctctcatcatatttttacacacatactcactcatacatattcttcaggagtttgaaaattgtttctcagtcttgcttttcacattaggaaaaaatgtagagtaactggatccaaatgttctgtcattatcaccagacggcgaatgccacacagcgtgttgttaataatggtaatgaaacgggcaccatcagcaccgtcgatcacgcggtggtcgaaggagaaagaaatcggcagcatcagacgcggcacgaactctttaccattccacaccggctccatcgcggacttggaaacgccgaggatagccacttccggcgcgttcacaatcggcgcgaagtgggtagtacccaggccgccgatgctggagatggtgaagcaaccgccctgcatttcgcccgcagtcagcttaccgtcacgcgctttttagaaatagtcatcagctcgcgagacagctcgatgatgcctttcttggtgacgtctttgaatacccggaacaaccacaccgttcggggtattcaccggcacacccgatgttggatggaatttctttcaaggtcagaacgcttgacccgtntttccgacaggcgaaac

SEQ ID NO: 113939 - DNA, 185 bp, Homo sapiens
tcatgtggggagcagggataaaaggcctcagtggtgtggaagcctgggactgctgatatgcaggggggccagggtacaacagaggtacttagggtgcctaatgaaaagagacccaactctaaaatcactcggggagtgatcttaaaaccaaagccacaaactggaacaaaaatctcactttattg

SEQ ID NO: 113940 - DNA, 273 bp, Homo sapiens
gactgcatacgccgctgactgcatccaacgccgctgactgcatccaacgccgctgactgcatccaacgccgctgactgcatccaacgctcgcaacagagttcttttattgaaataaacgtattggtggctcaaggtgataaggtacttacatttatctctctccctcctgaaatcccattaaatgatggtaaaataataaattaaaaaattgtaaaaattataaactctcaatattgaagagaacagatggagaacaaaagtatacaaacata

SEQ ID NO: 113941 - DNA, 272 bp, Homo sapiens
aaatggttcctgcagagatgtgaataatgagaactattattttaggtcatctggtcttcattaagaattgatttgaagccgggcgtggtgggtcatgcctttaatcctaggactttgggaggctgaggcaggtggatcacctgaggtcaggagttcaagaacagcttggccaacatgacgaaaccccgtctctactaaaaatgcaaaaattagccaggcatggtggcgggtgcctgtaatcccagctacttgggaggctgagacaggagaat

SEQ ID NO: 113942 - DNA, 365 bp, Homo sapiens
tactgggagggccccttggggtcccacaggaacaacccccatgtgtccacagtcactctcttctgcctccccacacatccacactcctcgtgtatctctacctgtggaaatatgaatagccagcatcctccctctaactcaaaagtactgttagatcccaaaccctagaaattctcatttctcaagtcattcctttccctccacgttgccgccctcccatgtggctgctccacatttctcccacagtctattgctataaactcctaattggggtctccacttccacatccttcttcctccccaggtgttcttagccctgttgccacccttacaccctgctctgatccagcacacaaggcacttca

SEQ ID NO: 113943 - DNA, 395 bp, Homo sapiens
tcctctaggatcccaggattagctctccaatactgtactgccccccacattcctgttcaatttaagtctgtatcattcatcatagcctcaaaattagtatcatccctaggccccttagaacgtttcccctttgctcgattcctctctttcaatacagtcctccaaaatcctccatttggctgactcaccaaaaagccccacctcagtaaaaacagccaggcctagaaagcctgcagactctctctttaggccagctcagcttagcatgccagagtcaaggcagtagttttggtgacagctaaactacctagtatgccacacaaccatgacgcactgctcaagaactacgggctgctctacggcttcaggaaggacatagaccaggtagagccgag

SEQ ID NO: 113944 - DNA, 380 bp, Homo sapiens
tacagtagtagcagtaacaaaatacaatgtaccaagaatttcctttgtcccagactctatcctaaatcttacgtatacttaattcatttgttaataattccactgcaaccttgaggtttggtgctataattaacccccaatttataagtcaggaaacagaagtatcaagaggtaaagtaacttccctaagatcataaagctagttgcttggctattaaaacaaaccagtaggctccaggacccagattattaatcattacatgattgtcagcatgacaggtacattatttctccaagttggtatactacagccaaatcgtcccctaagaacatacatttcaacaagcccttccagggattaaagatcactggtatggtag

SEQ ID NO: 113945 - DNA, 187 bp, Homo sapiens
gtatatttttgccttacagcctacagcctgttccttcagttctgaatccccccagtctcccaatctcttccaaatcacccaagtcagcaacttcttatactccagattttttttgccaacataaagcacgacccaatcactttatcacatcaccctttaattctctgcataacacatcactctgatc

SEQ ID NO: 113946 - DNA, 487 bp, Homo sapiens
atccctttacatttaaagtaattacttcctaaagtaaattacttatttctgttctttgttttttatatgccatattagctgtttttattcctcatattttatatattttgatttatattgggatattagctggagctgactttgggttatagtggttttcttcataaagtggtttcttcaaaaaaacccaaaccactatttgagttatagtggtttcttcatagtcccgtcctggctaacatggtaaaaccccgtctctactaaaaatacaaaaaattagccgagcctggtggtgggcgcctgtagtcccagctacttgggaaactgaggcaggagaatggccggaacccaggaggtggagctagcagtgagctgaaatcacgccgctgcactccagcctgggcgacagagcaagactctgtctcaaaaaaaaaaaaaaaaaaaaaagggtcatagtcataggttagaggcagagaaaaatgtgtgt

SEQ ID NO: 113947 - DNA, 236 bp, Homo sapiens
aagatttttaaacgcaccaatcagcacactgtaaaaacagaccaatcagcactctgtaaaatggaccaatcagcagggtgtgggcggggccaaataagggcataaaagctggccacccgagccagaagcggcaactgctggagtccctttccaggtgtgaagctttgttctttcgctcttgctgctgctccctgtttaagtccagactacctttgtgagcttgtaacacagtgagg

SEQ ID NO: 113948 - DNA, 999 bp, Homo sapiens
tagaactacagtttaaaaaacttatttcttgatggatagtctcgtgaaggtattgctgtgtctactcaattatgactaaccatagtctctcaagggtggcccacactaatcattctccatttttcatcttaccagaatgctgctggtggagtcagcaggaaaagcctttctgcccctgatcaacctctacctgaggacctaaggcaatgcttttattgtagatcctgatatgcaaacagaactacagcactccagaagtaacctcatttgactggcctattagttaatgggtaaatacatgtgtaaatgaacgaatgactaagcaaatagagttaaccggccaaggccgtgctcagcatcctattagaatatagtaattataaggctatcaaaaaccattgttctttaaatataatgccttttcacacacacacacgtgcatgcatgcacacacacacacccccacacactcctacctctgtccatttttctccattccttcctccaccttttcaaataaatgaagaaacctgagtatacatacaaaataactgttgatttgtgtatttgcagcatgaaactcacagtagaaaatcccagggttctgtcttggaatcttgagcactgctctctgagatctggagtctctctctgtgtgaaggttaagctcctgatggtctctgcctgtcctgggactgctgttgattcatgcagggagagagccgagaacaagctgtggctgaagagggcaaaatatgaggacatgctaactggtttgggaaaggaacctcctgacatctggctctctgcccccacaacagtggtcaggaaggagaagcagaaagaggcaaacaagcttaatggctctgaaacatatcattggacatttcagagccccttgcagggaactgaaatgttgcatgttttttaaagctaactatcactaatttaatttaaataattttttttgtactgcctataacacattttgtggatgag

SEQ ID NO: 113949 - DNA, 385 bp, Homo sapiens
ttttttttttgagacagagcttcactccgttgtccaggctggagtgcagtggcatgatctcggctcactgcaacctccacctcccaagttcaagcaattctcctgcctcagcctcccaagtagctgggactacaggtgtgcatcactacgcctggttaatttttgtatttttagcagagacggggttttaccatgttgaccaggctggtctccaactcctgacctcgtgatccacccgcctcggcctcctaaagtgttgggattacaagtgtgagccactgcatccagccaccatggctgattttaagaaatcaacatgaagccattgtatggggagttggtaagaaacatccacaatcaggttttacactatccttatctgtgc

SEQ ID NO: 113950 - DNA, 1423 bp, Homo sapiens
  misc_feature (32)..(32): n is a, c, g, or t
  misc_feature (43)..(43): n is a, c, g, or t
  misc_feature (51)..(51): n is a, c, g, or t
  misc_feature (53)..(53): n is a, c, g, or t
  misc_feature (55)..(55): n is a, c, g, or t
atttccacggggggaaatgttaacaaaccccnaaaaggggaangctttaancncnaatactaagtaccatgcacccaaatcctagcaagcttaactatagctaccagttatgaaagttatgtcacaagacatcctttcctctcccttggaggaggactcagttccacagtttcaccttagcatttggcttatgataaggagtccgtgcaacccccctccctcctacccctgagatacatttttctcccagatgcaactccaagcttcgagtcaaggccctaggaaacaaaattggatctgagggatccagaggcaaataacaacagaggttaaaaggcacagggcaagtgagcatggctgattcctgccaaataagccaacactaagcttcctgtttcatggataaagaccacgttaatattcatggcataaatgaggtctagggaattcgaaggccatgcatccagccaccatggctgattttaagaaatcaacatgaagccattgtatggggagttgaatgctgctggtggagtcagcaggaaaagcctttctgcccctgatcaacctctacctgaggacctaaggcaatgcttttattgtagatcctgatatgcaaacagaactacagcactccagaagtaacctcatttgactggcctattagttaatggctctctacgtttatcactgaaaaataagacagatctgctaagacgactgataaaggacagaggctggaattgtgattgcattaatggaacctgactagagaacttcacaaatgcccaaatcttatcctgccattcactcctgatgctgacatttccagaagagctacacataggaagactgatagcaactgggaaccaaaatgacaattatctttcagagcttggtaaggttgggtaagagcatatggttcattcttaaggcctaagaaagacactccctccctacctgcccctcttccccacacatctcagcttctcctcaaaatctggactctctctattccatcccatagagtggaaacaagaaatgcaaaaggagcaccatccatgggcatggtctttttatggttgatctggccatcgataaacatggccaaccaatactttaactgaccaaacatgaatggcaagccattcttccctaaaggatgtgggagaacgagagagagggccaatagggaagtaggcagagaggcagaagcatttcttcctctataacatattcaccctatttccataaaaatgttctatttgaaatcctatacagagaagtttatgaaattgatttggcttcctttagtaaaccctaaagtaaaaacgcttagaaaaatgatgaaataaggtttaaatatttaattataggagaatttttaacatttcaaaaaatacaatcctatggaaagaaaatt

SEQ ID NO: 113951 - DNA, 316 bp, Homo sapiens
ggcctggagagaggtgccacccaggacgggccatcaggagaggccggggatggccccaggtgtggctggcggaggtgggtggttctcccagccagggctcctggtccctggctcacctggagtcacacgtggcggggccaggactgctgtgagcttcacaggcagccgctcagttgggccttgtcctttcctgtggatagcctgagactctcctgttccaaatgatgatgcctaagtttgccaaggggaacttcagcggctctcaactaggactagagaggcaccgatttctcatcacctgagcacacacggcacg

SEQ ID NO: 113952 - DNA, 283 bp, Homo sapiens
taaaagtagacatcaactataagtaaagtgaaaaagcagaaaaatatcaacaaagtcaaaatgtggtcatttgaaagattaataaaattggtaagccctggcaatactgattttttttaaaaagagaaaacacaaagtatcagcataatgaatgaaagaagggtagatactacagatgctgctggcattaaaaggacattagcaacttcatatcaatacgtctgacaatttagatgaaatggacaatttatttgaaaaacacaagttaccaaaacaggaacag

SEQ ID NO: 113953 - DNA, 351 bp, Homo sapiens
ctcgagctgaaaattgactgtaagagggagtacaaaatggtggcagtagcctttactcctctatttcacaaaaattcatgtagttcatagatccaaaaataaaaagggtaatagataactaatagaatagattctttaggttttgtcagatactatttcttcagtatgcttttttcaagtttccttgtaacttctttgaaattgaagacgttcatgaattttagaaaatattatcaaatattatctctactgacaatttgaattttaatgtaacctcttaaattaattcagtgtcctccaaatttaagtgatcatttcagcacatcaggtggtatagtattaacatatgtt

SEQ ID NO: 113954 - DNA, 552 bp, Homo sapiens
agctcggtacccaggaaagatgacccagaccatatgtaatactatagcagcctttgcaatctggtctccactcctatcattctgtagaaactgctttcttgaaggttacccacaccacctaattgccaggaccacagtccttagtccttattctcattttcgtttagcagacagcaactacttcatctctagaaaggtagttactacatttttcttgacacttaaacttactttggactctttaacagtgttctggttgattacatacctgtctgaggcacactgcagtgcaaagtacatattttgaagtcagatagggtctgagtctgaatcttagctctgaccttgggcaaagtatatgtttttacagagcctatttcttccgttggtgagtggaacactaccaaattaccagactgaattgtgagaatcaaataaaataatgtagagtctagcagtgtttgcatttagttggtgctcaaagtgtctgtttcccctccctccccttttctgctttctctgtattcttcaggcatccttggccttgatcca

SEQ ID NO: 113955 - DNA, 273 bp, Homo sapiens
aggagagaagctgtttccttgccttttccagttcctaggggccacctgcattccttggcccatggcctccttctttcatcatcaaaacaagcagtttaacatgttcaatctctctctctttctccctctctgatctctgcttcctttgtcacatctcctctaactccatgtgtcctctccctcttataaggaccctgtgatttgttggacccaccagaataacccccccatctcaagatcctttactaagtcacatctgcaaagtacttgctg

SEQ ID NO: 113956 - DNA, 220 bp, Homo sapiens
cctagagttcgtgctgtcctaggtctacgctgcgagccccctccaggacagggcctgggagctcttgttcatctgcatcctgggggcgggcagaggtggcagagggctgggagatctgtccgggcttttggaggaagctcttcaacctgttcaccccgcctccgccgttgtgtcacttccaaggcccctggccagaaaacccactgggaggaagtgaggg

SEQ ID NO: 113957 - DNA, 478 bp, Homo sapiens
cgtcgctgtactgggtaggcctctccatcccaaagcctgattagttaccggactgcttgaggtgtaactccagagggtggcgccgcttatgcccagcaggtgggatgtgccagagaaaggcatctcttactgccacggttttcttttactggcatttcaacctcacacatcgcacccattttacaggtgccgcaaacgaggggccccactgggggacgtggttttattcagtgactcagaattggtgctatagaaacttctaaaactcggtctcagtttagcagtttcaatcgcataacttaggctatcctgattgattcagccaaaggcagtgtggctggagaaaagtgagatgagaagtcctagctcttttaagctaataggatgcctttaaggaggcttcagcaggggaatttgacattttccacatattatgtattaaaacaaggtactattgctactcaatcattaaaacacc

SEQ ID NO: 113958 - DNA, 200 bp, Homo sapiens
cccgcctcagcctcccatagtgctgggattataggcatgagccaacgcacctggccaggaaaatacttttttaataagcatctacacagaggctgctaggcaagtatccattctctgcctttgcctccaaattatcccaagtgtctaaagccagacacatttccccctattttatgagttgttttttttttttttttttt

SEQ ID NO: 113959 - DNA, 335 bp, Homo sapiens
cgagtaatattcattttccagatggaccgtaacacatttattcacctactgaaggattacttggttgcttccaagttttggcaattatgaataagattgctacaagcattggtgtgcaggtttttgtgtggatgtaacttttccactcccttggctaaatgccaagtggtgccaatcatggattatatggtaagaggatgtctagtttcgtaagaggctgccaaactgtcttccaaagtggctgggtaattctgtagtcccactagcaatgaaggagagatcctggtgctccacatgctcaccagcagttggtgttttcagtgttctggattttg

SEQ ID NO: 113960 - DNA, 225 bp, Homo sapiens
atggcccacagactgaattaggcccactgactgtttttataagtaaagttttattgaaacacagccatgcccatttttaaaatataatgtctccagccgctttctgacaaatagtggcaaacaatgacagagttgagttgttacggtggaaacaacattctccaaagcctacaacattttctctctggccctttacagaaaaagtttgctgatttctggtatagg

SEQ ID NO: 113961 - DNA, 212 bp, Homo sapiens
gctgagagctggggtgtgagttcctgtggaagctgagagctggggtgtgagttcctgtggaagctgagagctggggtgtgagttcctgtggaagctgagagctggggtgtgagttcctgtggacgctgagagctggggtgtgagttcctgtggacgctgagagctggggtgtgagttcctgtggaagctgagagctggggtgtgagttcctg

SEQ ID NO: 113962 - DNA, 456 bp, Homo sapiens
acttctcattttcaacttatacctgcaatgtttatgtagctggaaaaatgaaaacgaaatgtggctaaaagaaaagaaaacgaaagaaagccacaaaattcccaaaacctcagcataacttgcttctttcttcactcgctctcattaagtcttaattctccagattagctttgtctcaaatatttctcaaactagtaacctatttctgggtacagtatatttggcggggtaaaagaaacactgtcaagtttttctaaaacgtcgggtgcacgttaaaataattcctatccactctaataccaaaacgatatcaaaggaaagcatcccatctggagtagtcccatgaatctaaataggacgaagcagcctaccgctattgtctaaatcaagtatttactcgtattcatgcctaagagagagaagtaaaaaaaaaaaaattaaatcttagatcttgct

SEQ ID NO: 113963 - DNA, 408 bp, Homo sapiens
gaggcagaagaatcacttgaatccgggaggcagaggttgcagtgagctgagatcatgccactgcactccagcctgggcgacagaagcgagactccatctcaaaaaacagaaaaaaaaaacgggtaatggagtctggggcctacgagatgggggatgagcagggatgggactggacactgaatgtccaagggtaagaggaggcctgtagagaaggaaacacgcattcacaatggccctgctaaggactgtcctgccattttcacatactataaggtaagcactattactgtctccgttttacagatgagaaacccagggcacagtgaaggattaagtaactagcccatgcttccatcgctagaagaggcagaggcaggattccaacccaggcaatctggctctaagaca

SEQ ID NO: 113964 - DNA, 280 bp, Homo sapiens
tttaactcaagccccttgtcctaccacattttcccacagctctccacttcatcaaacctcgtgtacagacactcaggtttaactgtgtatttgggtcctcgtttccttatgaaggctcccatgtcgtttaaaacttactatctgaaatacatttgtgtgcttttctcctgttaatcagtgatttgttgcaggtgctccagtcaagaacttagaagagtagaaggaaagagattttccccccctacagtagccctctcttactataagctatcaatcgatt

SEQ ID NO: 113965 - DNA, 386 bp, Homo sapiens
agcccggctcctcccttcaaaaggcaagagagggtgagtgtatcaatattccttctacagtgtgaaaactagaatttctagatttccttcactgggaccctgtatgatataataccatgagttttctatttggaattttctgagaacaaatcacaatttaaattcaagttcttcaattagtaacaaaggttaggatggatgccaaggctttcatccaactaaaactcattttctggatttactggatatgaaggaaacaaggaatattcctggctgattcccaggtgtcccctcccactcgcttacccctccccacttcattctcatgagaaatgaaagtcacccacgggatttggatgcccattagaatcttcctgccttacaga

SEQ ID NO: 113966 - DNA, 236 bp, Homo sapiens
gtaactcaaaccagtcacagactgtgttttatgatttttagactaattacataactgaaaattccagagggagatcaggcatggtttgatcagggtgctaactcagtttttcagcatttctcttggtctgtgtttctctatagcattagctttgtcctcaggctggcttttcttgtgatggcaaaataactgccaattttccagtcattaaatgtgtattccccattgtccaaaac

SEQ ID NO: 113967 - DNA, 261 bp, Homo sapiens
gctccttaaggaaaagtcagcaatttaaatcaaaattaaagcttgaatctctaaaactggctaacctcatctggaacatgtggctcccgcttgcacctaagatcaccttctccattgtctaccaggctagcgtgagccacacctgttcagttttccaactatcagctaagagaaagacttcattaatatttggaggatacaggccgggcacagtgtctcatacttgtaatcccagcactttgggaggctgaggcaggtgga

SEQ ID NO: 113968 - DNA, 361 bp, Homo sapiens
tttttttttttaacaggatcttgctctgtcacccaggctggagagctgtgacctgatcacagctcactgcaaccttgacctcccaggctcaagtggtcctcccaccacagctacctgagtagctgggaccacaggtgcacaccaccatccctggctagtttttgtatattttgtagtgacagagtttcgccatgtttcccaggctggtctcaaactcctggggtcaagcagtctgcccgcctcagcctcccaaagtgctggaattacaggcatgagtcaccgtacctggccacattcttttttacttgccacacttccctgaattagccaactaggtatgcagaacaatgacatggaaggc

SEQ ID NO: 113969 - DNA, 150 bp, Homo sapiens
ccgggattggaccccataatcttgtaggggaggaaagatcagaatgccccattgctggttccttatggagcctcagtccagctttgtcctaaaccaaacttccttggcataccccccctttttttttttgcaactgacatcttttttttt

SEQ ID NO: 113970 - DNA, 279 bp, Homo sapiens
ctgtgttgcccaggctggtctcgaactcctgagctcaggtaatccacctgccttagcctcccaatcctattaatttattaaaggttagtgtgctgtcttctcccccttgctatgaattagttgggttatcactataagttttccatactgtaggaaaccaaaacactgccttcttcctatttctggcagcttggggatgctcctaaattgcaatatcatttatattgttagtttacattccagtttgccagtatgccatgtaaataagtcccatacatg

SEQ ID NO: 113971 - DNA, 140 bp, Homo sapiens
gaaccctgttggaaaggaccacaccaagttcttctcacacccacacctgtaaccttgggtccacatctcacaacacaaaagggccccttcagactcttagaacacctgttggagactttaaggtaaagctgaccaggaat

SEQ ID NO: 113972 - DNA, 144 bp, Homo sapiens
cgcgccgcggagcggggacccgacgcggtgtcccggacctccagtgcccggcttccttgggaacaaactgttccagccaaataggtcactgtgccgatgggaggacggagaccgcgaaggggcaggggagagggcttctggagt

SEQ ID NO: 113973 - DNA, 291 bp, Homo sapiens
cttttggcttttaaactgcgtaagatggggagccactgaccaattttgagcagaaaagtggcaaaagcttcattcaagggaatcaaacacatcaaatctttaaatatgattaacatatcattgtgtcactgagttaagtctattacacagttttatctaaaaattagatttaaatgacatacgatgaattaaattactctatcttacaaagtttttgatggccccaaatcattatcaacagcgaagctggtgatttcagggctaggagataagggttagtggtgtggcctc

SEQ ID NO: 113974 - DNA, 956 bp, Homo sapiens
agattggaaaacagtctgtcggttcctcaaaaacttaaacataaagtcatatatgatgcagcaatggcactcctaggtatataaccaagaaaattaaaatcaaatattcactcaaaaacatgtacaaaaatgttcatagcagcattattcataatagtgaaaaagtggaaacatcccaaaccaccatcagttgatgaacaggtaaacaaaatgtggtataactataaaatggaatatcatttggccacaaaaaggattgaagtactgctgcatgctacaacaaggatgaaccttgagaacattgtgctaagtaagagatgcagatgcaaaaggcaatgttgcattattccatatacaggaaatgcccagatcaaatatatctatatatagagaaggtagattagtgtttgtcagggactgcaaaaacggggtaattggagagtgactgccagtaagtacaggaatgctttccagcattgctgaagtattctgaaattaggtagtggtgatggttgcaaaaccttcggaatatagtaaaagacgctgaatggtatgcataaaaatggtgacttttgtgatatatgaattatactttagaagtaataatagcaacagtaataaagagaggtatctttccacacctccatgtcctgtatttttattaagaaagaaaaaaaaaaggctttttaaggccaggttcagtggctcactcctgtaatcccagcaattttggaggcctaggtgggaggatggtttgaggccagaagtttgagagcagcctgagaaacatagcatcacctcatctctacaaaacattaaaaaacttagccaagatagtgatgtgtgcatagagttccagctacttctgaagttcggacaggaggatcgcttgagcctggaagtttcaggtagcagtgagcagtaatcactactgcacttcagcctgagtaacagaa

SEQ ID NO: 113975 - DNA, 636 bp, Homo sapiens
tacagtttttatcagtgatcacattttagtgtaatacatgaaactgaggcttgatagaaaacaggagagaaggcatgagtgcatggggtacatagggagatgagggcaagcatcaccaaggagcggcagtgagatagacgctctcatggactgctgctttacaacctccctggagagcaatttaaaaatatgaatcaagatccttttgatccactaatcatccagaaatctacacagaaatatgcacaaaaatatgtggcatccattgacttccaacctcttctctttcaggggaaatattccttaactcttctctcttgttgccctcaaaggcaaagcctctccatcctcccactctggaactcactgtaactgttcacattgttcaggctttgctaaactgcaagaagagtggctgccttctggatggtgaggcagaaaggaggaagatgtctgcattcctgatggcagtggtcaccatacaagccttatcctgactacctctgttatttttttttaatatcaaaacatataccccttatctgtttaagcttctccgatcaggtctctggttaccatcagtcggatgtagttcagagctaaaaatttttaataaagcttttgtagctctattca

SEQ ID NO: 113976 - DNA, 412 bp, Homo sapiens
ctattatacagccttaaaaaggaattacgatgtatgctacaatataggcaaaccttgaagacattatgctaagtaaaataagacagacacaaaaagacaactgtcttatggttgattgcatttatataaggtatgcagaacagtcaagtttgtagagatagaaggtagaatagtagttaccagaggccaggggagaggagaatagggagctgttgtttgatgggcatagtttcaatttggggtgatgaaaaagctctagagatggatggcaatgatgtgcagatacttaatgccactgaattgtacacttaaaaattattaaaatgatacatttttatgtatattttatcaaaatgaaaaactttcaattaacaccataagccactggaaaagcctgtggtatttgaagagg

SEQ ID NO: 113977 - DNA, 537 bp, Homo sapiens
gggagagactgtcacttcctttctgcatggactgtggtgttcctgccccacccctgccgaaatgttaatgagctgtgcaaactactgctggattgttttgttcttccccctaatcagagtttccactcaggactgggtagcctgtggactccctggaggacagataggtgtggcagcctcagtggcctagagtggacagctggtttaccgatagtccttttttttgagacagagtcttggtctatcacccgggctggagtgcagtagtacgatcttggctcaccacatcccctacctcccaggctgaagtgattctcgtgcttcagccttcccagtagctgagactataggcagacaccaacatacccacctaattttgtatttttagtagagtcggggtttcaccatgttggccagcctggtcttgaactcctgtcctccagtgatctgtccacctcggcctcccaaaatgctgggtttataggcacgagtcaccgcgggcttactgatagttctgtaggccaggggaataatccg

SEQ ID NO: 113978 - DNA, 460 bp, Homo sapiens
tcatggctgggaccctctgagaccttaccctatgcatcactccctttggttggttctacttgtatctttttgctataacaaaactgtaatcataagcatgtacttttctgagttatatgagtcattctaccaaattattaaacctgagtgtataccgagaacccttaagttgaatcaaggtgtggaagtggaagtggcaccattcaccatcacccctagtgacccactagcaaaatttttgcttcctgttcctgcaacattatgttctgccagcctagagatcttagttccagagggaggaatgctgccaccaggagacacaacaatgattccattaaactggaagttaagactgccacctggctactttgggctcctcctacctgtaagtcaacaggctacaaagagagttatagtgttggctggggtgactgacccacactatcaagatgaaatcagt

SEQ ID NO: 113979 - DNA, 375 bp, Homo sapiens
agcctggggttgcagtttctttcccagagtaacacttttcctaccaacaagtagttgattaagtaggttttaactttttttccttcctgtctaccatccattgtgtgtgagatgggacattaatatgggtaagagaaacagacaaatctaaaaggtgctgaaaacccacataatagagtaactgccctcccccaaacaaacccaatgacttgttttacagtgcatgacactagaaagataagcactgataagctaagccctgttagacaggcttccaatgtgaatcctctaaccatcctccctgaatctcctctggaagcatttctgagaggcagccaaggaaatgggaaaaaaagcaggctttgtggtcaagat

SEQ ID NO: 113980 - DNA, 847 bp, Homo sapiens
ctccatagtctaggcatggagacaaatgcttctctgcccctaagggaggcctctctaccagagggctcagaaaattccttcctccctcctttcttccctcccttccttccagtgtttacagaatgcccccttggaccagaaactggctgcctttatgaagagaagaatcggggggaagagatgcttaaaggtaactttttagcctccagaggctgggccctctaatcacaggcacaaaactattaatattattccatgcagagacaagcagccagaataattagagctcaagcaattctttcacagcaagttcttgatgttttattttattttattttgtatttatctgtgtttgcctgggttacctacagtgcacactcccaccactcggccccaggctgctttctcttttcttggaactctccatgcttcctcctgccccggaacgtttgcacctgctgttcccaatgctggtcaaaagaaacaaaaaccagatacgctttaaaagggagaaagggtttgtattagtcagagttttccagagaaacagaaccaataggatatttatttatttatttaagatttattataaagaattggctcacataattttgaaggcaggcaagtctcaggatctacagggtgaattggcaagctggagacccaggagagctgatgggtagttccagtccacatcagagggcctgagaatcatgagtgctaatggtgtagttctgtctgaatgaaggcaggctaaagacccaggaagagccaatgtttcagtttgaatccaaaggtaggaaaaaagctgatgtcccagcccaaaggcatattctggggaaggtca

SEQ ID NO: 113981 - DNA, 411 bp, Homo sapiens
gagacagggtctaactctgtcacttgggctgcagtgcggtggcgcaatctcagctcactgcaacctccacctctgatctcagctcactgcaacttccacctcccgggttcaagtgattctcctgcctcagcctcctaagtagctgagattacaggtgtgcaccaccacgcccagttaattttttgcctttttagtgaagacagggtctcgctatattggccaggctgatcaactcccagcctcaattgatccacctgcctcagcctcccaaagtgctaggattacaggcatgagccaccacgcctggcctcttttttcaatttctttttttgagacggggttggggggggtctcactctgtcacccatgctggagtacagtggcatgatctcagttcactgcaacctctgc

SEQ ID NO: 113982 - DNA, 208 bp, Homo sapiens
ctaagactcaatgacacttgactgatttggggtcagtatctaataagcgcatttcccagatgaaaaaccagcacagctaggccttctccacagagcctatacctaggtctatcgaaggaagaagatcattcagaattttatttttgcaaaccttcaaatgttaagatctgaataatctatttaggacagtcagaactgcctaatggaa

SEQ ID NO: 113983 - DNA, 263 bp, Homo sapiens
ctgattttgaattccatagaaaaccctatgcactatgttaagcaacaaggatttcagtggcaaataattggaggcaacccacatcacagcaacctaatgtttcaatactggttgggcaagcgacagattaagaaaaattttaaaaggaattctggagatatggaagttgtacatgcttgcaggagagatcagagaggtttcctgctatctacttatccttggctgactgtgagaccttttgcaagcagacagtaaaatacagg

SEQ ID NO: 113984 - DNA, 357 bp, Homo sapiens
ttccatctattttcacagggctaaattttatcttgggttaggtatgaaaaagaacacttctcaaggatagtaaaatagtttatgttcaatgaaatattttcatggttcaatgttgtttcattcttaatgatcataaaacctctcaactgctctggactcattttaatgacagctctctcgtggctgtgaatcacagttcaccagcacattaattggcaaggtaactacagaaaaagggcttcctcgtgagcttcattaagttttcacaaatgacagcagcttcaacttcttacacttaattttctttcagtttaacacgaagagtcaatgcaaacccccccagcagcttgatgggta

SEQ ID NO: 113985 - DNA, 225 bp, Homo sapiens
tcttttgaaaagtattaaaggaatataaatgatcacccagtagtgaatgagattgtctcctttactgagtaatgactggagtaacattttccatcaccatcaagaaaacgtgataagtagaaaatagtatgtatatatttttaggctgggcatggtggctcatgcctgtaattccagcactttgggagactgaggtgagcaaagtctgccttccgggttcaagcg

SEQ ID NO: 113986 - DNA, 229 bp, Homo sapiens
catgcactaaagaactttaagctattttagggtaactgagtgctctttatttgagccataagcccatgctaagactgctttgaatacttgcccttactcatgcattaaaagagggctgaccatgatttctcaaaagggtaaacatagactactatatgacccagcaagtctactcctaggtatatatccaaaagaaatggcgtgaacccgggaggcggagctttgctgt

SEQ ID NO: 113987 - DNA, 754 bp, Homo sapiens
gtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgtgagttccttgctttttcc

SEQ ID NO: 113988 - DNA, 610 bp, Homo sapiens
atggtctcagaagtgaagtggaaggggccagctccccaggagggagaggcacttggtgggggcagtcttccttaaacagggactggaaagccaggcccatgggcagaaggggtgtctgccaggggggcatcagtaccgtcattccaatcatatagaagcaccaggcttgatgtgatggaagggttcctatcactttctgtttgtgtgtttttttttgagacggcgtctcgccctgtcgcccaggctacagtgcagtggcgccatctcggctcactgcaacctccacctcccgggttcaagtgattctcctgcctcagcctcccgagtaagtagctgggattatgggaatgagccactgcacccagtcatttacctttttttttttttcaatatggcaagagctcctaaaatctactgtcttagcagaaatccccggtataattcaatgttgttgactaggagtcctcatgcacattaggcctctgggcgatgcatcttgcatatctgcctctctgcgtcctttcacctacatctcccgtttcctccttcacctcccccacccctgctccttggtaaccactgttttattttctatgtcttctacttaaaa

SEQ ID NO: 113989 - DNA, 879 bp, Homo sapiens
gagacagagcataaacagcagccacacaagacacccacgcgggacacgggccgtgtgcgcacatgggcacctgatgcctggtggccgagaggacagcacggcctgaacacccggcaggaggggacggatggtccatccacactggaacattatcccatgacgaaccggagccaggccacagcgtgaacctggaggacatcatgctcagtcacagatgccaaactcagaaggccacgcagtgtgtgatcccatttctatgaactgtccgggacaggcccatccagagacagggaggggatgtgtgggtgtcggggagtgacggctgatggggacaaggtttgttcttctcgaggtgatagaatgctgtagaattggaggtggtagttgcacacttttctgaatgtactacatgcgactgaattgtacaccttaaatgagtgaattgtatggaatgtgaattacaaatcaatgaagatgcccaggccgggtgcggtggctcacgcctgtaatcccagcactttgggaggccaaggtgggcagatcacctgaggtcaggagttcaagaccagcctggtcaacatggcgaaacccagtctctactaaaaatacagaaattagctgggtggtggcttacgcctgtaatcccagctactcaggagggtgaggcaggagaatcgcttgaacccaggaggcagaagttgcagtgagctgagatggcgccattgcactccagcctgggtgacagagagaggctctgtctcaaaaagtaagtaggccgggcgtggtggttcacgcctgtaatcccagcaccttgggaggccaagggacgcagaacacaaggtcaggagttcaagaccagcctggccaagatagtgaaac

SEQ ID NO: 113990 - DNA, 319 bp, Homo sapiens
ctcagcttcaaagacagtgccctcttgctgtttctgcgtaggaccagaggggccaaaggggctggggtgccccttcaacctctcttacaagggcattaatcccatttaaatcatcatcccatattttaaaaacacacaggggctcctgatgatacataacagaaaatctaagcagccaaccttactgacagtttgtaatgactccccccttgaccatggtgaggtgaacctcacacaggtaggggctgtcgggatctgcctcctcactctgggcttcagccagtggcttctaagccagaggcagcatgatggccacggt

SEQ ID NO: 113991 - DNA, 937 bp, Homo sapiens
gatcagccaagcaggctgctgagaaagatgacctgaattgcagggatgcagaaagtgctgaagatgctttgtcagctgagaactggttaagagaaagtggctgatacagcaaccccgttcagtgtctgcttttgtggggagccctctgctcagaaaactgctcttcttggcacccacttttctccctcctgtctctgggccacccttcttctttccactgggtgggccatggatgcatggacttcagatagctcggacccctgggtgctgacgagatgggaccctcgggacccctggaggactcgcagtgctgaccactagccgcgtcgcctgagccccagcgctgatgcgatacagtttccccctcactgtgctggagggagaagaccctgggatttctgagcgaggcccgtggatgttgaagtcttcctgggtccccgactccatgctctcgcgccccagttactatgacgccctgcacaaccgcagctcggggcacgcccagcgccctgcaggacactcggcctccccggctcagcatctgcttcgagggcccccctctgaggcggcggggcggcgtggtggatcaccgagatgtcatcttggcccaccaggcccacaaaatccacagcaccccccaggccaggaggaaagaatgggagttatcaatactctggctgaccatcgtcatccgtgggactgacttcggtggaacgtccttgggttacttatcattacctgtgtttctggagaagttaataaaatttggccatctacgctctgcaacaaagttaacctataagatgttgtcattcctggaagaactaatcttcccggtttcaaaatggaccctgtgggatccacggttgtaccagcacaaaaccacgaggtcaaccgacggaacacacgcaggactcacactcgtccctgcagacaa

SEQ ID NO: 113992 - DNA, 163 bp, Homo sapiens
atgtttgagggggaggaaggaggaggctaagagaggccttcttatgttctgcttttttgccctgaggggatgacacttaaccactgcagaggctgcagctgagccgcagggatggtcacactgaaccagtagttcttcccttcccccactctaaacctctgcc

SEQ ID NO: 113993 - DNA, 547 bp, Homo sapiens
aggcgttcaagaccagcatggacaacatggcgaaaccctgtctctactaaaaatacaaatattagccgggtttggtggcccatgcctgcaatcccaactacttgggaggctgaggcacgaggattgcttgaatccgggaggcagaggttgtagtgagccaagatcatgccactacactccagcctgagcaacagagtgagaccctgtcacaaacaaacaaacaaacatgcaaacacccattctctctataaggtggacagtagaagccatattttaccaatgaagaaactgggctttagagaagagcaagtcacagagctggaaagtggtagaacaggcatttaaatctaggttagcttgataccgaagcctatgtttttagtaaccatactgaacctccttgagtagttaatttgctgagcattactgtgaaagagagctaagtcacttatgttccctaggatttataaatgagacatctgtgttagcacagggcattagtaacatgatttagattaaatctggctttgggattaaagaatagaga

SEQ ID NO: 113994 - DNA, 431 bp, Homo sapiens
cacactagagtggaggagggactgaattccccaaaggaaaacaaggaaacctagggagacaaaaaaaaatgcccattctgcaatgtatttttccccaaaatttgaactgactgtgggcaggtgttggcagtagggcttggtgggtggggaggtgggacaaagcctgggatcttaagaggaaacagtgggtagaaggaaatgaatgacgagctagagaagctacttggacgtaaggagatggctgctcttttcgttcaatagttactggattccaaaagttttacaagacattatctcaattaatcttcataatggtctcatgaggtatgaactcattttagccttgttgcaccagtgaggaagcagacccaggaaggtccatggatttgtccaaggtctctttgtcattaagtagcacaatcagggctcac

SEQ ID NO: 113995 - DNA, 389 bp, Homo sapiens
attgaaatgcaagagaatttttattgtcttggagtgggaattcagcatgacacaaaattcaaagacaatgaagtgaaatgtaactacataaaaattataattgtctgccgggcacagtggttcacacctgtaatcccagcactttgggaggctgaggcaggtggatcacttgaggtcaggacttcgagaccagcctgactaatacagtgaaatcacatctctactaagaatacaaaaattagccaggcgtggtggcgtgcgcctataatcccagctactcgggaggctgaggcaggagaattgcttgaaccagggaggcagaggttgtagtgagctgagatcgttccaatgcactccagcctgggcgacagagtgagagtccatcttaa

SEQ ID NO: 113996 - DNA, 271 bp, Homo sapiens
gacaatctggtggtcatcgaagtgcagtttaatgcaaaatatatacaataaccaacttggctgggcgcggtggctcacgcctgtaatcccagcactttgggaggtcaagacgggcagatcacctgaggtcaggagttcgagaccagcctggccaacatggtgaaaccccgtctctactaaaaatacaaaaattagccggccatggtggcaggtgcctgtaatcccagctactttggaggctgaggcaggagaatcgcttgaacccgtgagg

SEQ ID NO: 113997 - DNA, 302 bp, Homo sapiens
aaggaacttgtcaaaatgcatttgttagatcacgttttaaatgaagtacaattgaaggtagtttttgtccaaagaaaggaaaaacccctgcaaatccgctgagctcccagagagcgcgcctcctttgtcgtcgcgctgacattgaagtgtaatttttcatggttatttggactggaaaatgggggggggaagggagagatgggcctgcgattatttcccataaatgacaacacaatcacatcacgctctgctacagacatgctcggggaatttgccttttttacatttcatgtgtgaaagta

SEQ ID NO: 113998 - DNA, 443 bp, Homo sapiens
ctcttggcaacccagctcctggcctgtggtcggagctcaggatgggagcaggtgatgtctccactccacatccagaaccaagtccccggaaggaatcgagtcttcttcctgggtggcacagtagggcacccactcgtgggacaaagccctcagaattaagacccatggggacagagccccagccctgccactgacttgccagggatccctggaagggtccctacccaactgcacctggggccacctggggtctctacaaacagaccacttgcttgctgcccccaccctgcctgagacgccagcattgagaagcgagacccagggggagggcccttgcttccaggtacctgcctgagacgccagcattgagaagcgagacccaggtggagggcccttgcttccaggtacctgcctgagacgccagcattgagaagcgagaccca

SEQ ID NO: 113999 - DNA, 302 bp, Homo sapiens
gctgagatcacaggcgtgtgccaccacgcccagctaattttattttatttttttttgtacttttagtagagacagggttttgccatgttggtcaggctggtctgaaactcctggcctcaagtgatccaccagcctcagtctcccaaagtgctgggattacaggcatgagccacagcacccggccgtgatgttgctggctttgaagatgaggaagaggccaagtgctaaggagtccacctactctagaaactggaagaggtgaagcaggggaggggtgggagtgaacccacagccacgggatc

SEQ ID NO: 114000 - DNA, 429 bp, Homo sapiens
gggtttctaatagtacaaagaatgtcatcattcttggttatttcaggtatcagtaaatttaccacttagggttgtaggtatgtcatagctgattgctttcaacacagatatttaatgtagtttaggggagtacattcacttttaaaaacagtattcttggatgtaagagatatttttaatctcttaattttcagtatattctaaatgtatcactatggattaactttagcagtttaaaattatttttatgactaacttctgattctttttccacagcttctcttttaaaaaaaaaaatgctggattttgtctttgacaaaacacgttacagggctttgtgggattttttttcttttaatgttttaaccaaatctcattttacagtttctttatttgatcaccaattttcataaattttttcaagtaaaa

SEQ ID NO: 114001 - DNA, 335 bp, Homo sapiens
ggacatgtatggggagtcaaactggcgcttaaaggcttctgcccatttcacttctcccaacactgcattggccaaagcaaatcaccaggccatagagaagtgagatcctacgatgcacctggaagtggggaaattggaatcttcctggacagcccagtggctatccggggtttaccaggacttttgacatgttaaagtggtcaatctgtcaagtgcaagatttatcctgaaaagtattttgtgactgtaacagtgcttatcctccaggatggaccactctgggaaggttgaggcagagaaactataaacacccttattccttttccatctagaat

SEQ ID NO: 114002 - DNA, 422 bp, Homo sapiens
cagctccgacctttcctcaggcccacctcacacgttcgctgctttggcccacatcacgtatttccttttttttcagagccatttcttaaattataaaggcatttgaggccgggcccagtcagctcacacctgtaatcacagcgctttgaagccagagggtcacttgagcccaggagttttagatcagcctgaacaacacagcgacacccattctctacaaaaaaaaaaatttaaaaattagccaggcatggtagcgtgcacctgttgccccagctacttggaaggctgaggcaggaggatctcttgagcccaggggtttgaagttgcagtgagctatgatggcgcccctgcccttcagcctgggcaacaaagtgagagaccctttctacaaaaataaataaataaaaatcaagtcatttgag

SEQ ID NO: 114003 - DNA, 463 bp, Homo sapiens
  misc_feature (70)..(70): n is a, c, g, or t
  misc_feature (182)..(182): n is a, c, g, or t
gacagagtctcgctctgttgtctatggaaataaaaaaggaaattgtaatcaaacaattagcttttcaganatgatttagttataaatcctacatatgaatacaggacagaatctagacagtaggtattcctccaatatatttcctgatgtgaacatacagcgatgtgtacaccaggcatgtntctcctgggggaaatcgatgctttcatatggcccctcccttctttgtctcatgggtcccaaattatatctaatctttgcactgaaaatcagatccttcatatttcatacaccctgaagctaatgtggtttctccctggtcatcttcttctatgatggcaaagcaacgtccattagttatgcatgtgttattaatagcatcatctgggcagtgccctcagcaatagcacttgaaaaaaggcaaggtatcctctggtgctaaggttactccattttctgactt

SEQ ID NO: 114004 - DNA, 144 bp, Homo sapiens
tggcaggcagggacgggacacaagtgagaggcgggcgtccaggggagggggctgcagagacccgcaggcctgacagaggggctgagctccccactaagggctgagggagttccagtaggtgtgaggcagctgtgacacagcgga

SEQ ID NO: 114005 - DNA, 375 bp, Homo sapiens
ggagaaatttacatataatcgatattaaatatttggtagaatttgccagtgaagcaacttgggttgggagttttgttttttcctttccaagttttaaaactttgcatctttttatagatagagttctgatccttcccccttccctcccccctttgccctccttttcttccttcctttccccttccttccccctttcccttctcctcccttccccctccttttcttcccttccccctctcctgttttgtctccttcttttggaaaaagaaatcggttttatttctcttggcacagagcaatatatgaaggtggctatctcctgactccatatatcacttacataaagatgtccttcaaatatgtccagttacctac

SEQ ID NO: 114006 - DNA, 557 bp, Homo sapiens
ataataaactgtgggggaacggttggcactgaggagagcggagagcccctgccctgtggaaagagggcagtccttgcttggggacagctggttgttgccacaaggtaatgtgattcctctagagccagatctgatttttttcttaaaagaggcctgtaatctggactttaagatatccaaaattttaaataaagacaacgaaagcaaatgtaaaactcagtataagccaaaagaagacaggtgagcaggtcgagtgggtgaatgataggaaactgcagtcaggactgggaaatctgagagcaatgcacttttgcctgggttcccacagagagccctaacaggagcaccctgcctccctcagcctgtcttcctccctccgggctgaggagactttctatctgtccccatcccttttgttcaagccaatattgtggccaatccttgcctaacttttatgggatctggattttgaaactcaaaatatttattttttccatctgctttctgcttcccttaggcaatgaaaaatgctcagctgacttaatgtggggagggag

SEQ ID NO: 114007 - DNA, 390 bp, Homo sapiens
taccctcattaacacagatgacagccccaccagaccatttgccaagcaatcagtcagacaacagccgagctgagacccttttaaccagccccctggggaaccctttaccaagctttgcaggcagtgacactacttttaaccccctgttcctcccagctgtcaatggggcctcaggattaatgaccttgaatccccagctgttgggaggtgtcctgaactcggcatcggccaacaccgctaatcatccagaggtttccatagcaacctcctcccaggcaaccactaccacaaccactacatcatcagcagtggcagcactgactgtctcaacacttggtgggacagcagtggtgtcaatggcagaaacattgctgaatatatctaataatg

SEQ ID NO: 114008 - DNA, 1472 bp, Homo sapiens
gaaaggataaataaattgtggcatattcatacagtggactagtagcacatgagaaggaaagaattgccattccacataatgcctggttgaatcttatgaacctaatgaatgaaagaagacggacacaaaagagaatgtatctatcattccattttcatgaatttcaaaaacatgcaaaataactctatggtttcataagtcaggatagtggttactaatttggggaaaggagatctttttagggtactggtaatgttctgtttcttgtctagggtactgattacagaggtactttcactttgtgaaaattcattgaggtgtaacttatttatgtatttttgcatattaatgcaataaaaatttactaaaattcaaacataatagattttaaaattctaattttagattaataagatatttacactattagaaaattttaaaaacagaagaaaatagtttaaaattctcattcctacccccagaccccagccacctagttccctcacaaacagccaatgatactagtttttgggggggggtttgtttttatttttgtttttgagacatggtctcactctgtcgcctaggctggagtgcaatggctcaatcaccactcactgcaacctctgcctcccaggctcaagcggtcttcctgtctcagcctcccaagttgctgggactacagggtgtgcacaccacggctggctaatttttatgttttttgcagagctgggattttgccatgttatccaggctggtcctgaactcctaggctcaagcagtctgcctgcctcagcctcccaaagtgcaggaattataggcgtgagccactgtgcctagctgatactatttttgtacatgcttccagagatattttttaaatatgcaagcaaataagcatgtatgtaattacacacatgcacacacacacatatctattctcttccagctcccccattttatatgtgtggcaacattttgaacacattattctacagtttgcttttatcatttgttttatcttaaagacctttccagtatctgtacataaagaagtggttatttatttatttatttatttagagatggagtctcgttctgtcgctcaggttcgagtgcagtggcgggatctcagctcattgcaacctccgcctcccgggttcaagcaattctcctgcctcagcctcccaagcagctgggactacaggcgcacaccaccgtgcccagctaattttcatatttttagtagagacggggtttcaccatattggctaggctggtctcgaactcctgacctcatcatccacctgcctcggcctcccaaagtgctgggattacagacgtgagccaccgcgcccggccccttatttctttttacagctgcataatttacttaataagtctccctccttttctgttttgaaacaggatctcactctgttgcccaagctagagtgcagttgcgtgaccac

SEQ ID NO: 114009 - DNA, 210 bp, Homo sapiens
aaagctttacattatctaggttgtgctgtgcgtcatgtctttgcaactgttttcataaaactttgcacaatcctgtcttcccaagtgatctcagagtacttattatttattcttgtaatattacagtggctcttctagccatgtggcatgtcacaatgatttagttaaaggaagtattcacagccggatcacacattgaattcagaatgt

SEQ ID NO: 114010 - DNA, 322 bp, Homo sapiens
aatggcgatgatgatgttgccaaccacaaggaagccagtgatgatggcagtaacgatgataaagaagatgatgccagtgatggagatgaagatgaaatggtgacgatgatgatgatgatgacagatgtggtgatgatgataagtagtgtgtactttgagcacttcctacaagctaagaacttaccttgcattttgtcttcacaacctttgcctttcaaaatgtggcccatggaccagcagcatggctgtcacctgagcacttgttagaaattcagagtccaggccgggcgcggtggctcacgcctgtaatcccagcaatttg

SEQ ID NO: 114011 - DNA, 245 bp, Homo sapiens
tgtccactcccaacctagcacatatatcagtctttctcactagccttgtggttcttcatttctctctttctctgtccatgtggttccttcttgtgtctgttgtctgtctgtatgggattggggaagggaatttcttctctctgtcctctgtcttctctttgttgtctctgtgtcttcatcttttattatggaagagtgtatttgacaggactgatttagttacatctgaatggattttttaaatt

SEQ ID NO: 114012 - DNA, 426 bp, Homo sapiens
tggccaacatggtgaaaccccgtctctactaaaaatacaaaaattagctgggcatccacctgtagtcccagctgtttgggaggctgaggcgggacaatcgtttgaactcagggggcagaggttgcagtgagccgagatggcaccactgcactccagcctgggccacagatcgagactccatctcaaaaacaaaacaaaacaaaaaacaaggcaaaacaccttcgtatactcatggtagcaaagtttttcttcatcacgacacagaaacaaccataaatgaaaattacgaaacattcagtgaccttaaaattaggaatgtccattgatcaaaagacaccataaagagagtgaaaaccttatgtagtaggttgctatgaataaaagcaaaacaaaaaggagtgaaaacacaagtgaaaaattgggagg

SEQ ID NO: 114013 - DNA, 826 bp, Homo sapiens
atacgacgacgaggagtttgagtatcgacatgtcgtgctgcccaaggacatagccaagctggtccgtaaaacccatttgatgtctgaatctgaatggaggaatcttggcgttcagcagagtcagggatgggtctattatatgatccatgaaccagaacctcacatattgctgttccggtgcccactacccaagaagccaaagaaatgaagctggcaagctgcttttcagcctcaagctttacacagctgtccttacttcctaacatctttctgacaacattttttgttgccttcttgtttctcactttcatatttagaagatgttcaatgtactgtttcaatgtgctggtaactgctttgcttcttgggtagagccaccaccaccatagcccagccagatgagtgctctgtggacccacagcctcagctgaatatgaccccagaagccacgatgttgtctgtatccagaatacacttggcagatggaggaagcatctgagtttgagactgtggctgttacagggatcatgtaaacttgctgtttttgttttttcctgccgggtgttgtatgtatggcaacttgagaatttatgtttcagtgtactggaaactttccattttattcaagaaatctgttcatgttaaaagccttgattagagaggaagtttttgtaattgtgctgagatgtttcctccaagaactgcaaagccatcgtggaaagagctgcccagctgtccatcggagtcacaccaaccccaacacccagtaggtgtgttttattgttaaccccttttttttctttttttttttttttttttttttttt

SEQ ID NO: 114014 - DNA, 356 bp, Homo sapiens
ttacctctaggatcccagtgtgactgataagagagaatggagacctgtgcattatgcagcttttcatgggcggcttggctgcttgcaacttcttgttaaatggggttgtagcatagaagatgtggactacaatggaaaccttccagagtcttgctctgtcgcacaggctggagtgcagtggtgcagtctcggcttgctgcaacctctgcctcccggattcaagcgattcttctgcctcagcctcccgagtagctgggattacagttcacttagcagccatggaaggccaccttcactgtttcaaattcctagtcagtagaatgagcagtgcgacgcaagttttaaaagctttcaat

SEQ ID NO: 114015 - DNA, 2589 bp, Homo sapiens
atacgacgacgaggagtttgagtatcgacatgtcgtgctgcccaaggacatagccaagctggtccgtaaaacccatttgatgtctgaatctgaatggaggaatcttggcgttcagcagagtcagggatgggtctattatatgatccatgaaccagaacctcacatattgctgttccggtgcccactacccaagaagccaaagaaatgaagctggcaagctgcttttcagcctcaagctttacacagctgtccttacttcctaacatctttctgacaacattttttgttgccttcttgtttctcactttcatatttagaagatgttcaatgtactgtttcaatgtgctggtaactgctttgcttcttgggtagagccaccaccaccatagcccagccagatgagtgctctgtggacccacagcctcagctgaatatgaccccagaagccacgatgttgtctgtatccagaatacacttggcagatggaggaagcatctgagtttgagactgtggctgttacagggatcatgtaaacttgctgtttttgttttttcctgccgggtgttgtatgtatggcaacttgagaatttatgtttcagtgtactggaaactttccattttattcaagaaatctgttcatgttaaaagccttgattagagaggaagtttttgtaattgtgctgagatgtttcctccaagaactgcaaagccatcgtggaaagagctgcccagctgtccatcggagtcacaccaaccccaacgccaggctgcgcagtgaagaaaatgaatagacagctcatgtgcatgttttgtgtttaaataaaactgtaaaaactgcaaagaaaaaccaaaaaacaacaacaaaaaattattttgtgttaggcttccttcgctttttcagactgctttcaatttccattttcacatatggtattattagtttttttttttagttttagtctttctgatggatgtatctcattgcagtttcaaatttacatttttcctgatgactaaagatgttgaacatcatttcgtacgtttaaaggctatttggtttttttgtgtgtgtgatgtactagttcaaatcttttgcctattggctgttagagtgtgtctttttcttattgaatcataggagttctttatatattctagatacaagccctttgtcagttacgtttattaccaatatcttttcatgcaaatatctttctaatctttctacttcatggcttgctctttcattctttggtattttttgataaatgaggttttaattattttttttttttgaaatagagtcttgctctgtcgcacaggctggagtgcagtggtgcagtctcggcttgctgcaacctctgcctcccggattcaagcgattcttctgcctcagcctcccgagtagctgggattacaggtgtgcaccaccacgcttggctaatttttgtatttttagtagaaacagaattttagcatgttggccacgctggtcttgaactcctgaccttgtgatccacccacctcggcctcccaaagtgctgggattacaggtgtgagccaccgcgcttggccagaggttttaattttaacgtagtccattttaataatctcttcctttgtagttagtcctttctgtactttccctattttgtgatcatgaagacattcctttatgttatctgttagaaattttatttatctttcatatttatattcccaatcctcctagaactgacttttccgtgtgtaatacaaggtaggggtcagttttatttttgtattgtcctttatcaaatatacttgatcatttttgttggtcttgtctggtcattaaaaaatccaattgtttctttaaacatgtatgattattttatttataaccaggtagagtatttataataatatagatgttaagaaagaatgtggccttaggtctagactgcttgtgttcaaatcgctctcataaaattattttttattgataaatgtacatatttttggtgtacatgtgataatttgatacattcatttgtatcaaatttgataatgtataaagatcaaatcaaggtaattggggtagccatcccttaaatatttcttttatactaggaacatttgaattatttttttctagttatttttaaatacacaatagattatggttaactataatcaccctactgatctgtcaaacactagatcttatttcttctactcaattgtatatttatacccattaatcaacttctgttcttgctctctccgtgctacccttctggcctttggtaatcgccaatcaatctactctctatcttcatgagaccagcgtattttagctcccacatatgaatgaaaacatataatatttgtctttctgtgcttgacttattttacttaacataatgacctccaattccatccatcttgtggcactgacagtatttcattcatttttgtgtgaattatatttcgttgtgaatatacattacattttctttatccattcatcactgatgtgcacttaggttgattccatattttggctattgtgaatagtgtgttaataaacatgagagtgcagttatc

SEQ ID NO: 114016 - DNA, 2535 bp, Homo sapiens
atacgacgacgaggagtttgagtatcgacatgtcgtgctgcccaaggacatagccaagctggtccgtaaaacccatttgatgtctgaatctgaatggaggaatcttggcgttcagcagagtcagggatgggtctattatatgatccatgaaccagaacctcacatattgctgttccggtgcccactacccaagaagccaaagaaatgaagctggcaagctgcttttcagcctcaagctttacacagctgtccttacttcctaacatctttctgacaacattttttgttgccttcttgtttctcactttcatatttagaagatgttcaatgtactgtttcaatgtgctggtaactgctttgcttcttgggtagagccaccaccaccatagcccagccagatgagtgctctgtggacccacagcctcagctgaatatgaccccagaagccacgatgttgtctgtatccagaatacacttggcagatggaggaagcatctgagtttgagactgtggctgttacagggatcatgtaaacttgctgtttttgttttttcctgccgggtgttgtatgtatggcaacttgagaatttatgtttcagtgtactggaaactttccattttattcaagaaatctgttcatgttaaaagccttgattagagaggaagtttttgtaattgtgctgagatgtttcctccaagaactgcaaagccatcgtggaaagagctgcccagctgtccatcggagtcacaccaaccccaacgccaggctgcgcagtgaagaaaatgaatagacagctcatgtgcatgttttgtgtttaaataaaactgtaaaaactgcaaagaaaaaccaaaaaacaacaacaaaaaattattttgtgttaggcttccttcgctttttcagactgctttcaatttccattttcacatatggtattattagtttttttttttagttttagtctttctgatggatgtatctcattgcagtttcaaatttacatttttcctgatgactaaagatgttgaacatcatttcgtacgtttaaaggctatttggtttttttgtgtgtgtgatgtactagttcaaatcttttgcctattggctgttagagtgtgtctttttcttattgaatcataggagttctttatatattctagatacaagccctttgtcagttacgtttattaccaatatcttttcatgcaaatatctttctaatctttctacttcatggcttgctctttcattctttggtattttttgataaatgaggttttaattattttttttttttgaaatagagtcttgctctgtcgcacaggctggagtgcagtggtgcagtctcggcttgctgcaacctctgcctcccggattcaagcgattcttctgcctcagcctcccgagtagctgggattacaggtgtgcaccaccacgcttggctaatttttgtatttttagtagaaacagaattttagcatgttggccacgctggtcttgaactcctgaccttgtgatccacccacctcggcctcccaaagtgctgggattacaggtgtgagccaccgcgcttggccagaggttttaattttaacgtagtccattttaataatctcttcctttgtagttagtcctttctgtactttccctattttgtgatcatgaagacattcctttatgttatctgttagaaattttatttatctttcatatttatattcccaatcctcctagaactgacttttccgtgtgtaatacaaggtaggggtcagttttatttttgtattgtcctttatcaaatatacttgatcatttttgttggtcttgtctggtcattaaaaaatccaattgtttctttaaacatgtatgattattttatttataaccaggtagagtatttataataatatagatgttaagaaagaatgtggccttaggtctagactgcttgtgttcaaatcgctctcatgatacattcatttgtatcaaatttgataatgtataaagatcaaatcaaggtaattggggtagccatcccttaaatatttcttttatactaggaacatttgaattatttttttctagttatttttaaatacacaatagattatggttaactataatcaccctactgatctgtcaaacactagatcttatttcttctactcaattgtatatttatacccattaatcaacttctgttcttgctctctccgtgctacccttctggcctttggtaatcgccaatcaatctactctctatcttcatgagaccagcgtattttagctcccacatatgaatgaaaacatataatatttgtctttctgtgcttgacttattttacttaacataatgacctccaattccatccatcttgtggcactgacagtatttcattcatttttgtgtgaattatatttcgttgtgaatatacattacattttctttatccattcatcactgatgtgcacttaggttgattccatattttggctattgtgaatagtgtgttaataaacatgagagtgcagttatc

SEQ ID NO: 114017 - DNA, 360 bp, Homo sapiens
gcagccaccacagggtttacagtggaaagagtgatgtagggcctcacgggtgagccggccctaagaatgtgccactcctggccggacgcagtggctcaagcctgtaatcccagcactgtgggaggctgaggcgggcggatcacctgtggtcaggagtttgagaccagcctgacccacacggagaaaccccgtctctactaaaaatacaaaattagccgggcgtggtggctcatgcctgtaatcccagctactcgggaggctgaggaagaagaatcgcttgaacccgggaggcggaggttgtggtgagccaagatcgcaccgtggcactccagcctgggcgacaagagtgaaactctgtct

SEQ ID NO: 114018 - DNA, 903 bp, Homo sapiens
ctccttcctggaaacccacccagaacctccaccctctgacaccatggtcaactcctgttgtggctctgtgtgctctgaccagggctgtggcctagagaactgctgccgtcccagctactgccagaccacctgctgcaggaccacctgctgccgccccagctgctgccgccccagctgctgcaggccccagtgctgccagtctgtgtgctgccagcccacctgctgctgccccagctactgtgtgtccagctgctgcagaccccagtgctgccagaccacctgctgcagaaccacctgctgccgccccagctgctgtgtgtccaggtgctacaggccccattgtggccagtctctatgctgctagcccatctgctggcaaaccacctgctacaggaccacctgctgccaccccagctattgcatttccagctgctgccagccttcctgcagtatctctagcagcagtagctcctcctgctgtggcttcagctgctgcaggctctcctgctgcatctccagttgctgccgccccaactgctgccagaccatgtgctgccgcccaacctgctctagtgcttcttgctgctgaggctgtcatctggactcaccagattctcatcaaccagcattcttgatgtagctcatctatgagctgagttatgggaagctagttggaaaacttcagttccaaccaattcttagattgaatctggcctccaaatatatgctccccccacattttacctctctaccaaatgaacataagttgtaatttgctctgaaatctgtcaactatcttaattgaaatatttgctctctgccataatttctcatatggagctattccattttaaacaaatatttatctaaataaatcttaaataaattttcaggcatagaaat

SEQ ID NO: 114019 - DNA, 1083 bp, Homo sapiens
ctccttcctggaaacccacccagaacctccaccctctgacaccatggtcaactcctgttgtggctctgtgtgctctgaccagggctgtggcctagagaactgctgccgtcccagctactgccagaccacctgctgcaggaccacctgctgccgccccagctgctgtgtgtccagctgctgcagaccccagtgctgccagaccacctgctgcaggaccacctgctgccaccccagctgctgtgtgtccagctgctgcagaccccagtgctgccagtctgtgtgctgccagcccacctgctgcagaccccaatgctgccagactacctgctgtaggaccacctgctgccgccccagctgctgcaggccccagtgctgccagtctgtgtgctgccagcccacctgctgctgccccagctactgtgtgtccagctgctgcagaccccagtgctgccagaccacctgctgcagaaccacctgctgccgccccagctgctgtgtgtccaggtgctacaggccccattgtggccagtctctatgctgctagcccatctgctggcaaaccacctgctacaggaccacctgctgccaccccagctattgcatttccagctgctgccagccttcctgcagtatctctagcagcagtagctcctcctgctgtggcttcagctgctgcaggctctcctgctgcatctccagttgctgccgccccaactgctgccagaccatgtgctgccgcccaacctgctctagtgcttcttgctgctgaggctgtcatctggactcaccagattctcatcaaccagcattcttgatgtagctcatctatgagctgagttatgggaagctagttggaaaacttcagttccaaccaattcttagattgaatctggcctccaaatatatgctccccccacattttacctctctaccaaatgaacataagttgtaatttgctctgaaatctgtcaactatcttaattgaaatatttgctctctgccataatttctcatatggagctattccattttaaacaaatatttatctaaataaatcttaaataaattttcaggcatagaaat

SEQ ID NO: 114020 - DNA, 348 bp, Homo sapiens
aaattatacactgcggaagattggtgaattagaacatacagcaaaagaaacagtccaaaataaaaagagaaaaaaggctaaagaaaattagtgagctatggaacaacatctagtgatataatatacatataactggagtcaataaatatgctagggagaagacaaaaagattttgaaaatataatggccaaaacttcccaattttatgaaaactgtatactcacagaatcagaatgctcaatgaaccctgtgcagaagtttgaaataaaccataccaaggcataatcaaattcctgataaaaagtgatagagaattcttaaatgcagctgggggaaaatggtattaca

SEQ ID NO: 114021 - DNA, 748 bp, Homo sapiens
tcttccatgctagtctgaccgcagcctcattgatagcacccctcacctctcaccttaatcacacgtgtagattcccttgtttaacttctgctcattctttaggtttcagctcaattagagctctggctgagaacccttaagcgagcatcccctttaccctcctgccgcacttgaaggcactttgttatcatcactggctgttagtgttctttgattgtctttctcatagtgtgtgggcttcatgaagtcaggtactgtgagcctcttgctcactgttaaaccttgagtgacttgcactgtatgtggcacataacggtactcagttgctgtatattgcataattacataaatgtttaactcagtgatgcagtttggtgttgactgggtttcgttcttaaaagaatataatcagtagtctatttatatgtttaactcccaggatttatatttgtgatggttccagataactgataatccccaaatcatgtggctttagcaatccgctttaggagtataaatatttatatttctgttatttttcttaggctaatgttgtgctttatctatggtgtaaatactgataatcagaagagaatggcaatccagaacgtgctggtttaactggtgaatgtagcctaggctgtctcacttgtgactagaatacaaagtcagttattcttacagtgatcattgaaagttattcctattccacctataagctggttattctctttgctaccacaggata

SEQ ID NO: 114022 - DNA, 361 bp, Homo sapiens
ttaggttgctgagtccttatttgatttgtacatgtatatttttattaattttttttctactgagtgtgaacgaatttttctttaggggggaggatatagaatctgtggtttagccgggcgcggtggctcacgcttgtaattccagcgctttgggaggccgaggcaggtggatcacctgaggtcagcagtttgagaccagcctggccaacatggtgaaaccctgtctctactaaaaatacaaaaattagctgggcatggtggcacacgcctgttatcgcagctaatcgggaggctgagacaggagaatggcttgaacacaggaggcagaggttgcagtgagctgagatagcaccattgcact

SEQ ID NO: 114023 - DNA, 432 bp, Homo sapiens
gaggattgcttgagcccaggaggttgagactgcaatgagctgtgattgagccttgcactcccacctgggtgacagagtgagaccctgcctcagaaataagaacaggatatgtctgaaatttcccaagttgagtatttcattgtacccttctcattgagccaagttcttttagctaagctttttaagacagtttgttgcacataaaagcagagaatcttgaggctctcacatctcatattcaaattgccatttaaaaatcgttcctttgctcctttgtttttattacttttccccttgcttgtgacattggtctttccttgaggaaattgactcctggttttactgcactagtggttcactctctctgcagaagcagcagagggcactactcagaggttttcctgctcctggaaaccgagacggtgccctccc

SEQ ID NO: 114024 - DNA, 438 bp, Homo sapiens
ctaacatttctatgccgtgtggtgtgaccagggcacacgctaagtgtattacctatagtgactaattaaatcctaacaaaacccatatgcattaggtactattgtattaaccccatttcacaggcaagtaaactggagcctgtagggacattaagcagcctgtccaaggtcacacaacaattaggtgacaaaaaacaggatttgccctcaggcagtctagctgcagaatccttttctttataattccacacacttgctcctctatctccaagtcaatcaacagaggtagtccaaccaacacttctcccttcctactcttttcacttttccactccccaagcaactctttctttttttaatattatatttattttagattcaagggtccgtgtgcctgtttgttacgtgggtatatcgtgtcatggtgggcttgggatc

SEQ ID NO: 114025 - DNA, 424 bp, Homo sapiens
tattggccaggctggtctcgaactcctgagttcaagtgatccgcctgcctcagcctcgcaaagtgctgggattataggcatgagccacagcacccagcctcagttttccttttatgttttctttatggcttaagaattatatctacatttcttttggctaaggtttaggctaaggttaaagattagctgtaatttgaatgaatcaaatctataaaaagtattctagatgctacataaacattctcattttcaaatcaaaagtaggagagaggaacataacagtgtattctaaaccctttcaatagaggggaggatatatttataaaactagcatatcccaaaatacaaaaagtaattaagaagttaacaaagtttagaaatgtagcatttggacctgggtggaccaaagaaacccaaaccctag

SEQ ID NO: 114026 - DNA, 500 bp, Homo sapiens
  misc_feature (7)..(7): n is a, c, g, or t
  misc_feature (64)..(64): n is a, c, g, or t
  misc_feature (66)..(66): n is a, c, g, or t
  misc_feature (68)..(68): n is a, c, g, or t
  misc_feature (485)..(485): n is a, c, g, or t
cccacangagttgggagctgaagttaggcattttggacaattgatgggggagctgagtctctananangccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaataatttcacagtcagaagagacttcaaggtcactagncaaaactgtcttagg

SEQ ID NO: 114027 - DNA, 159 bp, Homo sapiens
ccttatgccacagggggtgcagcaggaaaaaggaaaaaggggtctctgtgtgtgattaagcctgggtaggccctgtcacttacttcacctccatgcctcagtatcctcgtctgtaaaatgaggatgaacacctaaacaatgcctggcgtgctgtaggca

SEQ ID NO: 114028 - DNA, 630 bp, Homo sapiens
tcactggttatactgcaaatataataccaaactgtctgcccccaaatataataccaaactacatcatttagtatttgtccttagtaatagttgattgctccataccaccaattaaaagccagtttgctacacctgaaaccccatgagctaatatgagagacatatctcatcagatagtaagaggggaaaaaattaaaaggagtcaagacaatttctctgcaaagtcatgggaatgtgaattttttatattaacttattcttccccatggttttcttccccattacagttgcagtaatgccccatagaactaattgattcagatatgaaataaaaatcacacctaagaaatcaactaatctagatgtcatatgcccctataagtagttagtccactagaaaacaaatttgctctttcataaattactcctgtgctttttctgtacttctgagaataagaaaggaaaagcctttttagaaattattattatactgtagatttcacataaagaaataacaaaaaattattatagatggttttgatttgcaagtaacaaaatgaacaggtgggagaaggattttctgatttattttcatttgggaaatttagtcctataccactgaatttctaa

SEQ ID NO: 114029 - DNA, 319 bp, Homo sapiens
cttgacaattgatgtaatcatttatcaggtgaatcttttatccaagtaactggataataacaatttataggtgctaattgactttgaaggtggtcttttaaagctctggcatatttttaacttctttgaagtgtggaatttcagaaaaaaatacttattaatagacccaagtgataaacattcagaggcatacaccagtgtcttatgactttctaagaaataatttaggtgtgaaatattattcacaagtaaaactaggctttaagtagctggatttgggggaaagtgagggagatgttaaccctccaattaagtaaaa

SEQ ID NO: 114030 - DNA, 606 bp, Homo sapiens
ctctgccctctctgctaccccacaatggcccaatcgtctcccagaaagcacagtgtgggtgggggtagccccttctttggtttgaagataatttcagactgagacatccctttatgaaatggatgggctggcagagctgaggctgggagtcaagtgagtatttgtgagtgttagaagtggggagggggcattcaaagcacccctcctagaaatcaggcttggatgtaaggcttgtccttgctccccagccccccttttttctgatttcctacgtttaggtaggttatcttcctgacttaaaaaaattagttgtggaattgagtttgagatggaagaattcaccagcttaccccaacccacacacaaacacacatacacatataagtgtaaaaatacttatcacagtattttagaagctaggtcacctgcggtatacatgccactcccccaaatcataatttaacctgaaagccaaattctgggaagataagactataaagtgctgagactgggttcatacccaacactaataaaaaataaatgctttgtcttcacaccttttgtgtgtatgaaaaagagagggcgaaacatgatcactacaggatc

SEQ ID NO: 114031 - DNA, 432 bp, Homo sapiens
ggaggggactatgttagggcaatgaatttgcgaataatagcatgaaacagtctcttggttattctccatcaaatatgaccacatcatcagcacacaatgtccatcctcccttatctcttccatctacgcctagaaactgctctcttccctgtctagcacctgccaccactagactactgcagatctagttgttctagctcttctcatctttacacgcttgaagcattcctcttagatgagaagctcaacacacttccctttattctttgggaaacgtttttagcttaagtcaaattctcacccctaggaatgaaaaaaaattgactcccaaacctctgactttgtaacccttggacaccactgatttcctatcatttcaccccactgatgtacttgaactctgttccctgagaagggagagggcagaccctt

SEQ ID NO: 114032 - DNA, 389 bp, Homo sapiens
aagctgccagccacaggcacagggggagagggaggagggaagagcaggtgaggaggcccctgggttggggaatttgctaggttgtcaggggcattctgagaggcaagaggtagggtagtgtcagccccaactgtgttcaaggatacaggtgtaacctagagagacaaatgtggcacaagggtcaggagccagcttcctcccagggaggtaggagtctggcggtattggcggtggtgagacttgtccttagagcccccggcaagggggcccagggcaggcagatgtgtccaggagaacaggactggcagccacaaggactaaagagcctcatggatcagagcatccttccttcccactgctggaagggcaggaaatcagcagcaatgcat

SEQ ID NO: 114033 - DNA, 565 bp, Homo sapiens
cagtgcttttcatcgcatctactttcaactcccatgtgatcttagtctatcacatattcctctgttttcctctattttcagtcctctccacggtccttccctcatacccgaaaacatatttcaatctctctcatcttaggctctctcttgagattttatcttttctagccactgtcctacccagccaagttcttcaaaggaacagtactcaggtgctgactttactcctcacctccattcatgtttcagccatttgtgacttgggttttgtccccaccatcccatgaaaaatgccttccaaaaggtaagcaatagcctcgtagctacatatggatacttggtagtcattgggttaaccaatctactccattgaacatggttgaccacacttaaaattttattcttccttggcttttttgacactgttttctcctagttctcctctatctatatttttcactgattcttccttctccacattacctttagatagctagtgtttttcagggttttgttttttacatgctgtctctaggtggaatcaccacaatgatccccagatctc

SEQ ID NO: 114034 - DNA, 456 bp, Homo sapiens
gacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacaggtaaggtttggctaaaggatgaataagaccccctccttgtcttcaggagtttgtctagcagaggagtctgtcatgtaatcaggaaactccagtacacaacgtgatagctctaagacaggtatatacaagatgatgttctggaccttaact

SEQ ID NO: 114035 - DNA, 999 bp, Homo sapiens
gacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccagcttgaaataacacggtgctaagcatggatttttccaccgaatgaggaaattctaattctaattgttagtctctttatcaatgacgccaagtggcaaggaacatcaccatctttggagacctagtggtggagttaaactactacagggaaacaactttacgtatagaggagttgagcttcctagaggaaaagaaggaaaatcattcctaatggaagatcaactattcaagaaagaaagaagagcaatgagaaagaatgtctctgacggcacttcactgacagctgaatcaaggccaattctatgcctctgaggaatgcagagcatacttcaggctctcctgttgcacaacacccaagtgagcacccaagtggtggctctggaccaagaattggactgttacagctactgcctaccaacatagggtgttctgagagacaggttacagctactgcctatcaacacagggtgttctgagaaacagcaaagacacttcgtttctgaaaatggcgatctgagaactttagaaatgaacttgagaggaaaagatgaacct

SEQ ID NO: 114036 - DNA, 1491 bp, Homo sapiens
gacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacgtgctgttgatgaaactgctaaaggggctgaatgtgactgacgtctttggaaggatgagacttagcgtgcctgtacagttgtgtccaaatgctgtcctcatctcccaatgaaaagggtttttccttaagcctcacaacaatttacagcattgccagcagcattcagtacattcagaacaggataatttcacccgcagctgaactagggccatgcctgggacagacagagaatggccttccagcagacatgccaagaagcaagccaggtcagtgagtgaagaggagggcaggcccatttgaagcaacacagtttatgaacaaaacccatcagaagatgtcagaagataaggattttggtcctgatgctacacttaccagctgtccctcagtgttctacttcttaaaaaaagatggataaacagaggcaacccgaggataaaggccttgctcagtgtcacacatttcagtcactaaataagacacaatggatgccagtattctcatcccctcacaaataaagagccttcaagctctgcagtcaaacaagaactttggaatgatttcactggctgaaaaggcgattttttgggtagacaccaaaattaggagagaaattaaactggaacctgactggtggtgggtcccagtgactctaagcagtaccacaccagaaggaacacattacagttttcacgcaagacgacggggttctgacagaaaattaaatatagctcgtttattcaagtggctgtttccaaccccatgtaacttcgtgggcaaatattactcttccttcaggtagtactactactctccaggctaggtcacctactacatccattgaatacatacactcgggtgtatcatggtgtggagcctcttcctgtttggcattttatctcggccaagttgccctcgtatataacatatacgtaataagaggcccaattttggggtcatctgtcattggggcacgcattatgggcgtccgctgaaaccacatactgg

SEQ ID NO: 114037 - DNA, 1409 bp, Homo sapiens
gacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacgtgctgttgatgaaactgctaaaggggctgaatgtgactgacgtctttggaaggatgagacttagcgtgcctgtacagttgtgtccaaatgctgtcctcatctcccaatgaaaagctgaactagggccatgcctgggacagacagagaatggccttccagcagacatgccaagaagcaagccaggtcagtgagtgaagaggagggcaggcccatttgaagcaacacagtttatgaacaaaacccatcagaagatgtcagaagataaggattttggtcctgatgctacacttaccagctgtccctcagtgttctacttcttaaaaaaagatggataaacagaggcaacccgaggataaaggccttgctcagtgtcacacatttcagtcactaaataagacacaatggatgccagtattctcatcccctcacaaataaagagccttcaagctctgcagtcaaacaagaactttggaatgatttcactggctgaaaaggcgattttttgggtagacaccaaaattaggagagaaattaaactggaacctgactggtggtgggtcccagtgactctaagcagtaccacaccagaaggaacacattacagttttcacgcaagacgacggggttctgacagaaaattaaatatagctcgtttattcaagtggctgtttccaaccccatgtaacttcgtgggcaaatattactcttccttcaggtagtactactactctccaggctaggtcacctactacatccattgaatacatacactcgggtgtatcatggtgtggagcctcttcctgtttggcattttatctcggccaagttgccctcgtatataacatatacgtaataagaggcccaattttggggtcatctgtcattggggcacgcattatgggcgtccgctgaaaccacatactgg

SEQ ID NO: 114038 - DNA, 1187 bp, Homo sapiens
gacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacgtgctgttgatgaaactgctaaaggggctgaatgtgactgacgtctttggaaggatgagacttagcgtgcctgtacagttgtgtccaaatgctgtcctcatctcccaatgaaaagggtttttccttaagcctcacaacaatttacagcattgccagcagcattcagtacattcagaacaggataatttcacccgcagctgaactagggccatgcctgggacagacagagaatggccttccagcagacatgccaagaaagaagaaagaagcagagaaaggaagagaaaagaaattacggccagtgcggtggctcacgcctgtaatcctagcactttgggaggcctaagcgggctgatcacctgaggtcaggagttcgtaagccagcctggccaacatggtgaaaccctatctctactaaaaatacaaaaatcagcagggcatggtggtgcatgcctgtaatccaagctacctgggaggctgaggtaggagaatcgctggaacccgagaggcggaggctgcagtgagttgagatcatgtcactgcactccaggctgggcaacagagtgagactctgtctcagaaaaaaaaaaaagaaagaaagaaagaaagaaagttaccattagttttttgttgtatttgcaagcaaagacaaaagcaccaaggtacttgtttccttctgtaattagagtttcaaatagactaaa

SEQ ID NO: 114039 - DNA, 258 bp, Homo sapiens
tgtgcttttcccctaaggttgtgagcaaggcaaaaatgtacactgccaccatatgtattcaacattagaggtccttgccagtgcaataactaagaaaaacaaataaaaggcatacaaattgaagaataataaagtgtctttaatttcagataacatgctcatctacatggattatcaaaaacaaaacaaaacaaaacaaaactacaaagaagctactaaaagtaaaaagtgagttaaggaaggctgtactatacaaaa

SEQ ID NO: 114040 - DNA, 454 bp, Homo sapiens
ggttagtctattcttcttgaatttcatatgcctcttcctgggtgggggtgaggatgggattttatggagttgaggctagggcaggtagggagaaaacatgagaaagatgaagagataagccaagccagattcttcagcagaaaaatcaaggttgaaataccatgtttcaaaaatcagactgaggtgggagttgaggttaggggtccctaggccaggggattgaagcttcaaagagataaaactagagcaaaagcaagcacagagagtggcagagaggtccctgggcatttttccacagtccattctagtgctggcaatccacctttcatggccaggcaggtaagagtatttgtggggtgggagaaaggacagggccataggctgggcacacagccctttactggcccttatctctcctctcttctcctatacagtgctgtttccgaactgtaca

SEQ ID NO: 114041 - DNA, 400 bp, Homo sapiens
gccagggatgagtcaggcatgactcatcaatatccccagcccctggtacagtgcctggcccagttcctggaccactgtaaaataaattcctgttgaatacatttggagccaggaaaaaatatgtatcttattttaacagctgtcatcagacttcattttaggaaaggaatcaagtatgaggttgaatgagcccaaattgtggaaatgaccatgggatatttaggtatagtaatatgtaacattgagatttccttttctgagctaaaattattccatacctacaagatattcacaatgtgaatgccttatgtaaatggttggactggtgaatgttaagaaaaatggctgagttctgtaactgagttaatggggtgcagaacagggaagacacgagcaacaa

SEQ ID NO: 114042 - DNA, 2037 bp, Homo sapiens
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 114043 - DNA, 1973 bp, Homo sapiens
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 114044 - DNA, 1848 bp, Homo sapiens
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 114045 - DNA, 2062 bp, Homo sapiens
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagaggtggtggtgtttgttgtctctgaagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 114046 - DNA, 1967 bp, Homo sapiens
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagaggtgggtaggaggttgaggaggatcctgagcacctgagcgcttccttttcaggaaaggatgctctgcttttctgtcaacggagtgttcaaggaaggtggtggtgtttgttgtctctgaagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 114047 - DNA, 584 bp, Homo sapiens
tggtgcgcatgcctgtcccagctactcaggaggctgaggttgggggattgctggagcccaggaggtcaaggctgcagtgagctgtgactgcgccactgcattctagcccaggcaacagaatgagaccctgtctcaaaaaacaaacccaaaaaccttacgtgaaacagttcaaaattacttacttcctaagttttcacaagaaatcagggttaacaattctgcatatggggtttataaagaaaagcaagatacttttttggtaaggaaagtggtaaaggcataaaaaggtgtgtggccaggccgcggtggttcacgcttgtaatcccagcactttgggaggctgaggcaggtgaatcacctgaggtcaggagttcaagacaagcctggccagcgtggtgaaaccccatctctactaaaaatacaaaaattagcagggtgtggtggtgcaggtctgtaaacccagctactcaggaaactgaggcagaagaatctgttgaacctgggaggcagaggttgcagtgagccgagatcgcgccactgcactccagcctggggaacagagcaagattccgtctcaaaaaaaa

SEQ ID NO: 114048 - DNA, 249 bp, Homo sapiens
tcttgattccagatgggactgggaagtcatccccatgaatggaaacgcaattaacagaccttactagcagggttatagcattttcatattttataatgtcacaacactgaagtgtactactttttagtttaatactgaatttttaaagcactcatcaatgtccgttatgtgcttgatgtaagtctccttttagttcaaagcagttaatgacattttgtcaattcgccattttctatagcctgaaatgca

SEQ ID NO: 114049 - DNA, 820 bp, Homo sapiens
gcgggttagttgttagttttccatttttaaagatttgcctaaggccagagaaacagaaaataaagaagcatgatgtagaatctgtttctccatatttataatttggatattttcttcaacacctcactataaccagcttagtacccctcctcccaacttactgcattaccagggatcactctgtagtaaatcactaaatcacttccttactaagttgtgcagttctaaaagcagagtatttttttttctcataaacaaaaaatccagtttttaagttgagattttcgttggttcccaggaaggatggaatgaatacaatattaagcattgatttagaaggatgaatgtcagctgaaatttaagaaacccctttgtaaataacccaggtctctataggagggtcgtagatagcattttatgtctttctgacctccaacctgaagtgaaacataaggcattgtgctcatgacttttgatctctccaagtctgacattcgaatcgattaccacaggaagctataaaatatttttctctagaggtattgcaaactaaggtaagaatttcagaagggaccaggctacaacttgaggatgaactgaatgacctcttgatattttctaagcatgaaaatgatttagtagcaaggtgtacaggtcttaagtgtacccagtgcaagcctcagaagtgacttgtctcaattcacaacttgtcttgatcttttgcagaacctaaaatttttccaaatgtgagtctggatggaacatgaggtagtgcagaatgattgaggaaagtctaacttataagtcaaatctataataa

SEQ ID NO: 114050 - DNA, 346 bp, Homo sapiens
gtgagggacacagtatgtgcacaacaaactctaagacttttaaacactttcaattatttttaaaaagtggggtaggagacaagtttctacccaatttttagtaataacatataagaaggggaaagcttttgaatttttaaaacttcagtattttaaaataatgcagtcactctcacacacaaattagtccatggtctttgataaagcaagacattaggtgtaattttgcttcaaatttaatacccacactcgttgacactgttggaaacactgaggctggcggtgggagggtgcaaagcacttgcttaggaaccagctgagaaatcctcactgatttctcagggag

SEQ ID NO: 114051 - DNA, 482 bp, Homo sapiens
cacgagggtccgcggcttcattgttgaagtcagtgagaccaagaacccaccaattccggacacaatattgaacatctgttacatttcagttttaaaaaagtttttgaagtttaggaattgttatcacatcagttttctgtgtaaatggttttgattggaattaaatttaaaataaattattgtgcttttttgcggtagttcctctaacatgggtaaatacgaccaaggcaagtatattctactgtggttgaagtaatgctgaagctgcagtttaaaaacattgtgaagaatgagaacaattattgcatgtggccgaggtattgaaggagttaaacctgtaccactctggcattattgacaattttgaattaaaggtacttaaaaaaacagcaggtgcaagaagatcattgtgacctcttttctacttcttaaaagcggaagatgaaattcctatgtgaaagacactttccctgtggaaagga

SEQ ID NO: 114052 - DNA, 1599 bp, Homo sapiens
ttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacttgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctccctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaag

SEQ ID NO: 114053 - DNA, 715 bp, Homo sapiens
  misc_feature (1)..(1): n is a, c, g, or t
  misc_feature (8)..(8): n is a, c, g, or t
  misc_feature (12)..(12): n is a, c, g, or t
  misc_feature (24)..(24): n is a, c, g, or t
  misc_feature (33)..(34): n is a, c, g, or t
  misc_feature (128)..(128): n is a, c, g, or t
nctagggncacnagacccaaactntttctgaannctaggagctgaggtggaggtctcgagaaagatctgtttagtgaaatgggatttaccctcggtgttgcatttgtgcatggatcacctctgtgacnggcgaatcaccctgatgagatgaagaactctaagtggattgagggaggcctttgactcatcccagccccacattggatattggacattatgttgttaagtgtttagattttgttttgttcccttaaagagtgttggattttttttaaacaggctcctgtatcacctgcaaattattttggtccattaaaccttgttattaagctttaaaggataggccaaaaagagtctttattctggcttttattcagccatacaactaaggcattagccttttggaatctccatcagtctctgcaaaaccatttgaaaatggacaatatttggacatttatggaattacaagggaccaggctggggaatatgaatgcagtgcggaaaatgatgtgtcattcccagatgtgaggaaagtaaaagttgttgtcaactgtaagtgtcatcaccttttatcaagataagttctgagaaaagataaaacaccttgaaaaattctgactgaaatttatgttgctgtttttaagaggttgtctattggtaaaaatcacctactaacactgaagacgtgtagatgttgaaatgttggttaaat

SEQ ID NO: 114054 - DNA, 1896 bp, Homo sapiens
  misc_feature (1)..(1): n is a, c, g, or t
  misc_feature (8)..(8): n is a, c, g, or t
  misc_feature (12)..(12): n is a, c, g, or t
  misc_feature (24)..(24): n is a, c, g, or t
  misc_feature (33)..(34): n is a, c, g, or t
  misc_feature (128)..(128): n is a, c, g, or t
nctagggncacnagacccaaactntttctgaannctaggagctgaggtggaggtctcgagaaagatctgtttagtgaaatgggatttaccctcggtgttgcatttgtgcatggatcacctctgtgacnggcgaatcaccctgatgagatgaagaactctaagtggattgagggaggcctttgactcatcccagccccacattggatattggacattatgttgttaagtgtttagattttgttttgttcccttaaagagtgttggattttttttaaacaggctcctgtatcacctgcaaattattttggtccattaaaccttgttattaagctttaaaggataggccaaaaagagtctttattctggcttttattcagccatacaactaaggcattagccttttggaatctccatcagtctctgcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacttgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctccctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaag

SEQ ID NO: 114055 - DNA, 1181 bp, Homo sapiens
atataggcatatacagaaaaagagagaagaaagaccagtagaatgattaaaataagaaaacaagaatccctcagccagagtcccatccagaatctttaataaagcatggtaagctccaagtacagcccagtatggaattaccgggagcgctgatgttcttttctcctgctggtaccttgtgttgacactgtcctctttcaccagcatattctccctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaag

SEQ ID NO: 114056 - DNA, 653 bp, Homo sapiens
agtatcccgtggttactgcttgacgttcccgtgaagacatcgccctgcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccagtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagctccaagtacagcccagtatggaattaccgggagcgctgatgttcttttctcctgctggtaccttgtgttgacactgtcctctttcaccagcatattctccctgaagaatgccattctacaataaattcaaagaccc

SEQ ID NO: 114057 - DNA, 333 bp, Homo sapiens
ccgtgaagacatcgccctgcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtaggaagaacggcgtgcttttcgtacttgtttcggtctatctttctgtctctctttgaaccctctttgccttcttta

SEQ ID NO: 114058 - DNA, 1584 bp, Homo sapiens
agtatcccgtggttactgcttgacgttcccgtgaagacatcgccctgcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccagtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagctccaagtacagcccagtatggaattaccgggagcgctgatgttcttttctcctgctggtaccttgtgttgacactgtcctctttcaccagcatattctccctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaag

SEQ ID NO: 114059 - DNA, 768 bp, Homo sapiens
agtatcccgtggttactgcttgacgttcccgtgaagacatcgccctgcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccagtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaaggtatgtattttcagaactgctatattgtgaaagactgtgcttagaaatatttaatatttaggtatcaaaatgactaggaagcagttaacaatgttgaaatatttgttgtcattgaaatatttgttgaattatattgtcatagttttcaggaatttacattcctagacatcagaaagtcattaagagtcatacagacagaatgaaaaagtcttttgactggctttcagttgaaacacacacgcgcacacacat

SEQ ID NO: 114060 - DNA, 145 bp, Homo sapiens
ctcaaaaaaaaagaagaaagaaacaggagtgaaaagttgagatgaccatgtgaagccagccaacctgaacaaaatgtaacttttgaatgataaggcacagctgagcggcccagactttgaattttctccaaatatcatgatcttc

SEQ ID NO: 114061 - DNA, 318 bp, Homo sapiens
tttttttagtagagacggggtttcaccgtgttagccaggatggtctcgatctcctgacctcgtgatccgcccacctcggcctcccaaagtgctgggattacaggcgtgagccacctcacccggccctaaaagaagattctaaagggatttgcttcaaattcacacctaatgaggattctccctgttttacactagaggaagcagagacacagagaggttttatggcttgctcaagctcacacagcaagtccgctgcagagctggaattccacccaggcagcctggccggaagcccaggcctttcacccctatgctaca

SEQ ID NO: 114062 - DNA, 503 bp, Homo sapiens
ggaaggccttgcagatggatgggccttggtcacaaaagcaacaggtaagagagtggctgtggacacagggtggtttatagatttgctgaggagtcaaggtgatttcccagctgataactcgaggggcagcatagcagagctaagtgaggctctgctcctttcggctgtcacaaggtccttctcggtggaaaataagggtgaggatgtagtaacaggaccactgcacgggtgtgctgtgaatgagttaacgtgcatcaagcatcaagaacagtgccagaatgtagtgggctcacatgtaaatagtcatcagtattgtgagttctgtgttctccatagaatggaaggtgaggtcatataaaggtaggtaaatcggaggtatgtggaaaatgcagactatatgacaggaacatggggagtgagaaacaataggctgccaggtatgctggccagagggcatgaccttaccatgcgcctgggccctgttcttggtgattctgtgcacc

SEQ ID NO: 114063 - DNA, 419 bp, Homo sapiens
accaggtcaagctcaccccaaactattaccttcgatgcatgtcttgtcataccctgtggagatctccaaagtcaaaagcaactctcagactcagagaagtatctctgcccctttaagataaaaggctccccctatcaagacccttgttccttaacgaatgcaggaaaacaggtctgccatagctggaatgatgttgtgtggacaactgaatatcaaggctggacctcgtcaaccggtggttgtatgtccttaaaaccatacattcacttcactaaagaaagtaccccccataattgccagtataaccaatgtaatccagtgcaaatttctattctcattccaacttctactgaccctaaacctactttaagttgcttatatggcatgggagccgaaatagcaggggcacatcttattgg

SEQ ID NO: 114064 - DNA, 778 bp, Homo sapiens
aatagtttcctcatctgtgaaatggggattataatggggtcgtttttcatagtaagtaagatgagccatggaaaagcacaatgccttgtgcagaatgagaatatttttatattataatattactatttattttatcgacaagtgtttaattagcacccattagggactgggcactattcttagctctggggaaaatagcagtgaacaaaatggacacaaatgtagaccttgtggaacttacgcttcagtgttgggaggagacattcagatgacaagtaaatatcacctggaatcccagttacttgggaggctggggcagaaggatcacctgagccagagttcaagaccagcctgggcaacatagcaagattcccatccctaaaaataccacacacacactaaggaaaatgtgttatctgttaagtggtaaaagtgctgtggagaaaatgaaagcagggaggggtgcctagatggtggtataatttaaagtgaggggtcaggatgggtttgcagaggaggtgatatttgagtaaagacctcaaaagggtagagaagggctccatggggatacagctggaaaagagctttggaagctgagctcatgtggaagccaaaggggagtgaaccagggttgttggaaaaccctggggccaggggtgaggccacaaggggccctgggcatgacatttagggaggtgcttgctttccagtacccactgcactcacgggtctctgagcacaggtgtgaaggagggaagagtaatgagaagagaaggtg

SEQ ID NO: 114065 - DNA, 369 bp, Homo sapiens
agacaaatgtatattaaacagtttgttgaaatgctttccaaagatcataaacaaaagcagcctgtttgtagcatagctcctggtgcttccctgggcatacacaaacagcactatttagaactggtcttcttggagctggcccctgccaccactgctcctgaagcttacatctgtagaaacctgcacatttccctgcaggttctctgatactgtatcttgaactagagcaccagtcagttcagttgcaggttttgagaacattttagctgccatcatggtagggctaagtgttcataataataaattttgcttccttcaagaaaccagtttgcagacggatgacagcagtgatcaaagtcactttagttt

SEQ ID NO: 114066 - DNA, 707 bp, Homo sapiens
cacccttcgtctcaagatgctgtaataaaggagttggctgagggttcagtttaatctcaaggatccagtttctgcagtttgacctcaaggactgcactttcagcagaggacctagctaggcagtgctcaaactcctgacccacaaaaataatgaatgtgacataaataagggtgtgttgcttacagccactatatttgtaggcattttttacacaacaatatatatctaatacagaagtattacagggttttagcagagagtcatccgtgttttaattacatagtgaattaatcactctggttgcattttgcactataagctctatgtggaagacaggagatcaactggagctctgatgcaagaatttgaaagtggcttacaataattcatagaagagcagtgcaagtgtctagaaatggctaaattctagatggatttgaaggaggagctgaaaggatttaggaatatattaaattatatgtgtgtgaggaagtgaggaatcaaatttttagtgcataggtaagtagaaagatgacagttgttattagcagagatggatgaattataaagagagcacacgcaaagagcagcatggtagattaaaattctagtatttaacatattaagttttattctttttctttaggtgtctagtggagaagtcaagtagctaggcagatatacatgcctagaattcagaagaaaa

SEQ ID NO: 114067 - DNA, 218 bp, Homo sapiens
gtcgcccctctctgggcacatcactggagaacttagagttctccaaactccctgctgcatagggatattgagtcatttgtttagactgctcagagcctgctattgggaaccccaggctggagaaagcacacagcaagaactggccaccataggtccagctctgagctttatttccagggaggagcctacctggctatattcagagaggggcggagcag

SEQ ID NO: 114068 - DNA, 735 bp, Homo sapiens
tagagacaaggtttcaccgtgttagccaggatggtctcgatctcctgaccttgtgatccacctacctcggcctcccaaagtgctgggattacaggcgtgagccaccgtgcccggcctgaaatatattcttatatttaatttaaattttgttctttgagtcttttcatcaatttgaaatttttgtaaatagcaaagaatctggttttgctttctcctggattgagagagagttattcaagtacattttcccactgaactaaatgccagctttgccttatattaaattctcaacatacctggacctatttccataccttgttctgcccacccctgtggctgcccccctgttacacttgactcagtggtttcacagggtctcaccctcaccttctattgctatgcttttcctttttttgtgtgtgctgtttttgaatatttattttgccatctaaaccttaaaattataattctgagtggaattggaatggatttttatttaattttaaaaataatttgcatttataatattgttcttctatccaagaacattatgtatgcctctccacatattcagattctgttcagattttaagcatggaaaaaagaaactcattttttacttatttatcttttatccagtgaactacataaattctcttattagtcatttgcttaatgactaagagaatcacttggatatctaagtatacaatagtatcatctgaaataattgta

SEQ ID NO: 114069 - DNA, 523 bp, Homo sapiens
aacagaaggaggcaacgcaatgttccagttctgaggctgagactcaagaagcggaacatggctctgccctcctttggaaacacggctggaacacttgggcttggccagaacaagcccaagtgagcctgtggggtgatgagaggcacgtggtcctggtgccccattcacagaggctgatccagtctgccaacctccaagaaccaagcatagccacatgagagaagaaccggccagctgagccagccagattgcctcctcaggtagatggtggtcgttgcatgccccagttctggggtggtttggacacagcagtaaagaagggacagagaaacagaagccggtgtctggtggtattgtcctccctctgttctggcttttccttgaatgtctgggcaatggcctctgagcttgaatgtcataactggagcttcccagccatcaagcaactatgagggtgaacacagacatcttgttctatagggcagataaactctgtttgtttatgcctggttttctgttactt

SEQ ID NO: 114070 - DNA, 335 bp, Homo sapiens
aacttctggccttaagcaatctgcccacctcggcctcccaaggtgctgataaacattttactgagcatgtacaatatgccagccacagggaatctacatgtgtacatcatacctgtgtgatgtacctctagaagtttgtagtctagaggaggcctgacatcccagcagcttctatggtggctaatgtaagaagccccacaaaagagggggatgattcattgtctacagaaatcagggaattcttcacagcagagtccaccctccagtggggtctgaaagagtgagtaagagatctctgcacagacgagatggagaaggaggcagtgttacttact

SEQ ID NO: 114071 - DNA, 309 bp, Homo sapiens
aggctctgacccaggccacagcgcggacacacctcgggaacgccatgctcagtgagagacgccagacacacgaggccacgcagcgtgtgatcccattgctatgaaatgtccaggacaggccgatccacagagacagggaggggatgcgtgggtgccggggctggggaggggacggggagtggctgtgatggggacggggtgttttgatggggtaatgagaatgttcggaactagacagtggtgatcgtgtgactctgtgaagagcctaaagtctcaaactgtacattatatctcacatacgcacgtgta

SEQ ID NO: 114072 - DNA, 922 bp, Homo sapiens
ctctctgggggtgattctgctctggagaacctctggtctggatatacctttattgtgacattgatttgtattgttttgctctactgacaggccttttccaatccatacaagctgaacttgcttcctaatgtttgtctaggccttacatggatagtaaggaagcttaggagacatgtacacaaggcagcccacttgtaggaaactgcttcaggtgaggacatcattcaccagtggatcaccgagcaccgtgacagcaccctcagtccacgtctgcagattaagagctgaactctcacagagaaagtggaagtagagaaagggttaattcaaactgctagaaaagctaaaagtaaattttaaaatgctgagctgcccatattcatgctaggatgagagccggcttaaatgcttgctgggcattttggtatttaccacttagcatgttttcaacttctgtgagggattttccccccaatctccctaatgtaaacacagatttctcagcaagtcatttctcaagccatgtcatttctagtgtaaaataaattataataatgtgtcatctgaatggtgttcttgtctgcaaacattagttatcctttgctaacagattctgagatgagagtctatcagtttggagccaatgtttagttttttttaaaaaaagttaaaaatacaactttttctctgatcaacaaagacctaaaaattcatcagtggcagaaaaaagttccaaggagctcctgtagactggggaggcctttcttcccagatagatccatctcctcaagcagcttgatttctttctagaatttttttcacttaaaaaacttctaatttttggttgataacaatttccatttttataaatgcagttatgctaacagaatgttatcctgacagttattaaacattagaagat

SEQ ID NO: 114073 - DNA, 429 bp, Homo sapiens
gataaagctgtaattagtatgctgtgttagcaggcaaatgaatatgagctgaagctctttggttatttaacagtgtgatgcagagtttcaatatattaaatttttctcaaaaggaaagtttgtaattttatataatgttcattccttgattcaataaccacttatgatgcactttctatatgtatggactgcatatgttatataaccaaaaactatattataatacatgaaatagcaagtctagagaaaaacatcattgtataataatagtaattgcatgcatgttttggaaaacattcaccagttttgccattcaggtataaatacgggatatttggggcatgtgcatgttatcatcatccctagctgtgtatggaactgtttctcaaacaatgcaacagtgactccttaatatattgtgtgaaccat

SEQ ID NO: 114074 - DNA, 534 bp, Homo sapiens
gcctcccaaagtgctgggattacaggtgtgagccactacacccggccttcttttttttaaattttattttactttagttctgggatacatgtgcagaacgcgcaggcttgttacatagggatacacgtgccatggtggtttgctgcacctattgacctgccctctaagttccctccccttgcctcccaccccccaacaccatatttatttttaacaaaagaaaatagaccaggcgcagtggctcacgcctgtaatctcagcactttgcgaggccaaggtgggcagatcacaaggtcaagagatcgagaccatcctggctaacacagtgaaaccccgtctctactaaatatacaaaaaaaaaaaattagccgggcatggtggcaggtgcctgtagtctcagctactcaggagactgaggcaggagaatggcgtgaacccgggaggcggaggttgcagtgagccaagatcgcaccactgcactctagccagggcgacagagtgagagtccgtctcaaaaaaaaaaaaaaagaaagg

SEQ ID NO: 114075 - DNA, 320 bp, Homo sapiens
aagtttgacccacagaaggaggaggtgataaggccttaggggcctaacactgccagattgtctatgcataccaaaaaggaaggacgacttccacgtttattttcttctttggaaattatagatttcagtttcaaacaaatggaacaccccctaattagcatggaccaaatttatcttcattttctctttgtggaggctaaagcaactccatcttggatgctaatccactgtgttgacttctgattaactccagttctaggaatgcctctaaggttactacttaatctactcttaagagcatgtacttgccgtaaatcctg

SEQ ID NO: 114076 - DNA, 725 bp, Homo sapiens
tggtcgtgaactcctgggttcaagtgattttttccaccttggtctcccagagtcctgggattacaggcatgagtctgaccaaaaagtttatttttgagggactggagagagatggagaaaactaaagaagagaggatgagtttgatttttatcatttcaagaaatgttgaacaattttctatgtgagtgaagagaggaggcatcagagatttgaaaagaatggagaatgtttgcaacctaagaaaataaaaaagtgtgaatattcaaatttgagaattgccagaggtaggaataactttgttattgtaggcaaaaaaattaatcagtaagccagggaagcaaacccatcaaaattgattgaagtttattttaacaatttttgtagcttctttttagaatcagatattatcaaacaagacaaaaatcacattttattcccttgtgtgctcatgttcaagaccaaacactttaagacatctcagaggtctgcaaagtcaaaatgatgatgatgaaaagtaataccataatcatttatggtatttgtgttaacatccaacagattcatgattgctattatatggatccatacctcttaaaaaatgtttcaagtttaatttctaatataatacatttcaatagttatacatgaacaacagctctccagggtccctaataagtcccaataaagaaaaggagtatagaggtgttttttttttgttctttct

SEQ ID NO: 114077 - DNA, 703 bp, Homo sapiens
gtttataagaaaccacgagaccgttttttcaaagtattattaccattttacctactttccaacaatgtgtgagagttcctgtttcatatccttggtaatatttgacgttgtcaatctttttaattttaggcattcagatgggtatgtagtggcatttttaaattttatttagagtttccatgataatcctaatggtgttgagtgtcctctcatgtatgtataagccatttatttcttcttatggcaagtgtctattcagatattttgccatttttggtgaattatctttttttattattgaattgtagatatctatatacttgtgtatatttttattatttttttaaaatctagcaggtaaccttatgcttaatacatattcattttattaccgctagaaactgggtcctggcaaaagttttttttttttaattatactttaatttctgggataaatgtgcagaacatacaggttacgtaggtatacatgtgccatgctgcacccatcaacccgtcatctacattaggtagttctcctaatgctatccctcctctatccccctaaccccaacaggccccggtgtgtgatgtttccttccctgtgtccacgtgttctcattgttcacctcccacttatgagtgagaacatgtggtgtttggttttctgttcctgtgttagtttgcagagaatgacggtttccag

SEQ ID NO: 114078 - DNA, 269 bp, Homo sapiens
  misc_feature (93)..(93): n is a, c, g, or t
tacaagcctggcaatgtggcgaaaccccatttctacaaaaaattagctgggcgcacagctgtagtcccagctctttggaaggctgaggtgggnaggatcatctgagcccaggatgttgagcctgtagtgagccgtgaaggcacgagaccctgtttcaaaaatatgtatattttaaacttagattgtagtagtagttgcatagctataatattactctatgagtattctaaagacttattaaattgtacactttaagtgggtgaattttg

SEQ ID NO: 114079 - DNA, 427 bp, Homo sapiens
tctcgctattcatcggcaccctagttctcaggatgagttactatctttgccagggagagatggtaaatcatgggaatggggcagggcacagccctagggcctcagagaagccacaggagtttgatgggaaggaggcagtaggcccctgggaaaagtgctcttcacttcctctccttttgcagtttggttttccaaggcctctgtctctgagggctcatggacacaagacctaaggatatctaccaaaagcaggtacctctgtccttttaattccaggggaacagggcccagagaaaaactcacggtagatattaaggaaaaggaaaatgcaatacagcccatctttatgttggagttaaacttgatgccccagggtattgttcccaaagacagatatttacatagatatctcatgtgcagatgaatg

SEQ ID NO: 114080 - DNA, 160 bp, Homo sapiens
tgctgagactacaggtgtgagccaccatgcttggcctgtaactgcttttgaggaaggctcctttatccttgggcccactggggtattccagagctttctgtctgtgtggatgagtggggtaagaactggcattaaaggtggaagagcaggtggtggcacc

SEQ ID NO: 114081 - DNA, 383 bp, Homo sapiens
tgctgagactacaggtgtgagccaccatgcttggcctgtaactgcttttgaggaaggctcctttatccttgggcccactggggtattcagagatggggttggctttagccttctatgctactagctgagcaccccactgcatagccaccacctggccttggcctgggacagagcagcagtggggaggggcctttgtgcatctctgctcctacagctcagggctgggagtggcttacactggggaatatgtgatccctgagcctgggtagtggctactttgtcagggtgcttgtccaacctttgtccccttccagagctttctgtctgtgtggatgagtggggtaagaactggcattaaaggtggaagagcaggtggtggcacc

SEQ ID NO: 114082 - DNA, 447 bp, Homo sapiens
acccacccttccaagcaggatctggatcatctggaaccctactcctcaagccactgcctatttgccatgaggggccagccctgacccctccctgtactgcagaccctcagatactgggctggccttgcattggccattctcctttctgttttgagtgaggcctgaagcccgaggtctgacaccaacctcctgcatgctgcctgtcccctgcctgggactcactgttcactgcaacacaggtgaaaccacaatcctgtctcccggagttgcctctcagttggcctggtgtgtcattctgggaaatgggacctatgaggaaatgcttggagacgtgttgggtgggtcattagtggtgtgcaagatcccaggtctgtgtgtgggaaggctcgttgctcccgatatgcggtgcctgtggccaacctggagcccttgtcctcatcctgctgg

SEQ ID NO: 114083 - DNA, 5645 bp, Homo sapiens
  misc_feature (4257)..(4257): n is a, c, g, or t
ccgaggaggacgtgactcggagctgcctccgctttctccaagccatattcctttaagatgatgtaatagtcatttccctggatggtttcttgcctgcactgctgaaacaacagcatccgaactgcactgggaactgtggaaccacccagctccgccgccagagaagccggagccccgggccccccgccggcatctctgcgctgcgttggcctctggctcgcaccggctcccacctggctgggaacatgggagtccgtttgcccttgccggcaggtggggtggctacctgggaccctagcagggcacatctctccatctttctgcttctgggctttctgaaaagcttctaagtcctggtacctcttgcaactctcttctaaggatcctttccaaagatttctttttccatttttcttttcccctggggaagctttggttgaatattttctctgctttacttcttcaacccaacctcctctcatcagggcttaactttttttgcgacttgttttaacttaagatacggaatgaacacatatgtacctacatacatacataaatacaaataggcatttatataaatgcatatatataatagttattttccaagagcacacctctctggcacttttcattgatacctcggtcgtttacctgtttgggatttgacaagatccagactcagtttggctgtggattttgattgctttacaaatggttattattatttttttcacaagaactgggtctccagcactcactaagacggacatctgagtaactggggaattggcctgccttgcatgtgagcttgatggaagattggatatagacgagttgattatattttatgaagtagcagctcactaccatccaccatccagggtttaaactactttttcagcatcacttcacctgtggactcttatacattttgatttcttgggggaaaaatactgggataagaggaggtcattttttaataagttagcatccttttccctttcttacaagttgatccaaaggataaggctgtgactccattggattgcacctttaaatcaaaatagcagcagcagaagaaagggacaatggctctgagtggaaactgtagtcgttattatcctcgagaacaagggtccgcagttcccaactccttccctgaggtggtagagctgaatgtcgggggtcaagtttattttactcgccattccacattgataagcatccctcattccctcctgtggaaaatgttttccccaaagagagacacggctaatgatctagccaaggactccaagggaaggtttttcattgacagagatggattcttgttccgttatattctggactatctcagggacaggcaggtggtcctgcctgatcactttccagaaaaaggaagactgaaaagggaagctgaatacttccagctcccagacttggtcaaactcctgacccccgatgaaatcaagcaaagcccagatgaattctgccacagtgactttgaagatgcctcccaaggaagcgacacaagaatctgccccccttcctccctgctccctgccgaccgcaagtggggtttcattactgtgggttacagaggatcctgcaccttgggcagagagggacaggcagatgccaagtttcggagagttccccggattttggtttgtggaaggatttccttggcaaaagaagtctttggagaaactttgaatgaaagcagagaccctgatcgagccccagaaagatacacctccagattttatctcaaattcaagcacctggaaagggcttttgatatgttgtcagagtgtggattccacatggtggcctgtaactcatcggtgacagcatctttcatcaaccaatatacagatgacaagatctggtcaagctacactgaatatgtcttctaccgtgagccttccagatggtcaccctcacactgcgattgctgctgcaagaatggcaaaggtgacaaagaaggggagagcggcacgtcttgcaatgacctctccacatctagctgcgacagccagtctgaggccagctctccccaggagacggtcatctgtggtcccgtgacacgccagaccaacatccagactctggaccgtcccatcaagaagggccctgtccagctgatccaacagtcagagatgcggcggaaaagcgacttactccggactctgacttcaggctccagggaatcgaacatgagcagcaaaaaaaaagctgttaaagaaaagctctcaattgaggaggagctggagaaatgtatccaggatttcctaaaaatcaaaattccagatcggtttcctgagagaaaacatccttggcaatctgaacttttaaggaagtatcatctataagggagggctgggggcgggaaaagaaaaaaaaaagtcattttgaaattaacctcctaaaaggaattcatattttaaaggaaaaaaatacaactaatgatgcacatttcttagaacacaatagtccattgatatactactgcctactttacctagttcaccttaacatgtaaatccacagggtagatttctttctagatgtggaagtacaagaaaatcttttttagttatttgtttgtttacttcgtcccatgtgctaactatcttatatataatgagagccagctacgtaaaagtagctgagaggccttgggagtcatttatcccaaactgggttttttctctcatccttctacctccctcctttgaatgagggtatggtagaaaaagatctggcccaatggcataagtttggaatttttaattttggtttttccttttgtttatggggttggggggaatggcagatttatatgacttttcactcaaatctatatgtgccagtttatattgactccgtatgcatgagtatttgtgcaacacaagcacaactaagtatgtatatacacatgacgcacacgatgccagggcctagacctcccaagggctgtgctcctgctcccagcagccctctcttagaatatttcagatggatgagcttctgactctttcttaaaattcttttgggaagatttcccagcctttcttcacaacactttctaacatcaaatgactctcatcatcaacaaattgtattccttattgtgaaattaataccctcaggctccattttactgctttgctctttgtctgcattaagagaggatgaggagagctggtcaaacattccttgtgttaaaaaaatcaaacattcatatccacaaaattttctgctaaatgactccacactcagccttctctaccctgaattgaattatcacccttttctccatgttttcagagttcttactgcccacagtttaatggtgtggcctttccacataatccacattaagttctgtgttcctgtgttgttgtggaactaaggacaacacacagtacttgaataagggtccggccttttgtttgttttagagaaagttgtattccacacacaacctaataatttcttataaaaattttaaactacaaagctacatttttacttgcttgtagccgtttttgtttgcctttgggattcgggctttggctgtgcccatgctaggatttagctgtgtcatttttatgatgtctgtaacaacccaacaaggtaactgaagctccagagttaaggtttcagatttctaaatgaaactatctttttcaattacatcctgacttgtatagacacagccagaaagaaactgttaatagccatccgtccatgtaactctgtattttactaagataccaatagctctttcatagacttgtgctacaagaaggttaaaagaccagttttattttcagcattcctcatgcatttcagtggtaaccaaaaaataatttgtcaattaatagttgtgtgccaagcactcctaatttgttttattgcgtgtgtgtgcatgtgtgtatgtgtatcacaggtaataaaggcaattggatgatatctgtaggaggaaaacaatgactaatttcttccttttgaaatctttcattgatgcacatttattatgtaagatgttctgtcttgatttctgttcttagtgatgattagtatatgaatatctttctgaatttttgtaattctcgccttcacactaggatgacagactcagctaatgtttccttgtcctgaaggtttgaatggagttgaaagttttacataagtgaaaaagaaagtttatcttgggagttgagttgtcaagagaattataatttntgaatttaagtggtattcttttctgtattaatatattagcagatatttgatcttaactacaacatagctttgtttgtaaacttaccagtatgtcttcattcttttcaatgtttcttgatagcacatggcaataccatcatcctaataacagaagatcttgcaaagaatcacagagcttaatgggtcaagaagttgaatttggggaaaatatcctgaaactcactttggtcaaatgattattgtgttgtcactggaagtactgtcaaagactttgggggtctaactaaaatggccaaagttccaacttccttaaatttcagacctgactgtaatggcctcaagatagagagatacccttgtaagagtaaagaattaagatgatagtcaacccaatatttctactacattctttaaacaggaaattaaacactgcaaaaggagtgttcgtggcagtgttcctctgacccctgacctgtcatgagttttctctgctctgacattccttatacatccagtgaacaaagctggaatagaaaacctgtttaaaaccatcacaacagcaatatttttattctgggccacctctcgactggcactcatcccatggtaaaatattcaagtaactaagacaacagcatggcatttatttgtgtgagtgtttatatagaaatgaacatagacctggccagtaaaaggctgtgaggaggcttaaagtacctagtttgagtggagttatcaagtgaggtccaggtagcctgcaacactggaaatgagttctgggtaagtgagttataagagtacatgctctagtaactctggtagtcactgtgactcgggcatgtttccctgaagttaaaatagtttttagaactttttgtttaattctgaagaaaacaatatatatggtttacttctcgaacattggttatgacaagggccataaattgctaatataaagaagttagtagtatcgagtggatacaatgaatggggaatcacatgtgtagagccccaacttagattgccttctgggaaatcccgcgatactaaaatccagtgagctttgggagatcattccctaaaggtatgtgggttgtctgaagtcagaaacatatttacaaagtccttctacccactatcaaaaatgaactgatctgcattcagcaggaaaaggggaagacaggaatgtaaaactactagatcatatggtattgtgattttctttcccctgctaggaaaaaattgcactgaaatgctgacaaaaaataatgaaatgaagtggcttccaaaatatgcactgatgttatcctttgtatttataggcacagttatcttactgaaaatgcatgcatggtgaattaaaataaaagggggaacaatgcacaaat

SEQ ID NO: 114084 - DNA, 387 bp, Homo sapiens
aggctaacaatatgcagttccgtactttctcgaaatgctggacagcggcagcaagcaaaacctcccagtcagccaagtgatcatgagggtaaacaaccaatactctacaatgtaactgtgatgccagcattttttggatatagtgttttttggttttccatcccatcatgtctacaaaacacccagtcttgacttacaatgcttttaacttatgggtttctcaggacataaccccatctaagtcatggagcatctttatatagtctgtcttagcctgagtttcccagaaagtagaagtttagacaaaatcctgaatgcaggatttagttggtgaagtgatcctgaggagcagattaaaaatggggaaggaaggaagaaaaatacaaa

SEQ ID NO: 114085 - DNA, 422 bp, Homo sapiens
tctcaaccttccataagaacccttagcactgaggcttgatagggagctctgtcgtcttcaggcaaaacttcttagaattcatcccaactgattactacatccaggtaagaagacttattggatgagaaatgtgtgctggggatgttcttccagttcttgctaacagatgtggaatggttactgctaaagactcataaccttggcagctctgcaagaactcagcctgtgcaaatgtgggggaaagagattctcatccatatgagattttccatggattcataatctgagactgcttgctgaaacaaatgatctgttcgatgccacttgggggtagcagttttaatcatatgagaaaatggtggctgacagtgaaatctgaaccaggagtacagagctccctgcatcccccacaccttccccca

SEQ ID NO: 114086 - DNA, 272 bp, Homo sapiens
tccacagatgccttgtgggaaagttacaacaatcctcaattctttgacaacagaattgatccatgcccagctgtccaaagcttccatccagatgtgcactccagcattaggttcacttgctaacctttttttcattaactgcacagtctctgcaggtaaataaacctcaaaatattttagccatctgttgttccaatggctcctgggattggaaacatggaaatctccgaaactacttgagtgagcacaggcaactttatggctatgtggat

SEQ ID NO: 114087 - DNA, 841 bp, Homo sapiens
gtatccagcatctacaaggaacttaagtttacaaaaaacaaatgaaccctttaaagtgtttgcaaagaatgtgaccagattcttttcaaaagaagacatacacgttcttcttttgagaattgtcttctcatgtccttagcccactttttgatgggactgtttatttttgtcttgctaatttatttgagttcattgtaggttctggatattagtcctttctcagatgtatagattgtgaaaattttctcccagcctgtgggttgtctgtttattctgctgtttcttttgctgtgcaaaagctctttagtttaattaagtcccagctatttttgtttttattgcatttgcttttgggttcttggtcatgaaatccttgcctaagccggtgtctagaagggtttttctgatgttatcttctagaattgttatagtttcaggtcttagatttaagtccttgatctatcttcagttgatttttgtataaggtgagagatgagaatccaatttcattctcctacatgtggctttccaattatcccagcactatttgttgaataaggtgtcctttccctactaaatgtccaaaaaacatgtgaaaaaatgctcagcatcactaatgatcagggaaatgcaaatcaaaaccacaatgcgatattaccttactcctgcaaggttggccattgttgttggcctggatgactattggtaggaatgtaaactagtacaaccagcatgaaaaacagtgtggatattccttaaagaactaaaagtagaactactgtttgatccagccatcccactactgggtttctacccagagaaaagaagtcattatacgaaa

SEQ ID NO: 114088 - DNA, 686 bp, Homo sapiens
gtggggagagtggctgcaggtggcctggttggggaaggtgtagacagggaaccagcgaacagttgagaatgcatgcctgccaagcgaccaagagtgagcagtggacagatattcttctacgtcggtttccacaaaggacctctttcagtaactgccctggggtccccgtgacccctccagtttccctgacttgctaggagagctcccgggacttaggatatggtcctgtcactgctatgactcattgcaatgagaggtgcatggcgaagtccaggaacccctcctcagagtcacatgggaggctgaatttcccagcacatgctgtgaccccatgtgtgacatgctgtctgttagggaggctcgttagagacccttcccagggctttactcggggctggtctcataggctgcctcgcttggtgccaccaagattccagccttcagaggaaaggcgctgttctgcacagaccatgtggtgctcacagctgttccggcacagcgaaccaccctcccggttagggcatggtgggtgggagcactctggaaacccgcattcccagaccacaccccgggacctagctcaccacaggcctgcctaagagtggacggctccaggctgcagtgtgaactcttttctgcacaattactaagaggcaggaaagtcataaagacgttggtgaggaaaa

SEQ ID NO: 114089 - DNA, 735 bp, Homo sapiens
ccctatactcccataattccttaagctgtatcagttcatgaagtcatttgtattaatagtcaatttaaaatgttagctcttagattaaattagtttagttagttggtttgttcaaaacaggaaattgctggtaggagagaggggttgagagaagcatgggatgagactaagagtttaagaactggaaaaaatgaggaaaggtattttggagtatatgacatttcagagaataaacaacttgcaagggacaaaggacaattcagtggagaatgagagtgaggtttggctggcccagtggggattagggtatataggcagccaggttggagtagttagtcctggtacagatgaataatatcactgatgaccagctcagaatgcacattccattggtggtgacccaactgcaacagcataattaaacaaaacaaaacaaaacaaacaaacaaaaaactaacgaaacattatttcttttcaggtggatctcttctggtttagcaaggaagaaaatatttctcagggtttatacctgcttgcaagttgggaattccagaaatctcttactttctagaccagtgcagtaccctattttgaaaaggcagagggattaattttcaaatttatgtgtttacactggtttgatttcaatggccccagggtgacttgaataattgaaaagtaatattgttcctagaaacttttggaagacaaaaaacattaaaaaaatattttgac

SEQ ID NO: 114090 - DNA, 424 bp, Homo sapiens
gtccgaaattcccgggtggtctactactattaaattcgcggccgcgtggacgtatttcgacataatcagcaagtaaaatactaaattactctgacaatgctatcttatgaaataaaaggtgatacaaatgtgtaaataacagcccagtatccagcattgcctacatagtgatcaaatttttgcagcccaacgtttcagtgggtaagatgtgcaaaaacaaaataagagatagcaaaacccacaaaacagcccatgaatctgaatgcttgaattatggtcatgaattcagctcaatcttgagcagtgaggccaaactgagaggtgtcctgacttgagtttcgaagtcacggaagattcagagcaggagacagacattcagagctggagtttaggatgttagatggcagcgtcgacggctggaggt

SEQ ID NO: 114091 - DNA, 385 bp, Homo sapiens
gatcattctcattaattttacttgttgattatgttgaaatactaaattactctgacaatgctatcttatgaaataaaaggtgatacaaatgtgtaaataacagcccagtatccagcattgcctacatagtgatcaaatttttgcagcccaacgtttcagtgggtaagatgtgcaaaaacaaaataagagatagcaaaacccacaaaacagcccatgaatctgaatgcttgaattatggtcatgaattcagctcaatcttgagcagtgaggccaaactgagaggtgtcctgacttgagtttcgaagtcacggaagattcagagcaggagacagacattcagagctggagtttaggatgttagatggcagcgtcgacggctggaggt

SEQ ID NO: 114092 - DNA, 1073 bp, Homo sapiens
tgaatcggttcccgggtgatcctcgcgcctgccgctgctcggccgccgccgctgacgaggagctgcagcgcgccgggccgaggcctcgagccgccccgggagctggagctgaaggcgccgcgcggagcgcgcacctcagccctgagcccggcggcggcaggcgtcgctgtcttttctccttttccccaatatggcagcggcggacggcggcgggcctggtggggcctctgtggggactgaggaggatggcggaggcgtcggccacaggacggtgtacttgtttgatcggcgcgaaaaggagtccgagctcggggaccggcctctgcaggtcggggagcgctcggactacgcgggatttcgcgcgtgtgtgtgtcagacacttggcatttcacctgaagaaaaatttgttattacaacaacaagtaggaaagaaattacctgtgataattttgatgaaactgttaaagatggagtcaccttatacctgctacagtcggtcaatcagttactactgacagctacgaaagaacgaattgacttcttacctcactatgacacactggttaaaagtggcatgtatgaatattatgccagtgaaggacaaaatcctttgccatttgctcttgcggaattaattgacaattcattgtctgctacttctcgtaacattggggttagaagaatacagatcaaattgctttttgatgaaacacaaggaaaacctgctgttgcagtgatagataatggaagaggaatgacctctaaacagcttaacaactgggccgtgtataggttgtcaaaattcacaaggcaaggtgactttgaaaggttagaaaaccttacttttttttttttgtgggtagctatgtattttagtaaggataaaaaactggtatgcctttggatgcatatgatacattggaggttttactgttactcacatatttatttaggttttatattatagaatttttatgattgatactcagaaatagaactatgtaatattgtgcctttccattaaacagctcattttgcatttcctgaggtatgtaggagttgatatgttgggt

SEQ ID NO: 114093 - DNA, 687 bp, Homo sapiens
tttggttttttgtaatcttctactttcccttaacagtacattgttaacgtgtcatatcatgaatgttctgcaatataatctgttgttgcagtgacttattggctataatataaattgtgtagtttgtgttctgttgttgaacatttagattttttttctgtatttttgccactggaaggaatgctggaatgatgaacattcttgcacaccttggtacatgtctctgaatatttccttaagttgaattgtgagaaatggaatttctaggctaaaggacatgaagaattctgaggcttttgatacatactgctgctgaagtgcctttcagaaaattgtattaatttgcacttccatcagtaatgtataagtgagcctgttgaatcatttttttcatgtttaacttttcatgttttaagtattgatttgacttttcctgtctttttgaacttattttgtttcatagctttttgatgaaacacaaggaaaacctgctgttgcagtgatagataatggaagaggaatgacctctaaacagcttaacaactgggccgtgtataggttgtcaaaattcacaaggcaaggtgactttgaaaggttagaaaaccttacttttttttttttgtgggtagctatgtattttagtaaggataaaaaactggtatgcctttggatgcatatgatacattg

SEQ ID NO: 114094 - DNA, 1361 bp, Homo sapiens
tgaatcggttcccgggtgatcctcgcgcctgccgctgctcggccgccgccgctgacgaggagctgcagcgcgccgggccgaggcctcgagccgccccgggagctggagctgaaggcgccgcgcggagcgcgcacctcagccctgagcccggcggcggcaggcgtcgctgtcttttctccttttccccaatatggcagcggcggacggcggcgggcctggtggggcctctgtggggactgaggaggatggcggaggcgtcggccacaggacggtgtacttgtttgatcggcgcgaaaaggagtccgagctcggggaccggcctctgcaggtcggggagcgctcggactacgcgggatttcgcgcgtgtgtgtgtcagacacttggcatttcacctgaagaaaaatttgttattacaacaacaagtaggaaagaaattacctgtgataattttgatgaaactgttaaagatggagtcaccttatacctgctacagtcggtcaatcagttactactgacagctacgaaagaacgaattgacttcttacctcactatgacacactggttaaaagtggcatgtatgaatattatgccagtgaaggacaaaatcctttgccatttgctcttgcggaattaattgacaattcattgtctgctacttctcgtaacattggggttagaagaatacagatcaaattgctttttgatgaaacacaaggaaaacctgctgttgcagtgatagataatggaagaggaatgacctctaaacagcttaacaactgggccgtgtataggttgtcaaaattcacaaggcaaggtgactttgaaagtgatcattcaggatatgttcgtccagtaccagtgccacgcagtttaaatagtgatatttcctattttggtgttgggggcaagcaagctgtcttctttgttggacaatcagccagaatgataagcaaacctgcagattcccaagatgttcacgagcttgtgctttctaaagaagattttgagaagaaggagaaaaataaagaggcaatatatagtggatatattagaaacagaaagccctctgattctgttcacattacaaatgatgatgaaagatttctacatcatcttatcatagaggagaaggaaaaagatagctttactgctgtggttatcacaggggtacaaccagaacacatacagtacttgaaaaattatttccacctttggacacgacagttagcgcatatttatcactactatattcatggcccaaaaggaaatgaaatacgaacatcaaaagaagttgaacctttcaacaatattgatattgaaatttctatgtttgaaaaagggaaggtacctaagattgtca

SEQ ID NO: 114095 - DNA, 675 bp, Homo sapiens
gactggcttttcactatactcttgtgttctctgatgcacagaatttttacatttttatgtagcctaatttatctactttcacttttttgcctatgctttctggtgtcatagccaaaaaatcattatcaaatctagtgtcatgaaccttttcccctatgtttccttatagaagttttatagtttgggtcttgtgtttaggtttttgatccattttgagttgatttttgcatatcgtgtaagattagagtccaactgctttcttttgcagtatccagtatcttttgcagtatgttttgttggtacccagctctcccaacaccatttgttaaagaaaaaaaccatacagatttaagggaaactcagaccacatagctataaacctggagttcctctcatactttggtccaaaccataatagatttagaaagaatcacgactaaagttctcaactgggggctcttttctcctggcgagaacatttagcagtaggtggggacatttttggttgtcacatcttggggtgggagtgggggtagcagttgttactggaatctagtgagtagaggttacgaatgttgctaaataccctgcaataaacagctccctaaagcaaagaagtatctggcttcaaatgtcagtagtgctgaggttgaggaaccctggcctagagtatag

SEQ ID NO: 114096 - DNA, 667 bp, Homo sapiens
tagaaaccgaagctgccaggccaaagtgttatgacaagtatgggccagtgaagggtcacaccaggaacaggtggagagtcacttctgccatattctgtgagtgcatctgtcacaggacctacacagattcaaggaggtggagaaatagactgtactcttgatgggagagtggcaattctctgcagcctgtcatgagggatccactcccacggcccaaacacctcccagcaggtcccatctccaacactggggatcaaatttcaacatgagatttggggaggacaggtatccaaactgagtcaactggtctcattgtcaagagtcctgagttctatagtgttcccgcaacacacacattgctgttttctgtgtgaccctgacaattcacttaacttctctgggactttaatatctgatttgtaaaagggaggctatctggcccttctcatagaagtgttacgacaattaatgaggttataataataaaaggacttggcagagggtgagagtgagtattcatttttaaggaggatgttaattttgagaaatacccaatctgtgagctatttaaatatctagaagtaccaaggaactaaacatggctccatctttccagtgttcatcctgtaacccagtgctatggtttgaatgtggccttcaaaaccca

SEQ ID NO: 114097 - DNA, 104 bp, Homo sapiens
attgcttacgaagaaatttagaaaatatgcttcattgagtgataatgagaatataactttgtaaatttgtggaatgcgcctaaggtattgcttagagcaaaatg

SEQ ID NO: 114098 - DNA, 134 bp, Homo sapiens
tcaaaagagtgatggtgtcattgatagagagatacagcctgctgaagaggggcaggagctttcagcgtggagggtaaggttggagaggagatcctgagtttgcttctagatgtgatgaatttaaaatgatggta

SEQ ID NO: 114099 - DNA, 421 bp, Homo sapiens
tgcctgtgtcatgggcttcatgaagaattccagttactatctgaaagtttaattgcaaggtttggagctcaagatgttacttatcctcatgggcagtacctgttacttccccactgtaaaatatgctagctcaggtcacaaggaactttgagtgctaggatagtaccccacggtccagttccccagaacttcttcccagtgtctccacagccactcacacagcctgagcaggtcttgccactggcagctctcttcccctacttcctccaggccaggggttggcctgattctgcttagagcctgcatgcggctccctcagagccttggggtggccaatctttgctgcttcccagaaccaccttgtactcttccatgcagagccctgttgagtcaccatgccttcctccagctgctgccacag

SEQ ID NO: 114100 - DNA, 397 bp, Homo sapiens
gagaaacatttctgggtaggttaatttattaacactataaggcatggtaggcatggtaaaggaaagacaacccctgccttcatagagctgacagtcctcctgggatatcggatggacagatgtgaaacaattagagaaggacaatttgctaaacttataggggcatgatagaaattctgagagggaagaaacccacatgaactggggtagtgagaacatgcttcctggaaggagtggatatggaagaacactgtgaaggatttgaggggaggcacaaaagagcgtgttttgggggcaatagggagaaggcccagtgagttggagtacaagagagttgcttggatatgccaggaatacttcacatgtgatcttctaagggagtgttgaggaacatggg

SEQ ID NO: 114101 - DNA, 478 bp, Homo sapiens
ctgtagctgactctagaggatacactcgctattcatctcacccatggaaatttgaaaagatcaaaaatatcaatgcaggccacatatgctcatggttttagacaaaaccaaaacttcaggaaagttttcagatattaaagctacagcaggcagcaggaagtctttaagaggtgctggtgatgagaacccaataaataaattttaaaataaagccagaacagaaacactgagttgagacagttcctgcatgagcccactttggctgcgaaacgccaaggccaccaagtaattgaccttgctcttttttttcataggtttttgtggaacaggtggtgtttgattacataagttctttaatggtgatttgtgagattttggtgtagtcatcacccaagcagtatgccctgtacccatgaccttgttcttaattctgtacatagctcgcccttctgcctactacagtcggtgtcctgttctc

SEQ ID NO: 114102 - DNA, 726 bp, Homo sapiens
gggacaacttcaaaacaacgctggtgctcattctgtgtaacttgaagacaaggactgtgccacgctgcactggctttggtatgtggggaagtaggatcccccaggcaggagggatacggctggtacagggtggagggagaggagagctggaagccaggcttcaaaggctgcaggcggaagcactgcttccccaggtgtggcccgggcagggcaggttgcaggtgtgccggagtcacagggcagctgaggaaggggaagggagacttccagcactcagctgacttaagggagttgtcaggtggcctttgctcacggttggcgcaactgagccaagctggcaaagctgctgcttcttcctgtcaaacttcccttcagagatctcttcctgttgctcagaaggagcctggacttagaaactcatacaacaggctgtaggtagcccaggagagccagagctttggggtgacgctggcctgggttgaaacctgcgtagccttctgtgctctgaggccttggcagggttcctagacatttctgagcttcggttttctcatctgaaaatgaggtgattaggaaggatgaaatacgatgatgtacgtgaaagcacagagccaagagcctggcttgtagagaaggtgctctctaggcggtgccccctctgtaagcatcgtcccttagcctcctgcctgttctagtcctctagaacactcaggcgcttggagggtc

SEQ ID NO: 114103 - DNA, 358 bp, Homo sapiens
caaaaacaaacaaaaacaggatctagcacagtgcgtcctggtccctagtaaacattcagtaattcatagttattccatcctatgtttaccggcacattgtaggtgatcaatagataattgttcaaggagtgattcaggtcttaggactgagataaagagatggacacggccgggcgcggagactcactcctgtaatcccagaactacaaaaattagccgggcataatggcgcgcgcttgtagtcccagctaggcagaagatttgcttgaacccgggaggcggaggttgcagtgagccaagatcgcgtcattgcactcccgcctgggcgacagagcgagactctgtctcacacacatac

SEQ ID NO: 114104 - DNA, 296 bp, Homo sapiens
tatgaagaattccaagggacatccaattttcgggttgaaacagctgcctcaagagtggaagaagttgaggaaagaaaaatgcttggctctgatttacaagtcccctgcaaaggggcagctggagggtagcctctagagatgagaatgtctgctgctcttctctctctgggctgctgctttcttccaaagagtcactgttgcccaggaggaaggacttctcagccctcacggtattattcaatccacaggaaataagcaaatacaaagtagccagctcacagaaagtaatctgagtt

SEQ ID NO: 114105 - DNA, 349 bp, Homo sapiens
aaaacataaatatacaaaataacactgtgccaaatctttactttttccttagctgtcaccctctttcttcctccatctcacaatagactgcttagaggaagattgtcatttttgacttgtgacctattagttctcagttcatttaaaatctggcttctagttcacctctgatgaaatagttcacggaaagtttacctgttactctttatctctcaaatttgataattatttttaagtgtttatctcccttgaatcttaattacatttctgatctaactcttcctcatcaaaattccccttcctggttccctctataatttataaagccttcaatgagtcaaactcttaa

SEQ ID NO: 114106 - DNA, 604 bp, Homo sapiens
cagttgaaggtcttcatgatgtcttcctccctctgtcagtcttcatagttttatatagatttgcttaacctatgaatttggctggacattgacttaatcagacaccagctaacataatacattgataatttttaattgactcaataccaaccctctactgtgtgcaaagcaccaaagaaacatggactggctgattttcagaactgaaaggaatttaacagataatcttgtttcactcccaggaagtgctagggaagttcagtgacttgaccaaaattacacagctttcaaagggtagagcaattaattcctgctgtaaacagtccaggctggaatgactgagaaagaagaaattgaagtttgaaagatggataaattagacttagcagaaagttgagggagtttatttcagatataatattaacacaatagtactttggcagataacctttgaaatggaaatgtttaattattcttaccacactctagttgctagacagccagcattggctaggataaaggatagagccctcctcagggagttggtttgtagcacagtctgggaaacaatcggtgctctcatttcaaggacagagtgaaatga

SEQ ID NO: 114107 - DNA, 590 bp, Homo sapiens
gaaaattaaggataactgcaatccaccacaccgagctttccattggatttggtcgtatctgttttcagttattcttgttttcattgtgtgatgacacgatgttgaaacacaattttgttatccttctcttttttttcagttaatccttcccaaacatttcctcatatttaaaaatatatttccaaaacttcattgtaatggctgtagggtgtttcatcacagaagtcacctgaatttatctagctcggcccttattatggataatttaggttatttcccttttctttttctatttaaatagcattgtgatgaaaattcctaggtttgaagcctatattcacaggcattactatttccttaggtgtaaaattttcatcagagagtaagaacctttctctgggctgtgtataaatataactcagttgctctctagaaagatcgaatgtagttactgtgaatatgggttctgagatcagaaaaaaacaaggtgtcgtcctaggtttgcagttctggatctgtgatcagccctgtgacattgagtaaattacttaacttcttcaagcttcagcttccgtatctattaaatggag

SEQ ID NO: 114108 - DNA, 752 bp, Homo sapiens
agaaaattcactttactttttaattatttcatcataacaacttgatttggtggggggcattacttgtttatttcaccagtctttcactgtcagtcaggtgtttaacacagtgataaatgttactggggacccagaatgggtgtaaaactgtttgccattaagttgtttgtagtccatgcctatgtcctgaatggtaatgcctaggtcttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatctcaagaac

SEQ ID NO: 114109 - DNA, 451 bp, Homo sapiens
taaaaaagtgagattaatagttatttttggtaaagaagagaattattattagaaaaggcatgtatagctctcttggggtagctgctaaatttctttttcatttttgccttctactgtattaagctatgcatttgttttgtgtggttttctttgctatacttaatcattaaaaaattcttgatacctttgtcaagtaagtaccatgaaattttaaagtaagttataaaagaattgtcactggtcaggtgcagtggctcatgcctgtaatcccagcactttgggattagcctggcgtgatgactcttgcttatagtcccagttactcaggaggcttaggcaggagggttgcttgagctcagaagtttgaggttatagtgaggtatgatcataccagtgcactctagcctgggtgacagagcaagacattgtctctaaaaataaaaaaacattt

SEQ ID NO: 114110 - DNA, 385 bp, Homo sapiens
gcccgggcagacaggagtatcctttcttttaatttatcaacaaaacttaaaagacaaacaaaaatgtatctgtaaaatataaaaactctatagatgcactagaggtgaatcaccacattttattcaagtatagagtataccatctctactatgaaatctaagaaactcacagcttaaaaaggaatttcatagatttaggtagatgaagatcatcattatacagacgacaacaacaaagtagagactgcttcagtctcaccaagtgacctggaatcataagatttgtacttgggttttataactcctcattctgttttcttactcttttgagacaaggtctggcactatcgcctagactggagtgcagtggcaggatcttggctca

SEQ ID NO: 114111 - DNA, 605 bp, Homo sapiens
gttatcatattaatgatgatggcagtattataaaatgttttccacctgcttgtgacagtacacttggtccagcatactacaaacctcaatttgtaagtataatgtatttcatattgacaattggaaaattgtttatgatttacatatgggtttctttttttcctggcttatttctccaagaaaaaaatgattacacgttttagttaatggaacactaattgtggtaacaaatagacccccaaattttagtggtttaatacagtagaattatttttcctcattcacatggacattctcgttaagtgactttccttcatgctgagattcagggacacaggattattccagttgtgcttctgtcatcctctagggccttgttgtcaagtgtatcaagctggcagaagaggatggggaattatgcttggaagtttttgtaggccaggcttggagctatagccagtcacatggccatacttaactgccagggagaatgggaaatatagtctgtgtatctcagaagaagaaggaatgggtataaattattaggagtctctgccacagtgtataatcataaataatacatagatattatttttcttaatttg

SEQ ID NO: 114112 - DNA, 447 bp, Homo sapiens
tcctgttttcatttttacttgagaacatgttctcagactcggtgcccagctgacgttacctgtgcattgcccgaggcacacacctggccggggctgtgtctcgggggcttcagaagaggaaggaagggctgccaggcatctggcccttccacgtttccctggtggagggattaggccttgggcaggagtcttggcttgtcttaatggatgagcttgtgtctctcagtcagctctgccttggtgttaagctctggactgactctgacctctgagtggcagaggagaggacggtgatttagaatcagtcatgcagaccagggcactcagcgggtcttgggtaaaaagtggtggcaatcgattgcttgcccttttgggagaactgtgtggattgactcctctgaagacctctttgttttgattttatcttgagactttgtagaagcaaaa

SEQ ID NO: 114113 - DNA, 3930 bp, Homo sapiens
  misc_feature (662)..(662): n is a, c, g, or t
aaaacattaacacactgagaaaggctgcgtttgaaccaacctaacttttacattatactgacatcattcccctatgtacaaattgcatacgacctactttgcaaaggcaatggtcatagtaactgtacgatggtgagtggggttgttaaatgcagaccagatactgctgtaatagggctgtgactcaggactatcattccagttgcctgatatgaaaaaggacatgaaggagaaggttttatgagaactctggcaaagacccatgaaaccactcttctttgccctccagaaaacctggtaaaactgaaagtaagccagcagccccacgggtttgggattgatccagaagactgaaggaataaaaacaagctaatatatttctatcccctcccttctaaggcctgtagttggttccattatgatgagacagcagccgatgcacgtaaaaacagaggccatgcatctacacaggggtgttgaggattgaatgagattaggtctgaaagaacacacagtggagacagtgttgtcattgtggggacaaagatttcttttcacaatttgagtgacacttgtcatttctataggcagttaagagacaataactgcatactgttggccgctgtacctttcctgtgcactgagtccctgagcatattcgngagtctttaaaagtacattctagtcaatgtagaaaacagatagtaagggacatgactctacctagattaagctcagttttgaagcagggcctagaggatttagaagtgacagagtcctggattaggtgacatttgataagagctctatccctaacttcctcttaattctggacaagccactccccgctctggctgtagttcccccatctttaaaatgaaacagttgaatcagacaactacaaaaggacttgccaggccttctgtctcagatcctgtgttgttgaagggatgtctgaggccagagatgcagtttacttctgagcaattacagttgtatttcttgtgttcagcctagccctttaccaagctttgttgaagaaatggagcaagatccttgtcctttgcttcggtggtttttaaaacttggatgcctaaagaaaccaggaaggtcatatcagtgagcaaagtacaaaatgtataagcaagacacagtgcaccatgacgctgagagtggcaaagtaacagtccaaccatgcatcagggagtggtggggactgtggcgtgctggcaagcatagccttgtgggattctgcattggacagctcttacaatttctggagagaaatcagaaattcaggtctacatgttgaatcttttaatattgaaatgttcacttggcaatgtgtaaacatcatttgggtcaaagcccatctgtgaaccaagttagtcaaagacaacttgggcatttggacctcagctttatagtctatataagggttggtaaactatggcccacatgctaatctgacccacctcctgtttttgtgaataaagtttaaatgaagatgcagtcacacctatgtgtttaggtattgcctgtggctactttcacactacaacagcagggttgagtagttgtgacggtagttgagacagtgtggccctgtatttattctctggacctttatggaaaaaggttgctgacccttggttcatgtcaatgactcatatggagcagcaggaaacattctgaatttggagctgaatgaccagggtttgacgcctggctcagggaactctagtaacagagtagagagtgtttctcttttctccttttggaaatgatcctgaagcaacaaatggaacaaatggaaatgcaaatgccatctttgatggaaccatagcttctggaacctcatatgtggggaagtgcagtaaaggtcaaaaatgggtgcaggatgtctccaaagggaaataaaatgcccatggctgtaaagctcagacagagcaaacaaagcagaattttctacaccttctgtggtgggctcagatggcaagacctatagttcctctcatggagcaataagaacaagtgcattggctggtgtcttagtctgttcatgctgctatagcagaataccatagattgggtggcttgtaagcagcatacttttatctctcacagttctggaggctgggaagtctgatacccaggtgtaacagatttggtgtctgctgaggacctgttttcttgttcatagatggtgccttcttgctgtgtgcttgcgtggcagaaggggctagggagctctctgagatctcttttataagggtactaatcccattcatgagcactccaccctctaagacctaatcagttctgaaagacgttacttcctaagaccatcacattgggggctaagatttctatatatgaatttcggggggacacacattcagaccataacaactggtgtgggagccttcccagatctagttttgcacaaagtgaaatcagggaagtctggggtgaacaaggtctcacatggacaagctatattttcaaaaagcagtctactagagaggcaaagtggagaaaaggggctgtgttatgtgccagcctgtggcatctgatcttaacaagaaagaagtaaaggccaaaagaactgactctcactcacaagcctgttttctaagaactagattactcttttggacactctggtgcacgaatcttgtataaatagatggttcaggaagaactcatcacattcagagatgagtaataattagtaaggaccagtgcaagctctatctcaagatcctccaaaaatgaagaaagtaacagatgaaaaatatgcgcaagaaaacatttgccataaatcagatgaaaatgtcaacagtacataatgccttggactaaggaaaaaaataattgagcaatcacacctctaaacaagagtataaagttgagatacaagaactcaggagaggtggtaacatgacagaagagagtgaaacctgatatgatgagctccacaaagtagatagattaacaaataaacccatctaaaaagtgaagtatgcaatggaatgattatgacagggaacacagaaaacacagtaagagatatggaagatgagattgggaaaagcaagataaattaatgtaaagagagagagagaaatattagaacatgatacagaggacagataaggggatccaacatacacataattggtgtccctggagataagaatgaaaataattaaataaaaaaaatttaaggcacaattccagaactttctaaaaataagatttgaatttatggactgaaaggaagtacagtgagtggctgagaaaatattgatatggtgaggtcaacagaaagacatagagaagtactaatttcctcataaatcaagaacccccaaaaaaattcaatagaagaatggataaaggatgtgatgaggagatggtttacataaaaggaaatagaaatatcttttaaacacataaaaactcaacctcactcataataagaaaactccaagttaagatactgttttttatctatcgtataggcaaggactaaaatagctgatattaccatgatggtgcaggtatgagggaaacaagaactctcagaaacatggctatggatttcacttctaatccttgtctgatggaagtacacaagtaagaggccaggtgtggtggctcatgcctgtaatcccagcactttgggaggccgagattggcagatcacttgaggtgaggagtttgacaccagactggccaacatcacgaaaccccatctctactaaaactacaaaaattagccaggcgtggtggtgcatgcctgtaattttaggtacttgggaggctgaggcacgagaatcgcttgaacccaggaggtggaagttgcagtgagccgagatcacgccactgcactctagcctgggtgacagtgtgagactctgtctc

SEQ ID NO: 114114 - DNA, 538 bp, Homo sapiens
agcggcgctccgaggatccctcgctatcatcggcaccaggaaaacacaatccctgctttcataagatttacgttctagtgggggaaacaagaaatcttagtgggcaaatacagggtggtgctttagggacaaataggaagggcatccaacacagatgtggggaaggagggcagttagggaaggatactcaggggaaagagaatggaatctcaaacacagaatgagcaagagttcctagatacaggttggaaacttgggaaagagatctaaaatggggatagagcttttagagtcatcattatacatccacagtaaatagtagattcagccatggatcatgttgccttgcacagaataataagaaacaccaacatttaagagaagagcagagggaataaaggctgcaaaggtgagtgtttagaaagaaaggagtactcaacagtaacacatagatacagaaagtaaagaagaaaaggactagccaggcttattggcgtgcacctatagtctctgttactcagaaggctgaagcaggatg

SEQ ID NO: 114115 - DNA, 530 bp, Homo sapiens
tctggtggtggggcaggagatgtggccacaaaggaaggtggggatagtccggggatggcaaggaaggagaaccacaagagagggcagtcctgagggttcactgtgacagaggccaaagggttcccaaaattcgaggcctgggagctgcttccatggacttggcaactggaagcttctgatgccctaggacagaatagtttctaagaagagtgagggcagaatggtgggttagggcagcggtccccaacctttttggcaccagggactggtttcgtggaagacaatttttccatggaccagggtgggggtgaggggatagtttcgggatgaaactgttccacttcagatcatcagccattagattctcataaggagcacacagtctagatcccttgcatgcacaggtcacaatagacttcacactcctgtgagaatctagtgccaccgctgagctgacagaggcggagctcgggtggttatgctcccttgtcagccgctcccctcctgctgtgcggcccagttcctagcag

SEQ ID NO: 114116 - DNA, 91 bp, Homo sapiens
aggcaggagaatcacctgaactccagaggtggaggttgcagcgagtcaggatcgcagcactacactgcagcctgggtgacagtgagactcc

SEQ ID NO: 114117 - DNA, 433 bp, Homo sapiens
ttgccttactgtttagggacaggaaggagacctgagggggtctgactgttttattcagagtttgaaacagttctcctgttctcagcccctgcctctcaactcttgtctgcagtggttcctggtgcctcccacttccctgcgtgctccgggcttttgaagcactggcttgctttttgtggcttttccctctgcagccataaacttcaactttccttctttgctgagtcagttacttcttaccttcctgctcaacctggtctttcagatttctgttgacatccctcatctactgcctttttccttccccttactctttgtctttatgcatgtacacttttactgttcccttatagtcattctagtgaaccctcaggaagatgcaaagaagtatatgttcattttgccatgtttatccacaacccccaaataccat

SEQ ID NO: 114118 - DNA, 332 bp, Homo sapiens
tctgctgcaattgtgtaagatttgtctgcaagccttaattttctcattacctactttttataagtcaggcacaaataattggaactgcttatatagggaaaattgttgaggctttaaaatgtctcaacgccaaatgagaagaaagagaatacatattctttagtcttaatttggttccccaggagcaaacttgaatcctgaaacaagaattcaaactcacagagtttattttgtagggaggaagggaatgaagagaacacaggtaggggagaagagaaataagacaaggaagaggagaaaattaataaagataggcttctcaagccaattac

SEQ ID NO: 114119 - DNA, 656 bp, Homo sapiens
gttaggcagtgaatgaagagtccgggagatgataaccacctcaacgttcccatttaaatgtcactgttactgggccctttttaattctattccaggacgtgtacctaccaataatttttactttagaagtttcttggtgtggtaggaggagtttgatgatgaaaccatgcatccatatatatagaaacaagtggatatattatcagtatggatggaaatatattttacaggttaaatcattctaaaaatatttttatcaaataccttattctgatattgcttacatctgggtttaaatccatactttcctggagaaacatgttatcttttactcttgtctcagtaggtgccaggcattcaaatgctgtttttccagctcaaaggaattaaggacccaaaggcatttaccattgatatataggaagagtggcaacaataagtcacgctacagtgtgtagaaaagtagaaagcatccctaccaatccttaaaatgtttggctgagagctatacactgggtggcaggagaaactgattaaccttttactcctaagaagattcctcaggcatagagtatggttaatgccgtgagacatacagtatttaataggtgttcagcatctcagaaaaaaaaaataatagttattttaggaatatc

SEQ ID NO: 114120 - DNA, 249 bp, Homo sapiens
attgctgggtcctggctatttctgtattcctaccaatatgctttttccccccatcaggcagataaaatcttgttgtatttgaatgactggatctatgtaatcaccaagatccactatgtacagacgagagagggagacctttatttcttagtttcttcctcctgggacagtcttaatgattttctcttggcccagaggcactctccgtggaactacagtgctttcctggtcttagagccatgtgccctg

SEQ ID NO: 114121 - DNA, 247 bp, Homo sapiens
gccctaaaaatgagatggtaaagactgtttattaacatgccttctcactgtttagagagtcagtttctcgcataaactgtaatttagtcctttgaagactttgagaccttctcttgtgttctttaatggtctaattatgaccatgtgggaaacacctagtcaaacaaatgaagtcaggaaattccgggttcctttttagtcagttccaaagacctattgtgcttacatttcttccacggagatgcca

SEQ ID NO: 114122 - DNA, 514 bp, Homo sapiens
ctacataatttagaacaagcttgtccaacccacagcctgtatgtggcccaggacagctttgaatgcagcccaacacaaattcataaactttcttaaaacattatgagattttttttttcttagctcactatttttcatagtagaaagaaacagggattgtaagtcgcccagcattggagccactgccccaagactgcctagtaggcagctccctttgggcaattgtctgcctcctggaaagcttcctgccaaagctgccctgagaatctgggatggaggtgtggccatgtggtctgggtcccctgggctgcgtggcagcagcatctcaggagttgagtcctcttttctaaccttgcgctgctgcattggcttagctacttagctggcatggtcagacaaggggagcacgcccgtgagtgtgtccacatgggccggcggactatcagaaacgccctgttgaacaaatgtgtccaggatagagggatgtgactgtgtatagctgatgaggggaaca

SEQ ID NO: 114123 - DNA, 100 bp, Homo sapiens
tacatttatcttatctctagaaatacaatacataactgaaagctcaaggccaactatgccaagggtggccaataataaaactgggcctgataaaaattaa

SEQ ID NO: 114124 - DNA, 139 bp, Homo sapiens
acctgtgttacagagaaatatactggttatggacaaactccatgtggacaactctatcacccagaagccagagtttgtattcctcgatgctgtggttatatagtttgccaattgcaacttgcagagaggggcggagcag

SEQ ID NO: 114125 - DNA, 387 bp, Homo sapiens
tgtcactatagaggggagttgggtggggagtggttaatgtatttttcctctttttcgatacttaaaagaggcaatatttgggagctggagcaagacgactgaatatagcccttcagtgatcatttcccctcaggatgaccaaattgagcaactattcatgcaagaaagcaccttcatagaaaccaaaataggtgacaaccacagtacttggtttgactatattatcaaggaaagagtcattgaagagggtagaaaagacagtcttgcattgcctacagcacccctccctgaaccccatgtagtatagcatgaagacagaatctgtgtacttaggcaagaaagaccaaagtgagagtggacctttggaactcagtgctgtcctgtcac

SEQ ID NO: 114126 - DNA, 184 bp, Homo sapiens
atcgaatcgagccggtcccctagttttagaagttcaatagcacttgggcctctgccctcatcactctcgctgatgttactaatgacctctcctaattgtcttatcaccactgtatccttattccattggccttctctgagtatctatctgatatggctcatcatgctctccttctagaattaga

SEQ ID NO: 114127 - DNA, 482 bp, Homo sapiens
ctaggtgcttcacaagtgtattctcctctaatcctcacaacaaatatatgaggtgctattatcccctttcgcaaatgaggaaaataaggcacaaagcttcagtaatctgaattcccaggtcacataactagtatgtagagaagctgggaatcaaacccaggcagtgagcactttctagaatgctgtgcagttccacttccccagctaagcccttgcttacccagagtccattgtgatttaatatcaagtgtgtctatgcccgttgtatgtgttattgtaattcataatgtaattaaatactatacacattgatgaacaggccaggtgagatggctcacccttgtaatcctagcactttgcgaggccaaggtgggaggattgcttgagcccaggagtttgagaccaccctgggcaacatagtgagaccccatgtcaatgtaaaagaaaatttatctttaaaaaaaaataaattgatgaactga

SEQ ID NO: 114128 - DNA, 1191 bp, Homo sapiens
gggaacagaggaagcacattaacatatactgagtacccagtgcttgttctttggctcctttgttgccccatatgccatcagactcttctgggattgccctaccaatggagagctgtctcacctaggaccacccctcttcccaatgcagtccatttccagtgactgattattgcaggagtttaaagacctgacatctcatcccaatttgggactaccctgaaaggctattgtagctccagactccccgcataggaacagctccccgtaggtcagctcttgctgtacctgcatcacagcttatttcttccctctgcccacaccctcctcctccttccacaggtgttgataccaagcgcacttcctaacaaacataccacctgcctcagagtctgcttcccagggaacccaacctgcgacctaagtatatttcacaataacaacacccagggtactgctctaggacaaataagatgatgtgtgtgaaaacatttgacaggtaaacataggcagtctaatttagtgtttaagaatatcatctttgaagacagatgagccaatctttggttgtgaacttcttagaacctttagtcaggttacttaatggttccacatttcatttttctaatctttaaattaaggatgagaatacctacttcatgggggtgctttgaggattgaaagagagataatacatgtaaagcacttagaatggtgcctggtacatgtttggtgttcagtacaatatgtatatctctataatatatgtctactatattaatataattgtattttgatgactttgcatcaatcattttatgtatcagttttactttccatgaaatacagattttttttctatatcaagtgtatagttataacaatgtagttgaaattgagttctgcaaaggaaaatatagattctaagattgcattatcattgtcattttgctgttaaaattgtcagcaaaatcttaactctgatcccattatccatggctactcttcaatattgtattggcctattcagttgccctatctccatagcagccaaatacattgtcatcattacctattcctgtagcaacatgatttttaatatttcttggataatgaaaagtagttatcaatacatggtatttcatttcctggggatcttagtaccttctggaaatggccattttcaaatacaac

SEQ ID NO: 114129 - DNA, 379 bp, Homo sapiens
  misc_feature (17)..(18): n is a, c, g, or t
ggtgttagaggatccgnntgcatctgtgctcggaatgtgaccttttttggaaatatagtctttgcagaagtaattagttaagatgaggtcatgttggagtagaatgggctgttcatccagtatgactgatgtccttataagaggaggagaaaagatacacaaagagaggagaacaccaagtgaagacagagatacagaggaagaacttgtatgacagcagaacatgtgtgacagcagaggggagaccggagtgacatgtctacaagccaaggaatgcaaacgagcacctgcaacgccaaaacccaggagaaaggcgggaacagattcttccttagattctccagaaggagcctccagaacgatcagagaataaatacca

SEQ ID NO: 114130 - DNA, 2270 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaaaaaaaaacacaaaacagaacaagagacacacacaacgaaacgacaccagacagacacaagacaaaccccccgggagggaacacgcacaagggagccaacccagaaggggggacaccacacacacagttgcccacaagaggagcaaaccacgccgggcacacacgacgacccaccgacagaagaaacgcacaccag

SEQ ID NO: 114131 - DNA, 1345 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttaaaaaaaaaacctcgttccgaatt

SEQ ID NO: 114132 - DNA, 990 bp, Homo sapiens
  misc_feature (37)..(37): n is a, c, g, or t
  misc_feature (794)..(794): n is a, c, g, or t
ccccggctgcaggaattcggcacgagtcctgttgctntgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaattaccttacggccttaagganattgttacctaccattattaaaaaatcaacttggtcctattctgggtgcctggaggttctcaatgatatatgttgccgaacccactgggtataatctaaatcgctgaaatatgaattccttaaaccttggttattcggtaagattgtgaattcctgatgaatgaacctttatacccggtgtggaggttgtccatca

SEQ ID NO: 114133 - DNA, 825 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaatttgagtgtagatgttaaagagatttcaaacacattgtggggaataccgacgaaacaccatatcgccagcgtctgagaactgccagagcaataatacacaatacacagaacatcaccgcccactaatacacaaagatggaacacagtaatttgaacctaatgccagatcaattcatggttcgatcttagatcaccaaaaaatcaatcattctatgcaggtggctataggaacattgcgagatgctttttccgggggggcaagcctcagacttgttttttgtggtagggt

SEQ ID NO: 114134 - DNA, 1177 bp, Homo sapiens
  misc_feature (652)..(653): n is a, c, g, or t
  misc_feature (660)..(661): n is a, c, g, or t
  misc_feature (1177)..(1177): n is a, c, g, or t
aaaaaaccgcataagccaaaacatcaaagcaaaacagtgccctagtgccgacgggcacgagaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaaaaannaaaaaannaaaaaaaaaaaaaaaaaaaaaaaaaaaaaaaaaaaaaaaaggggggggggctaaaaaatcccccggggggggcccacaaaatatagcgcgcgcacacaccaccagttttcgtgtgtgaacaaaggggggcccccacaaagggggagggagctatatatataataagcaagaggacagaggggcagcgcgtattaaacaaaggctgcagaggggggaaaaaaccgtggccacgggggacaattttttgggaaggaagagaacctttctacagttgggggggggagggagacaatatatggggagaaaacaatcctctcccaagaaaaaattataaaaagcgttatagagggggaataataaacaaattttataaagagaggggtaaaataagtggggtgtgaaacaaacaagcggagatattcgcgatggagtggataaggaaaatttgcgtgtatacaagggataatagtatttaaaaaaaaattttttatcccaggaggcgcttaaaaaaaaagn

SEQ ID NO: 114135 - DNA, 232 bp, Homo sapiens
gcggccgcctactactactactactgctcgaattcaagcttctaacgatgtacggggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114136 - DNA, 2604 bp, Homo sapiens
  misc_feature (2079)..(2080): n is a, c, g, or t
  misc_feature (2087)..(2088): n is a, c, g, or t
  misc_feature (2604)..(2604): n is a, c, g, or t
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaaaaannaaaaaannaaaaaaaaaaaaaaaaaaaaaaaaaaaaaaaaaaaaaaaaggggggggggctaaaaaatcccccggggggggcccacaaaatatagcgcgcgcacacaccaccagttttcgtgtgtgaacaaaggggggcccccacaaagggggagggagctatatatataataagcaagaggacagaggggcagcgcgtattaaacaaaggctgcagaggggggaaaaaaccgtggccacgggggacaattttttgggaaggaagagaacctttctacagttgggggggggagggagacaatatatggggagaaaacaatcctctcccaagaaaaaattataaaaagcgttatagagggggaataataaacaaattttataaagagaggggtaaaataagtggggtgtgaaacaaacaagcggagatattcgcgatggagtggataaggaaaatttgcgtgtatacaagggataatagtatttaaaaaaaaattttttatcccaggaggcgcttaaaaaaaaagn

SEQ ID NO: 114137 - DNA, 2027 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114138 - DNA, 1921 bp, Homo sapiens
ttactgatctgttttcttttcaggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114139 - DNA, 1944 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114140 - DNA, 1656 bp, Homo sapiens
ggcacgagcggcacgagctcggcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114141 - DNA, 1969 bp, Homo sapiens
gtggcacatttagtcaatattgaaaccaaatgtattgctgcttcaaatacatgaatgaccaccagaaaatggtttgtgctagatatagtgttgtgtccatcaggtttaagttattttccactgaggcatgatgggagatacagacttggcttaccagggggctgtttaatcttctgtgccctcaaaagggcttgtttggaaatgatttcgggcttctaaatttccatagaaagtgctggaaaaaagtttaaggcttctttttaaataccatctgaatgatttttcttcccactttggttcacataataattgcgttcttactcttaaatttcaggcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114142 - DNA, 2011 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaatctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114143 - DNA, 1933 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggacctttcttggccaggactcgcagtgggtaacctgtttcatcgtcctcgggctaccgtcatggtgatggtgaagggagtgaacaaactggctctacccccaggcagtgtcatttcgtaccctttggagaatagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgggagagacaacatatcttccaagaacacaagcctgggcgtaagaaccaccctggccatagtcctaacttggctgttgatttctttctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114144 - DNA, 1171 bp, Homo sapiens
  misc_feature (45)..(45): n is a, c, g, or t
  misc_feature (47)..(48): n is a, c, g, or t
  misc_feature (66)..(66): n is a, c, g, or t
aacaaaacacgatatgttgctactatccaatttctgcctcccccntnnaaagagggcaggagaaanccgtcctagtagtccaccacaaaaatctaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114145 - DNA, 530 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgtgagtatttattataaaaaattaaagggatgcattttacattttcccttgtcagctgtcattatgaattgcattctaaacatacttctc

SEQ ID NO: 114146 - DNA, 2075 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114147 - DNA, 1691 bp, Homo sapiens
  misc_feature (1489)..(1489): n is a, c, g, or t
  misc_feature (1496)..(1496): n is a, c, g, or t
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaanaaccttngaaaagtccgtttgcgaaaagtccgggttttttaaacttccaatgtttctcttaccgtaagggaaacacttggggctggtcgacacacgtgttctccgttaacccacaagaagtttcgcacagtggtaatccgacaagagagaacaccgggacgcacgcaaacaccggttactcgttcttccagctgttttcggc

SEQ ID NO: 114148 - DNA, 2021 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattgcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114149 - DNA, 1243 bp, Homo sapiens
  misc_feature (1235)..(1236): n is a, c, g, or t
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagatgatctcctcggaatcatcgtgggnnatacggt

SEQ ID NO: 114150 - DNA, 1979 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114151 - DNA, 1841 bp, Homo sapiens
agcggagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114152 - DNA, 1299 bp, Homo sapiens
tggcgtgaatcgagctcggtaccatctcgtgaccggcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 114153 - DNA, 557 bp, Homo sapiens
tggggagggaggcgctagaggaatctggggctattgccaagtcccctatcgttcacatgttcctggagaaggagtttggatactgacaaatcctgcatcagggagggctacctgagtccagagatctcatcctgagcctgtctgcttgcctggaaccacaggcaaaaagagtttcagggcagccggaataggacaacatgttcctagtataactaaaatggcctttatcaagttgctttaaagaggtgttctttgactgctgaaagaaatcatagatgacacaaacaaatggaaacacatcccatgctcatggatgggtagaatcaatattgtgaaaatgaccatactgccaaaagcaagctacaaattcaatgcaatccccatcaaaataccaccatcgttcctcacacagttagaaaaatcaattctaaaattcatttggaaccaaaaagagagcccatggagccaaagcaagactaagcaaaaagattaaatctggaggtatcacactacctgatttcaaactatactataaggctatagtcaccaaaacagcg

SEQ ID NO: 114154 - DNA, 602 bp, Homo sapiens
tggggagggaggcgctagaggaatctggggctattgccaagtcccctatcgttcacatgttcctggagaaggagtttggatactgacaaatcctgcatcagggagggctacctgagtccagagatctcatcctgagcctgtctgcttgcctggaaccacaggcaaaaagagtttcagggcagccggaataggacaacatgttcctagtataactaaaatggcctttatcaagttgctttaaagaggtgttctttgactgctgaaagaaatcatagatgacacaaacaaatggaaacacatcccatgctcatggatgggtagaatcaatattgtgaaaatgaccatactgccaaaagcaagctacaaattcaatgcaatccccatcaaaataccaccatcgttcctcacacagttagaaaaatcaattctaaaattcatttggaaccaaaaagagagcccatggagccaaagcaagactaagcaaaaagattaaatctggaggtatcacactacctgatttcaaacgctagggtaatgcaagtcacagacactatgattgtatcgacgcgtcaaatccaaagcggcagactggatcggataga

SEQ ID NO: 114155 - DNA, 325 bp, Homo sapiens
ttttttttggaatgtggcttacatacttgtcccctttgaactgtcctttgcatttgattggcttaacataattacagtaatatatatttactctattcacaatccatctttcctctttatcattttagtttttctcttccaaatttacactattaccagctaatgaattatataatttgagccatgtgccatggctcatgcctgtaatcccagcactttaggaggctgaggtgggaggataacttgaggccaagtatttgagacaaacccgggcaaaacagactctaaaatatatattttttaagccaggaatggtagggtgcac

SEQ ID NO: 114156 - DNA, 626 bp, Homo sapiens
  misc_feature (583)..(583): n is a, c, g, or t
ccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagtgcactgactgcccggaacgcgtaactcaccttctgaaaaagtcacactcccatttctctactttaacaaacctcctgccctgagcccacaaaaccccacatcaaccaagcagggaaccgagcactgggctcatctattaagacctgggccttctgaagtctgtaaaagaagcaatttccttcttcttaagatttcntggcatgtttattttctaataaatatctgttctttggccttgc

SEQ ID NO: 114157 - DNA, 408 bp, Homo sapiens
aatgtaatcactagctttgatggtaactgtaattatgtagaaatccaaaaactcagtcgtcattttaactggcttatcaggattagtggagggagaggaagaaaatattgcatatatacctggaatgtcattgtcttgtgttcattttactttgacctcttatttaatttgcttttcacatgtgtgtacctgaatatgactggaaactcagtgcattttgttaaaatattctcttctggttctaaattgaatcgtatagtgtggttaatttataatcttatgaatctgcatattgaataattgtgcaacaaataaataacaaaaaaaatctggcctatttgattttctggtctgtttcagcataaataaaaagaacatggaaaaaaatagttgaatctaaatagaatc

SEQ ID NO: 114158 - DNA, 342 bp, Homo sapiens
tgtagcctcagggcatggctggcagtgagcagagttcctgttgcagtgacgctggcacagctgtcagtgtgcccagccacactgtgccacgtgtttgcacgtgtgccctggtacatggggccagctgggggagcggggcctcaggctgacctgggacgagccagctcgctccagttggctggccgtgttcacggtgcccgtggagggtcctgtttgctggtgtgtcttgccctgcttgctcctccatttatgtttgtagtggtggtgggaactctgacgtctggagcccctggtgtatccccatcatctccccaagcagtcacaggtggtttctgaggtctg

SEQ ID NO: 114159 - DNA, 366 bp, Homo sapiens
cactatagctctgggactaggcagacctggggtcaagtcctttttccttggcccagaaatttcatcttgagcctcagtttctttctctttaaaatggggctagtgggacctacccctaggttctatatggagattatatgatgtaatgatccaacctgtacttgggaagcacttagtcaattgccactactgtttctcagcagatcttccagtaacaactaccaccacctgttgagtacccagtggtttatacacacaagcttattggatacccagggcaagctaaaggagttgttcttgttctattgtgattctcattttataaaaaagaaaactgagatttcaagaagtgccgtgtaccttgct

SEQ ID NO: 114160 - DNA, 355 bp, Homo sapiens
aaaaaatacaaaaattagccaggtatggtggcaggcaactgtaatcccagctgctcgagaggctgaggcaggagaatagcttgaacctgggaggcagaggttgcaatgagccgagatcatgccattgcactccaacctgggcaacaagagcaaaactctgtctaaaaaaaaacatatatcaactttgaaaaaatacatatattttaataagagttaggcttttaggaaatttgtgaaaaattatttggaaagagtaatattccaatactgagttgtaagcaatttataaaacattgatcagagactccagtgttattttgcactatgaaaacacaaggtcagaaatatagtagga

SEQ ID NO: 114161 - DNA, 493 bp, Homo sapiens
gcctgggcgacagagcaagactctgcctcaaaaaacaaaaacaaaacaaacaaacaaacctgaacggtccttgtgccatagaatgaggtcattctggaggttttgggaatgtacacccatgtaagaaccttgtgttttcctgtgtgtagagagtgtgtccttttggacaaaggagccactgatgttctagggactggtgattttcatctaccatgtcattgcctttaatatcagggatcatggggaggtaggctctgagaatgtgcctgtaacaactggagcttttgtgagtaagaggggagtgtttccttgctacctagtgggtcctgcatggtggcacacaaattaactcagaaccccagactctttagatgtaccaggaccagaagtttctggttggggctacagttacccccaaatcacctggctacggcaaagcattggtattcctcccaatttttgaagatgataatcttctagaggctgtggcacc

SEQ ID NO: 114162 - DNA, 427 bp, Homo sapiens
tatgtgggctttgctttttaaaggatttttaaagtattaattgattcataagaaatatttgtaacatttcattagtttgatacttttaagtccttgtttggagttaacataagtatttatgtgtgtatgtgtgtgtatatctgagagagataaatagagagagaaagaaagagagattctaagtgtctctaactttgtttttagttttcttttgctatattctagctttgtgtgttatagtcatagaatagtgtctatactgtgatttatcagaattttggagtgtctaaaaatgagataatttttaaagtgttacacttacataacttcaaagaaaggacaaaacagaagttatagagaatgttatgaaaacatgggatacaactacagcactgcagtggaaatttgttttaaatattttcatttc

SEQ ID NO: 114163 - DNA, 403 bp, Homo sapiens
catttgaagaaagggctgtccccagggccacagctgcctctgcagggctgaagaaaggaagacaaaaaaagtcaggcttcatacttcgaaggaaagggctgaaatggcaagaccaagtgaggctttaaaggaaattaagtgtaggtctggcaaaaagggtacgaagagctctgctcaccctgtggccaccccaggcctgggtaattacttcacgtggattagacctatgcttcacggcccaacaagaggctttaaaagagcccatgctttaggctacagaccctcgaataagctcactctcgttgagccttttctttttggctgtgggtccaaggagaaatggttggctcctttgagtcctttcctccctaaggtgcttatgtaatactaagagatcaaatga

SEQ ID NO: 114164 - DNA, 410 bp, Homo sapiens
gcgggcacctgtagtcccagctactcgggaggctgaggcaggagaatggcgtgaacccgggaggcggagcttgcagtgatcccagaatggcgtgaacccagaaggtggagcttgcagtgagccgagattgtgccactgcactccagcctgggcaacagagcgagactctgtctcaaaaaaataaataaataaaataaaaataaaaaattaagtaaatgcaaattacttttaagtatataaaagcatattcaagttcaaccataataaaactacaaataaaactctatcaatactctttcacctattagaatagcatctttaataacacaaacttcagcaaacatatagagaaataggtacttccattcatgcatctgcatgattggagtataaattagcacatatttatc

SEQ ID NO: 114165 - DNA, 756 bp, Homo sapiens
agagaataaagttttataaagataattaaaatgacctaaaatcccaccagccaagacgaccactgaagacattttttttaaacaaagatattttgataaatatgctttaggttctgcttctatgtctggtttcatggttttttattttttttaccccaaaatttggcttatttagagcatggtatcctggaatctaattttaaaactttttccattaagcatttttcaagttacctaataattattttaatcactatatggtttgcaatctattgttaaccataatttatttaaccaacctcctattgcttgacatttacagtatatacaaattgttttaaaaaaattcttgaaatacaaagccttttcttgattcattacattttgaccattccttaagaagaagaagtgaatactctaaccagatctaagtgaagttttaaaaacagtgtgtgtttgtataaatcttcaagcgtagtgttatacaatttaattgtgatgtgttcctagatcagaactaccctacggagagtccagatttggtgtttttacagccttcctttgcagaaagttagatcgagaaattcataagcagtactactttctctgggcataataaactagtttttctaacttgtttatatgtttaattattttaaaagtcaagaaactgaagcctaaatattcaacacatagttgactaaatgggaggaattcctggaggtgttcatttagaaaatgtggattttaagatat

SEQ ID NO: 114166 - DNA, 390 bp, Homo sapiens
cctcggcccatgttgttacagttgatgagccgacattgacacatcatcacctaaagtcatagtttacactagggttctctcttggtgttgtacatgctgtgggtttggacaaatgtataatgacatgtattcactattatggtgtcatacagaataatttctgtgcccatttcaacctaggggatctcccctcctgcatccatgatacaggttgagtatttcttatctaaaatgcttgggaccagaagtgttttggacttcaaattttttcagattttggacctttgccttacttaccagttaagaatccctaatttgaaaatccaaaatgctccaataagcattttccttgagcatattttttggtggtcaaaaagcttcaaattctgg

SEQ ID NO: 114167 - DNA, 321 bp, Homo sapiens
ccactttgccattctgcattcaggcaaacattactaatcaaccacggtgctaccgcttaccccttccttattcaggggaggcattgttaatcaatcacaacactggttccacaactctcccctcctgcatccatgatacaggttgagtatttcttatctaaaatgcttgggaccagaagtgttttggacttcaaattttttcagattttggacctttgccttacttaccagttaagaatccctaatttgaaaatccaaaatgctccaataagcattttccttgagcatattttttggtggtcaaaaagcttcaaattctgg

SEQ ID NO: 114168 - DNA, 881 bp, Homo sapiens
aatttctgatgcctttgaattgcccaggaggtttctggatagaaccatggagctaagtgaagtctagactgaaaattaaagctgttaagtgtgaagtgtgtagggaaaaattaaagtcttgagtattcatgaagtaaacttggaagacagcctaagtgtgtgcagtgaagaattccagtttatttttgactaggtagaggaagatgaactggataaggaggagttacacagttaccagcagggtgttgcgctactgaagatgagtaaggcttcatggaaagagtggtgaataatgtccagttgctgtataagaattaggtggaaggattagcacatattaatcatctaaaaaacaaatacattaatatcttcaaagtctgatttgggagaatttgttttcattgttttttttcaaacaggaactgaacaataccatcatttacagttacgggctatgggtggtcacttaattggtgtgatttgagactgagaacctcctgttccacaaatctatacttcatcctctactaatgcttgaaaagtcattgatagaaatctgttttaaagcatatattcctgggaagagtaatatgtttagaagatacataattctcagctgtgccaaaatttagaattaactgaggagttgtgtactaaaaatgctcaagattatattccatggttctgaggtggggccttggcacatgcatttttttaaaagctcccctaggtgattctaatgtgccattgttgaaaaatcattgacagcatcctattaacacagtattgactcataacgttttgtttagatgacatgtgggtaggacaggacacctatttataaaacagtggttggtaatggccattgagtagggaggatt

SEQ ID NO: 114169 - DNA, 569 bp, Homo sapiens
tctccagtggcattggctgattgggttgccaggctcaggtcactgacaggctctggcttccgagtatcccgccattctcctgcctcagcctcccaaagtgctgggatacaggcatgagccactgtgcccggccccagagtctcatatgttttactttataccatcttgattttttgttattcttagggaagttttcatttattcaagattatatttctgttttttatagttagatttttaatgtatctagaatttagttttgtgaatatcataaaattaggatcttactatattcctttaaaatggaaagccagtcgtcccaacactattggttagaccaggagtcagcaaactacggccaacatgttttgttaataaggttttattggaacacagccattctattgtcattgtcaatgactattttcatattatgccggcagagttgagtagttgcaacagaaactattaatatatggtccacaaagcctaaaatatatgtctgtttatggaatttcttttatttctttatttgcttaatgtgttcttctctcatcatctcacactgt

SEQ ID NO: 114170 - DNA, 370 bp, Homo sapiens
gtggcaagaggccatgggccggataagggggctgtgctccagcctgactcaggcacacgttggttgagtaaccaaggcaagccctgtgctcttccaggccttgatttcttcctctttaaggaaaagaaattggacctgatgcttcctaaagtcttggccccaggacagggaaggaggctcactccctgaaagtgttcactcaggccaggtgcagtggctcatgcctgtaatcccagcactttgggaggccaaggcaggtggatcacttgaggtaaggagtttgagaccagcctgggcaacatggtgaaaccctgtctctactacagatacaaaaattagcctggcatggtggctcatgtctgtagtccca

SEQ ID NO: 114171 - DNA, 767 bp, Homo sapiens
ggctcacgcctgtaatcccagcactttgggaggccaaggcgggtggttcacaaggtcaggagttacagacaagcctggccaacaaagtgaaaccccgtctctactaaaaatacaaaaattagccaggtgtggtggcacgtgcctgtagtcccagctactcgggaggctgaggcaggagaatcgcttgaaacccttgaacccaggaggtggaggttgcagggagctcagaccatgccattgcactccagcctgggtgacggagtgagactccatctcaaaaacaaacaaacaaaagaacaaaatttgaaatcatcatcactaaataaccactaataccatacatccgaaatacttttatccaactgttttctttatattttctttaaataatttatttccctccacatttataaaacaatcatatatccctaaataaacataaggttccaagaaacaaccttctatctgtgaccattctctcaaacagcctctacagcttggtattcttattctatgatagtcagagcattatataaatactccaattgtaatagctacagagctctagacttgcacataacacctaataaaaatactaacagctactactgaattcattcaagacattctaaatatattatctcattttgttttcacaagatccttgaatagcaagtattgtttccttctttcaaaagatgaagaaattcacattgtggtgtccttttggttaataaaggctttattagaacaggagaacacatctg

SEQ ID NO: 114172 - DNA, 694 bp, Homo sapiens
gtaaggacacaagcctgagcgggtcctggcagctggtgtgcaactttcaggggagccacgtttgaggatgacactgacatcagagggaacaataaagagacagaaggaaaatgggtcactggcaatagccccaggctcctggaccagccagcccagacatctgccccacctctgggctttccagttgaatgagccaatcctttcccctaaaatttatgtctatttgagttggtgtttttgttacttgcaaccaagtaactgactggtcctgaggctttcttcaggtctctgggccgccccaggagcctctggttaaatgcccactttttgcctaaattgctgcagtacaggaatttggccaatgactcaacttgccgaacttgcccaccgcctccccagctctagaatggggataattatatacacttgattgagctgttaaatggattaaaagtgatttaaagactgtctagcacactgtaaattctcaacacgttagcaattactattcgaaagcactgaagggtagctgaaaagtcccaatcccagtgagcaatcagccacatccctcccctgtcttgtttgtagttcctttgttcaggtcaacaagtcccctcctcacaaacagtcccagagaacagctaacccagtttctgtcagaagggtggcaaatctggcctgggggtgggggtgg

SEQ ID NO: 114173 - DNA, 201 bp, Homo sapiens
ttgcaaggtggaggaaggaataggatcatgagtcgaaacagaacatgtgctcctccccatttccctcaaacctcagcatcagcctggcccattctgttttctactaacttccatgatagagccagagtgggccaggaagcacatactgacagtgggaaggagatatcaggaaatcttgttctaatccctagagcagagctg

SEQ ID NO: 114174 - DNA, 435 bp, Homo sapiens
ggccaccagcgttccccgcaatccctgtcctcaggcataggcccttctgctcttcccactgtagagcagcacccatccccaccaaacctcacttctgggtgtgacttcataggctgtcgtgttctgcagtaccctcgagtccgaggctgttgagtctgaaggatcctcagaagactggcctctttctgatggtttatggactatggcaaagatgaggaaatggtatttggagaccacatactgggccctaggggtgctctttgcaactgcaacaaacatggacagaattgggaaatttgtttttaatggtaaaaatacatgatgaacagtaccacagagattttatttgatcttactgatcttatgccatactaaaaatctcacttcccaaccacaccaagctaattcattctatacatacaacaaagctaatac

SEQ ID NO: 114175 - DNA, 591 bp, Homo sapiens
gggtctaccttgtttctagcccggaaccctagggcaagagacaggggtgtagtgaggggaccctagaagcctcaggcatctcagtgcctcgttgctcccattatagtaaggaaagaacagcacacctgggtcagagtatattcagcttaggagggaccttgagggtcacagagtccagtgctccatccaaaggttacaggctgaaagacactgggtgggtgagtgtgtgggtcacccaggcattagtgggagacactcagaattattggattttttggagaatagtgtaatcataggagcgcttccccttggccatctcaaaggccagaagggaagcctaagctttagcacctgaccacgctgtgctctccaagccactgatcacagcctcccattccacacttcctcttacaccatctgttcatgagatctgtccagacatccaggctgatccatgaagaatgaatgtcttcagcctctgtgtctcaacctggctgtcacttagtctggatggcctgcccagagggaaccaagccctgtgcccagagcatgtgggagagatgtggagagtcagacaaggtcagggccttg

SEQ ID NO: 114176 - DNA, 166 bp, Homo sapiens
tggatgtctactgcacatctcaaacaggtccaaaactgagcttctgtttcctccccactcaaactgggactctccccatcttcccaattttagtaggcaaggcctaacctacagtcacttgctcaagccaaaaccttcaggtgatcctcaattcctcttttttcct

SEQ ID NO: 114177 - DNA, 702 bp, Homo sapiens
ccactagtctctttccctccacaagggagaggctggctgagctgtattaacctctgtatgctgcaccatgagtcctggagcagtagcaggtcaggtcacccagctctctctctttcccagtgtcctccaggcatctagagtatgctgtgttccatcagcactccaagacaaagcagaaacgagtccctcagacagcctcccaaaagggcagaatgttggacacactttgctcttctcttttcccctgtataggagaggccgccaagatgtattggcctctgttggactgcagatcctctacagcagcagcaagctgccatgcttttgttctcagtagtccccaggcatctatggtatatcaagcctttcaatgctcaagacaagagaaacagtcccctgggaagccccctgaaaaactggaaattggattcaggctccaactctctccctccccagggaaaggcaagagccaggtgttttctcccacttgtttcacactgagctggggcaatgggtatggtgacagagtacatgccaatcccagtctcctcttttgttctgagtggtccctagactgatacccttttcagtcagttcctaaattcaggcaagagagaaactaatccctcaggcagccccctgaaaagtctgcacattgggcataggtattagtcttctctttgcctccccagggagaggtca

SEQ ID NO: 114178 - DNA, 430 bp, Homo sapiens
atttttaaaaattaatgcaacaatgagagatgattgttgatgctcattattaaatcatttattcatcccacacaatgattcagaattattcatcaagcttgctggaaggaagctgggttttacctccacggtggtttggggagagatgtgctctttaaaagggtattttataacaacacaattatcataattaaaagttaccctgatattctgatgagcttttgacatatttttgagtactggcatttcagcacaaggagataaatgagactgagacagtagtagggaataatattgccatggggggaagaaaacaaaggcaatattaaataccagctgccatcgtcacccccaattttatcccagcctttaagttaatgaattttacaaaatatcacttgaacttctggctctccaaaatgagttccaa

SEQ ID NO: 114179 - DNA, 144 bp, Homo sapiens
gtcagtgtctggcccttagaggtgccttgactcctgtgagggctgagctgggtcacagaccctggtggggacacctcaaattgttgtggcatcagcctgtcaggggcccaggagaggcaccaagccactggggagcacgaggta

SEQ ID NO: 114180 - DNA, 126 bp, Homo sapiens
attctccttctttctgaaacgccatccaagacacagtccatttctcaagctttccttaatccaagtatgcttgcattctataaacctctctctgctgcccttcagcttttcatggtgtcaactgaa

SEQ ID NO: 114181 - DNA, 257 bp, Homo sapiens
tctggatcagagaccttcaaaccatgctgctcccctccagggataccccctgcccgccctgcagtccagatcatagactaccatccacagcccctccagccccggacccccacctcagccagagacccctgggccctgccacctcccacttcaggggaaccccccccggcactgggggatcctcctaggagtcgacccttggcaggcatttcaaggctttgggcacttgggccgtccggttttaccaacggttcttg

SEQ ID NO: 114182 - DNA, 755 bp, Homo sapiens
taagttttgtttttcctacactgcttttctttttttttttcagatggagttcccctcttgtcatccaggctggagtgcagtggtgcgatctcagctctctgcaccttctgcctcccaggttcaagcgattctcctgcctcagcctcccaggtagctgggattacaggcacccaccaccacactggctaatttttgtattttttagtagagatggggttttgccatgttgaccaggctggtcttgaactcctgacctcaggtgatccacccatctcggcctcccaaagtgctgggattacaggcatgagccacgatgacagggctacactgtgtttttcttaaagggacacatctgcatattgtcctcagtcacaggttactatacaacatggtgactatggttagtaacaatgtcttgtgttttgaaaattgctgagagtagattttaaatattccaatcagaaaaaattataaatatgtgaggtaatgcatatgttaattagctcatttgagccattccacaatgtatatatattttgaaacatcatgttctacatgataaatatatccaatttttatttgtcaattaagaaaataaaggaaaaaagtaccacttaaataaaacttgcttaaaaacacctattaagctagacatggtggaagaaattggcaaaaatgtaaaatatctttcttctcactaaacatttttagtttggaatcaaatagccatttaattaaagcattttatttaccta

SEQ ID NO: 114183 - DNA, 850 bp, Homo sapiens
gtgactcccccaggttgcccgtcaaggccgtgctgtgaccgttctcccggccccagaactcatggtttctccaccagcttgtcacctcaaagagtaaaggccagagaaagacctgttgagaattcagatgtggtgttgattttttttcttggtcatatatttgcaatatttgtccttcagctttgcatttgtatccacgagtgacagtggtgtgtagggtttttttggtggagtaccgttttcctcaggtttaggaataaatgttatgcttgcctcataaaaggaagtaggaagtttacttcatttcccatggccccctccccgtgtcttctcctcccactggcccgagtttacggcactgagaaagggtgcgtgcccacgcgtaccacacaccccagagcacgaaggctgagaatgtaaccgaggtttccaggactccaaagcccagtgccttctgctacgcacttgagtgtctccacttttgataaacacataactctcatgtcctttttccctggtacttaaaatttcaaggtaaagtagattccttagttatctgcaaagagaaaatttaattttgatcatgaaaactacaaatccttacttggatcatgagaaataaaaagtctgcaaactcacccattcactgggtcaaaaagccttgcctgtgccattttgtttttcctttcgagaagataaagatggcaagaaaagcaaatagaaaaaagaaaatattaaaaggcacatatcaaatataaactcccacaccccacaaagtgggagtccagctttctcaagtgtgaaaaggctaaacgctggagaccacctggccacacagcctcaactcagc

SEQ ID NO: 114184 - DNA, 243 bp, Homo sapiens
gagtgggggctgaggcaggagactcactcgaacctgggagacggaggttgcagtgaggcgagatcgcaccactgcgctccagcctgggcggcggagtgagactccatctcaaaaaaaaagttcactccgaatgcgttagaggtctgaatgtaagggcgaagactatgacactcttagaagaaattataggattaaatgtgacaattgggttaggcagtgttttcttagatacactgccaaaaa

SEQ ID NO: 114185 - DNA, 192 bp, Homo sapiens
cacaaagcactcacctggagccctggacttgtcatttgtaaccagatgatgccctcttcagctttactcttctccagttctctgagactgtgaggtccgggcactgtccattccaactccgacatgtcagccatggctgaatcagtgcttctccatccatcttcttttcacatcggaattgctagaggagct

SEQ ID NO: 114186 - DNA, 181 bp, Homo sapiens
tcacaaattaatgcatgttgcagttattaatgtacatatcctaggttcctgacaggacggcaagctcccagattttatgtgactttattctgcctcccttttcacaccctcacagtgagcacctggtacatatgggcatgttaaagcctgttaggtgaatgaataaactgatggatgaaat

SEQ ID NO: 114187 - DNA, 650 bp, Homo sapiens
gggctgctgaagagacagaggtctggatgcttgtccagcgtcacacagtgggaagggttggcaccaggattcaagccctgattgaccagctctggatttgtgtcctagcatggagacaggcatagtgtaaactcagtgcctcatcccccaacccagctggcaggagaggctctgcccccacctgggctgggcaggggtgccggagagcgaacccccaatacctggggctggcctgatgtcaggagacccgtcactgccccttcctaggacccaagctgtccgcttccctccccaggccctgctgtccttgtctgcaatggaggagggtggctctgtggcccctgaggccccctctcctcgggcctgctgaaagagcactgtttcggggccatcgtggcgatgctattcacccatttgtttggcaaatgtttactggagacatggctggcctgtgccttggggccactacagggacaggacctccaggaccctcctcccggctcgggcccagcagagacggtggacagacccccaggatccgggcccagcagagacggtggacagacccccaggatccgggcccagcaggggcggtggacagacccccaggatccgtgcccagcagtgacggtggacagacccccaggatc

SEQ ID NO: 114188 - DNA, 494 bp, Homo sapiens
tcattgcttaggctggagtgaaatggtgtggtctcggctcactacaacctctgtctcctgggttcacgtgactctcctgcctcagcctcccgagtagcaggtattacaggcatatgccaccatgcctgactaattttctatttttactagagacggggtacctccatgttagtcaggctggtctcgaactcccgacctcaggcgatccacccaccgcagcctcccaaagtgctgggattagaggcctgagccaccatacccagcctctatgtagctttgtaaaaaatccttgtagctgtctcttttaggaataaaatgggaggcaggtttgtctgacacagttcccagcctgacttttctctttggcttagtaatttttaagcttctttcacaaccttctgacagacataatgctttgacacactgatattggtttatatagattttccaaaacagtaaagtccaagggtctatcctgaactgggttagcggag

SEQ ID NO: 114189 - DNA, 417 bp, Homo sapiens
ccccaacccagcatgatttgtactgagcaagaggattctaagggctttgtgtagcccacgcaaggcagaggaaagggtacaggggctgcccttgtcccccagctgccagagactggatcctcacatggagccccgcccggtttgtccccaccagggcaggacttggataaaaagtctcaggagaacaaagaccacattttcccctgtgaagcagagaggccactgccggggaaacaatggccttgctgcggatcaaaggagctgggcctgtgctggggacaaaagctgagtccctgcttgataagactgacaaccggctcttcccctccttttagaaaagtctccagagagtccaccccaccttcccagcctcacttcttttcagctaagttccctagaggggtgggtggagagcgg

SEQ ID NO: 114190 - DNA, 273 bp, Homo sapiens
ccttcttgatgggttttggtccattgttttccattcacattcaaggagactgggtctagttctcccttgaagacagaatattgggaaaatttttttggaatttctagaattaagttttagaattaaacacatccctaaaacttctaaagaaggtaatgtagtcaaatggctaagaagggttttcttagtccaagatttatctcctcatttactggttaattatacaggctctggcattattgagatctaaatttgaatctcaactccgctatt

SEQ ID NO: 114191 - DNA, 331 bp, Homo sapiens
atgctgggattacaggcatgagccaccatgcctggcctgttcctgttaacttttattcaagtattttagggtcttctgagtgcagagcatgggggcattgggaaaatacaaaaagatatttattcttttgtttgttcttcaccagctctataaccatccctatgcttagtcctgtaatactgagatgcataagacatcatccctgtctccaaggatcttaggtctataaaatgcaattcctgctctcagggagcatactgtctagttacgtcactatattagtcagcagtttttcagtggcaaatgacagaaacccaactcgagctggctt

SEQ ID NO: 114192 - DNA, 155 bp, Homo sapiens
agcgagggcacctctggaatgagggtcttatgacttactttaggggaaggtcagaaaattgttttatggcctgtttcaggggagaagggtgggaggaggtcagaaaccttcctgcttctgctactttctcaaataccaaggtaccatattttggg

SEQ ID NO: 114193 - DNA, 281 bp, Homo sapiens
gagatgggtttccaacttggggactccctgggttgggaggagaattgaggagaggagatggagaagagacatgggtcagaggtgaagccaaatgtgctggttggactgagagactgggatacaaagagagggaagctgcttgagagctggtacaagagggaaatggtgaatttgattttgaatctggcaggaggattgagtgtttggtgacacagcccaaagagaattccaacacacagatgtaaaattccatttagacgagagagcaatcctgcagttag

SEQ ID NO: 114194 - DNA, 446 bp, Homo sapiens
gcaaatattgctaagcaacggtgtacttgagagagcatttttaggagcagagccaggggagttatgcctgggagcactcactgcttcttatggctcagtacaagggaagagattcaaagttctttcctgtaagggccgccattgcagccgccagcacacgagacagtgacctagtggcaccgattagggctggcaaggggatgtgtgaaaacaggaaagcttttttgccatgtgggaaggcagtaagacatgttcacagaggtgagtgccccacagtgtacagctgccccacagtaagtatgcagcagctggaggttcaggtggggaggatggagggtagggaaataagtgagaggtgaggccacaagagaaagttgatgtgtcttgtttctcttcccccttctcttcttttcttttgcccccctgtgttaggggctaacatggaa

SEQ ID NO: 114195 - DNA, 366 bp, Homo sapiens
gagcttgggcttaattccaggtatagtagagacctgccaaagggccctaaagtggtggatggcagtaagtctcactagctgaactgtagaatctcctttgtttttgtaaaattcatattttactctgatttcctttaggctctaagtgaagtgtacagatcttaactgtataggtctgtgagttttgtcaaatgacggatgcgtacctgtgtgtaatccacaccatgaggatatgggacatttccatcagcccagatatatccacagtgcccctttgcagtcttcctagtcaaccactgttctgattcctgagccagcctttgtaactgctcatgaaaatgacacatgtgcattgttattacagtg

SEQ ID NO: 114196 - DNA, 377 bp, Homo sapiens
tgaactgaatgaacagtgcatttggcattgactatcccccactggatgtccttagtggctgtacgtgtacagagcagaaggggaacaaccagggcaatctgggcttctgaatggttccattcattccatggaggcataacctcctgcctgacagccttcccacatccatttccatttcctccctcgttccccacagctctgcaacttcagccttccatcctcctgccatgtgggctatatccaatccaagtttatttaggcacagtctctttcttcatacacatgtgtatgttgggtttttcaaggcatccagcattctttcctcaacagctaccttttttccacaattgacagcatttggactcaaacagaaaaaa

SEQ ID NO: 114197 - DNA, 323 bp, Homo sapiens
gctcccgcttccacactcagtgcccttctcactttgttcagtcttgggttgcactgggttgctttccccatcacctacgataaatgatgaatgccctctgcatcccagccttgccagacaccctgccctggcccttccttcctcagcaatgccctccttgggcccttcctgggctctgactctccacaccgggcttcactcccaccccattgctgcaggttcacgctgttgagtctctgacgctctggtaccaggccatacatggatgtcctcaccttgctcaggctctgacactcacactgggcaaccttcctacacagatg

SEQ ID NO: 114198 - DNA, 379 bp, Homo sapiens
atttttagcaagtcattcttcaccaacttttccttccatctgatgccctactttggtttaattgaaattcattagagacttaaattttatgtaattaacagaaaacttaagaaatgcgcagtagctgtgtcagtagttataggctgcaagtggttactctttaattgctgtcataatggcccattagtcatgcctctgaagaggtgtcagatgcttttttctctttctgaaacatctgtgttatttaataaattgaataagcaagcagagtttgcacagaatactaagtaagttgaataatcacctttctagagacattctttgaagtaatactactctgtgtgcaacatttttgtgctacccttagtaataaaacttg

SEQ ID NO: 114199 - DNA, 248 bp, Homo sapiens
aatatcaaggcaggctcaagtatttccaagcatgcttttagtgcagaaagacacatggggcaggggaaggggaaaagggtggcgagcagagctagcagtttatctctatggtgggatgggacacgtctccggaaagacagcagagggtttggtagagggaagcagagatcctgaaacgacatgagatctttgttgtaaataacgtctttctgggtctggcgtggtggctcacgcctataatcccagca

SEQ ID NO: 114200 - DNA, 412 bp, Homo sapiens
ccctgtcttggcagaaactggggtcctttggcgatttagcctgaaaagcagcccaaggctggagggcttatgtatgctggggtgctggggaatgcagggtctcctgtacttgggaacgccatcaccccttctactcccacacacagcacagggctccatcacaccagcctccccgacacccccttccttctcacacacccgagatgccaaactgctgccaacagttatcttgctcgtctctgtcccacagctggggcctgcagcaggtggcacttcacatcactcacttgatgaggctccctcatcaagaccctcccatccctgtaacctggccctttcctctcctcttcctttatttttcctgcgtcattgtcattatctttttctcaccctcccaactatctcacaccat

SEQ ID NO: 114201 - DNA, 314 bp, Homo sapiens
caacatctcattattattatgaatttagttttgaacccaccgatcccttgaaaggatctcaggaacgcccagggctccctgacccacactttaagaactactgcaatagacaaactcctaccttataatcaaggagataaacaagaactagaaaagaaaaaaaaaataggctgggcaccgtttttgtaattccagcactttgggaggccaaggcggatggactgcttgaaatcaggagctcaagaccatcctaggcaacatcacaaaaccctgtctctacaaaaaatacaaaaattagccaggcatggtagcat

SEQ ID NO: 114202 - DNA, 323 bp, Homo sapiens
ttggtgtcttcagagaactggaaaatgacttgatgtggaaaatgcacacattttgtgccagaaatgttgtgagtagggaaaaagttttgtttttagggtcacgactcaaagactttgtaacatcctcagtgaaaattcctggctaccaatggccactcttggtcattcccaactgtcctttagacagtgtccaatcacctggctcttcatcgtgccagggtgcaaagcctttctactctctatgtccaactgttaagctcttccctccgtcttatcctcaaactcacaatcctaaacccaataaaacaaagcactgcctgccc

SEQ ID NO: 114203 - DNA, 414 bp, Homo sapiens
agtgcagtggcctgaccgtgatgtaaccgagtacccctactttcctaagagatggtttaattatttctctctctcttctttttcccccagttccccacttcccctttagaaatgcaaatatagcctgttatctcccctttagcagactctccctgtagggcaagttcatctacccgctaacatgcccagcccttagagacttcttatttatgtctcctaagttaaaaaataaataggcagttgccaatgaggattggagggctgatacaagaagtccacagaagttgggtgtcctgggcatggtgacatacacctttaatcccagtgccttgggagaccaaaatgggaggattatttgaggccaggagttgcagatcagcctggtcaacatagagaaactccatctctaccaaa

SEQ ID NO: 114204 - DNA, 742 bp, Homo sapiens
gagctggagaggagctgaatcccaggtcagtgattaactagctatataaatttggcacatgatttaatctttctaatctcaatttccttctgtgtgaagttgagataatatttcttatctttctgggttatttgtcaaatggcaagcaatatttgtaaagttcctgattcataataaaagatcttcaaatagtaactcttgtttggatttccttacctaaatcctttatctgagccctttccagcattctatttttcagcaagatatgtaaatggcttaagaaaattggctcatacattagatatttttaaatcaagttttcctgtgtatcctgtgacttaatcttctagatctatcttatatatcatcattgagaatgaaatatataagaatagattatcaaaactacagaattgtttttatattattgaaatttaaaatatttgggtaattctctatgctagtaaaaaattaataatataaatcttccatcatatcccactgctgcttgagctcttttacaaaaagtttttgaaggagataaggtgatattattaataccaccttgcagaagaaaagaaattgggacccttaacaggtaaaaggatttaatctaagttacataatcagtactggatgtgctgacaagacatctcagcctctggcattcttcacatgttatataaatggcatagtattgggtctctaacttttaaatttaccaatagcataattttgtgta

SEQ ID NO: 114205 - DNA, 429 bp, Homo sapiens
gggattataggcgtgagccaccacgcccggctgagatactttctctaaataaaaatgctcttgctgtacttgaaaatattattaagctgaggatttcatgggtctgagaggactgtgcgtctgactttgtataagttgtcctaccatcagtggagtttgtaagcattgttttttttttaagacagagtgtcactgtcgcccagattcgagtgcagtggcacaatcgtggctcattccaacctccacctcctgggttcaagtgattcttgtgcctcagcctcccaagtagctgggattataggcgtgcgtcaccatgcccagctaatttttgtatttttttagtagagatggggttttgccatgttgcccaggctggtcttgaactcctggcctcaagtgatccgctcacctcggcctcccaaactgctg

SEQ ID NO: 114206 - DNA, 411 bp, Homo sapiens
tgctaattaaagataattcactcttggctgtatgtggtggttcaaagtaatccctgcactttcggaggctgaggtgggaggttcatttgagctcaggagttagaaaccagcctgggcaacactgcaagacctagtctctattaaaaatcaaaaaagttagccaaggcatggtggtggcaggcgcttgtagtgctagtgactcaggaggctgaggtgggaggatcccttgaacccaggaggtcgaaactatagtgagccgtgattgtgccactgcactcttgggcaagagagtgagaccctgtctcaaaaataataataataataataataataattcactctttagtattttgatgtaatttagaatttgaacaacctcatttatatgtctcttagctgttgatttagtta

SEQ ID NO: 114207 - DNA, 406 bp, Homo sapiens
ccgggctgagagagactgccttagtggcaaggtgaggaaaaagcagtgcctgccctgagtttgccaacccatggggcaaatgcagctgtcaccctttcacaccccaggagaaactgaggaactcacctagggccacaggcttgcaggtgtctgagctgagctaggaaccctagcccaacctcactgcaaaacctagattccttctaccagagcaacggtcttcagactgttttgatcacatatcctactggtgtgcaatttttatcacaaaccctcattgaaacgtgtctgtttataaattatatacttattctgttgccaatcactacaatgcatatgagtatgcttaatctctcttttttcttttcttttctgtttccttcttccctccctccttccttccttt

SEQ ID NO: 114208 - DNA, 710 bp, Homo sapiens
agatgagtggtatttataaagaaataggtcaaaaagggaaatgtatcaatgcatagccctgtggttggtaattgtgtatgctcagctttataactgcagtcatttgaaatactttaagaacaaccagtgtcttccactggcttcactcagatgctaatctctggaaacacttgcacagacacactcaaaacactaataagtttctaggtgttccttaatccaatcaacttgacacctaaaattaagtcccaaagaacacctcttatcaactcagcacccatacatacctccttaaaccgtacttaatttccaaataaagacaatgagaaagttgtagttctacctatcatgatgccagtatcctctgattgtgatttttgggattttagacattatggattttagattaggcattttgatcttttgggatttcaccattcaggattaaggtgttcgagattgtgtcttacaggattataaaccaaatccctttttgggattgggtttgttttgccccagtcagccttattcttcagagattcttccagtttgttgctgtatcaatagttcacttttattttattttgttttatttatttatttgggatggagtctcgttgcccaggctggagtgcagtggcgccatctcagctcactgcagcctctgcctcctgggttcaagcaattcttctgcctcggtctccctagta

SEQ ID NO: 114209 - DNA, 826 bp, Homo sapiens
agcatgtatttatagagagaatggagggattctaaggagggagcaaagtgactataacaagattagggacaagagacttcaaccagagagttctgtgatcaattccccgagatctctgcatcttctgagttttctgcttagaatcagggaagctcagtgcttgacaggaacgagcagtggcactctcagtttcactgtgttacaaaggagccctgaggaagggaggccgctggctgcccaggtgccctggggggaaagggacttctgctgctgcagagagtggcacccggtggggccaggggctctgggatggtccgtaaagctccccaggacttctttgaaggatgctttacagaatgtttctgggagaccagcctcaaggtcaacccatcacaaacgtgaggaccaggaaggaaccatggccagggttctccatttgctgtagagtatctggtgatacagtgagacactaaagagtcatcagccagttcatctttcctctgccaataagagtggatagaacaggaatgaagtgttactggtggtatttcaggcatcaggagccttggaaaatcatcgtaggggcccatgcctgtctgtccctaggcacctgggcagtgccacagaggcccgcccacgactggccaggggacagaactccagtagtgcatccctgtacaacctgcacataacggttatgtatgttcacctaaaggagagaatatactttctattcctattgcacaaaaaccttgtaaactttgagaggtgctgaaaaagccaattctgcaagctctcctagaggactgacattgtaacattagag

SEQ ID NO: 114210 - DNA, 191 bp, Homo sapiens
gacagagagatggagacagagagatagagacacagaatcggcgggggcgcggtgcagagagagacacagagagagagtgtgagccgtgctgaggggtgggcccccaggagcccaggggcgccccaccagcaccagcccaaaaaggtgggcatgaccctctgggaagcctttctgtggacccggtctcagag

SEQ ID NO: 114211 - DNA, 1203 bp, Homo sapiens
acaattctcttactaaaagtattgtaggcaggcttgctttctgaaggctaatcactatttggctttgtggaaacagaactttcctcccatggtcacagactcaggagatggcgttggcaaaatcacttggtcccactgggattctttgactcctgatcttgaaaattatgataataaatgcatcttagatattcctatgtaattagtgatgatgatcgctgtataatatattcaaaggaatgtattattttaccataaaataatgtgctacgcataaggtagtccttatctagaaagactatttttatttttgtttttttgtttgtttgttttttatttgtttgtttttgagacagagtctggctctgtcgcccaggctggagttcagtggtccaacctcggcccaccgcaacctccacctctgagttcaagctattctcctgcctcagccacccgagtagctgggattacaggcacatgccaccatgcctggctaatttttgtatttttagtagagatggggtttcaccatgttggccaggctggtcttgaactcctgacctcaagtgatcctctcgccttggcctcccaaagtgctaggattacaggtgtgagccaccgcgccccgcctttttattttgttttacaatacaacaaaaaatttttagttttacaataaaagagaatctgattattggaaatagacctgaatagctttttgaaatatttatagttctagtatttaaagagaaacctgaaattataaagctgagttaatttctatacctgaaatgttcatttgtctgctgaattcagggagcatttgagatgtcacattttggaactttgatttaaatagttcagtattcccaaggctgagttccatgaccctggaatgagaaatatccactgtacctctggttctgaagagtctatagtcggccaacactgtgaatgtgtggaggactaattgtcactttcatgttatttgccaccctgacagctgagacactgcttttcagcattttagttaagatttgctttttaactgtgcaataatcattttattttggcattataaaataaaaatcacaacttctgcttttcttatatgctttgtgtgttatcacacaaatattctcaaatattcataagatattttaaataaatcattgtgaattagtcaatatatcaagttgctta

SEQ ID NO: 114212 - DNA, 612 bp, Homo sapiens
gcccaggctagagtgcagtggcgtgatcatggtttgttgcagtctcaaagtcctgggttcaaaggatccttccacgtcagcctcccaagtagctgggactacaggcacaccaccacacctagctaatttttttatttttatttttgcagagacaaagtcttactatgttatccaggctggtgtggaactcctgacctcaagcagtcctcccacctcagcctcccaaattgctgggattatagatgtgaaccactgtgcctggccaataaccacctttaactctatactttaagtttacctggttttgacatttatagaaattgggacatgcctaggattggaattactgcttcatgtgatatgcatattcaacattagtagattttcttttccttccttccttctttccttccttccttcctcctttccttccttcctttccttccttccttccttccttttctttctttccttttcttttctttctttccttcttttctttctttttttttcttttctttctcacagggtctcactctatctgggctagtcccaaactcctcggcttaagcaatcctcccacctcagcctcccaaaatgctgggattatca

SEQ ID NO: 114213 - DNA, 352 bp, Homo sapiens
gcggccgctctctgaagaacctccgagtacgaggtaagcccgctgcaaccctcactccccaccgcccggcgcccgccacccctggcacttgccttcccctggccctgggttggggagcgagccggggcgctggccggagccagggcagccgcagctggcctgcgagccaatcctaattggggctgtgtgtctgtttcgcgcagggcggaatgacagcggcgaggagaacgtcccgctggatctgacccgaggtaacgcggggcgccgcgggcgccgcgagggcgcgctgctggggaggagccgggtccggggctgggggccagaggcaggggcgggccccgcacgggaccgg

SEQ ID NO: 114214 - DNA, 856 bp, Homo sapiens
agcgggttgtgactgaaacccgtcaatatggcggcgatcggccgcggccgctctctgaagaacctccgagtacgagggcggaatgacagcggcgaggagaacgtcccgctggatctgacccgagaaccttctgataacttaagagagattctccaaaatgtggccagattgcagggagtatcaaatatgagaaagctaggccatctgaataactttactaagcttctttgtgatattggccacagtgaagaaaaactgggctttcactatgaggatatcataatttgtttgcggttagctttattaaatgaagcaaaagaagtgcgagcagcagggctacgagcgcttcgatatctcatccaagactccagtattctccagaaggtgctaaaattgaaagtggactatttaatagctaggtgcattgacatacaacagagcaacgaggtagagaggacacaagcacttcgattagtcagaaagatgattactgtgaatgcttccttgtttcctagttctgtgaccaactcattaattgcagttggaaatgatggacttcaagaaagagacagaatggtccgagcatgcattgccattatctgtgaactagcacttcagaatccagaggtggtggcccttcgaggtggactaaacaccatcttgaaaaatgtgatcgattgccaattaagtcgaataaaatgaggccctaattactacaattttgcaccttcttaatcatccaaagactcgacagtatgttgcgagctgatgtagaattagagagaattatagcacctatactgtgttcactacagacctttccagatacaggtgaaggacagttcaggaaacggga

SEQ ID NO: 114215 - DNA, 521 bp, Homo sapiens
caagattgcaccactgtactccagcctgggcaacagagaccctatctcaaaacaaacaaaaaagtgtatgtgtgtgtgttcggtgtatgtgtaaagagagagagaggcagacaaaaatgttaaactattaacagttgtttaggtgaaggatacattgggtattcattgtaccacttttccaacttgtctgtatggaattttttcaaaaagaactggagggataagaaaagagtaaatgggaagaaaggaaatggaaacaataactaaagggtctgcatgtcttgcaaagagaagcaatgaaatggggcattggagggaaatatgagagtcaaggttttcattttttgtttgaattctgtagagaatgcagctgatagtcatgatccaatacagaggaaaaactgatctagcagagagagggaactgacgatgtagtttctacttacacatcaaagtctggctccttaataacaaggaagttattatttctaataattccatccaaaaataaattgttaaaa

SEQ ID NO: 114216 - DNA, 909 bp, Homo sapiens
gtggactccacagagagtaaacacaaagactttacatgctaacgttcaaagacagtttaccccaacatcattcattgttttcattattccagaggtcatgggggcttcagaaaaccaacacaatctgaaagaattgcttcttgatttcagcttttcaagtttgattgttttaacaactagaaagtcatttgaaacaacccagacttaactttgctactcagagatagcattagtttttcaatccacatttgacccaagggtgtactgaccagtgggcacagggaaggagtgggagtaaggactgtggcttctaattctggtcttgttttgccctataaagtgtgttagatcagcctcagtctccctatataagacacaattaggccgggcgcggtggctcatgtctgtaatcccagcactttgggaggccgaggcggaggatcacctgaggtcaggagttcaagaccagcctggccaacatggcaaaaccccgtctctacaaaaattagctgggcatggtggcgcacgcctgtaatcccagctactcaggcagctgaggcaggagaatcacttgaacacgggaggtggaggttgtagtgagctgagatcaggccattgcactccagcctaggtgacagagcgagactctgtctcaaaataaataaataaataggacacaattaaatcaattggtgttcttaaacaaaatggcctaagggtcagaaaactgaaaagcgggtagctgctccagtagtcccctctccatgactcctgggtattgccagctttgggggatgggaaagaggtagggcttgaccagaattctccagcatgtacagtcctattcatacacatgcatgcacatatgtgcacacacacacacgacacacgtacactctagtgataaca

SEQ ID NO: 114217 - DNA, 739 bp, Homo sapiens
aggctgctttccaatttttcctggttttattgtcctagaaatagagaaaagcacagtatagcccagtatgacaacttaagagtaaataatcacatatgaaattgttcaaaatcttacctttttattccatacaaatcactttacaatcaaattattgtcaactcttattttgatttcgataggcttcctagtgctcatggttataatttataacatccctaattgtgctgtttagcctgtctcaccctatatgtaagtctcctcataatttcttatctaaagatgtgacaactcatttgtgtgcctctcatggcaaattcatattgctaaacattcatataatcatagaattgtaagatactttattttgtataatcctttcattgtaatgtgtttcttttttatgtcaaatgtgatttttgagtggtctggctgcaaagtatagtgggcttttctgtgtatttttatcaaatcctgcttttagattccagattatacttatttgaggaaagttaaaaattgacaaaactattcgcataacagaggaacctccactttatttttactaaaataaattttaaaacacttttgttttccctttatattctaagttatgtaaatttcatttctttgaaatatattattttatttgagctttgttatgttacctttgtagaccttgttttaaaaaggatcctcaggtttttagagtattgagtatttgatatcttttctgatg

SEQ ID NO: 114218 - DNA, 718 bp, Homo sapiens
gggaaaacaaagtacttatttattttaccaagtaacatgaacattaccacttttcctttatggtatttttctatattttctgaagttttatatgcttttcttttatatgtgctactctaattaagagtatacacaaaattttatatcctttttccaactcgactatttcatcctgttattacattgtctttattctttttagtggctaagttgcatttcatcaaataatatttcaacagcagtataatattataatataatctttattactggatgtttaccttgctcttgattttttttttttttttttaagacagtgtctcactctgtcgcccaggctggagtgcagtggtgtgatctcaacttactgcaacctctgcctcccaggtttaagcgattcttgtgcctcagcctccggagtagccagaattacaggcacgtgccaccatgcctggctaatttttttgcattttttagtagagatggggtttcaccatgttggccaggctggtcttgaactcctgatctcaggtgatctgcctgccgtggcctcccaaagtgctgagattacaaactgtgagccaccagcctggccctctgttaaactttctcaacagggaaaatccatgagttatatttaaagaccataatataagcagatatagtttccaacttcactgggttagagtagaatatggcactttcaacgaaaaacaaa

SEQ ID NO: 114219 - DNA, 372 bp, Homo sapiens
actgggtactggctgggatttgccctttcagaggtgggggcaggaggacttcccctcccctggaccctgtctgatctctccttaagtaaacagaatctcaccctttgggaatttggccgtgatcctgtgtgctccaggggcttctggtgagaaacttaggaggactaggggagggaggaagagctgggaacagactgcaccctagttggggacagaggaggtagagaaggaccaagctagggaccttttaaccctcaggattttgtcattcagaagctgctgcccctgccagaactgatccattaaaacacagggcagagggcataggtgtgtggtacctccaagcctcccaacagtcaggtcagatatctg

SEQ ID NO: 114220 - DNA, 484 bp, Homo sapiens
ggcattctatggtcttatctagcaccaaagcctgaggagatccctgctgtcttcagctgtctgtccacactggttagggatgaggtgctcatttactgaactggcatggtatcttcagttcctttgtccctgctgcttctatccaaccctctgggtagtggaatgtttgccaagactaggcaaccagcttcccccggcccatcacagagtcttctttgggtcctgatatgaagaaatgctcatgtctctgccactgaaaggaagtatagaccctgacctctattctcttgctgccctaaaatgccctccattcccatccagggacatctggcttgatttcatcaatgaatataatccttttcagaatatatgggctgggcacagtagctcgtgcctgtaatcccagcactttgggaagtcgcaggaggattgcttgaggctaggagttcaagacaagcctgagcaacatagcaagacccaattt

SEQ ID NO: 114221 - DNA, 582 bp, Homo sapiens
ggcatcttccaagctttgaagtaccagaaagcagaagtgtctcttgctagctcgattgaagcctgtcgccatgttatgagctgccctatggagagacccagatatcgagaaactgagggaggcctccagctaacagccagcaaggaactgaggtccttattccaaatgagactcttactctgggactccaagagggattgaattctgcctaacaatcacttgggcgagctaaaaagttgatcatacctggtggagccctgagtgatcactgccccagctgacgcctccactgcagcctcagggagactctgacgctgggggcttggccacacagtgcctgggttcctgactacagacttcatgagatcatcagagttctttgtttcaagctgctaggctttgagttaatttgttgtgtcttttaagataatgaatacttcatccagtccaatttctgtattctcaaagagctgatggagacctggagaacgtcagtccttttcctacgctctcacacactcggaccagatttgaagccaggcccctgaatttcctggcctgggccctcccatctctttgaat

SEQ ID NO: 114222 - DNA, 270 bp, Homo sapiens
aatcaatctacaccctcaagcagttgtagtctgctggaatgacagacttaaaaatgcttataactaaaatattttatgtgcaggactagggttttaagctaaaaggctgctttttaaattgtgaaatataaagtacatgtagaacaatgcataaaacatgtcaacagttaaacagatagttatgggattatactttgtgtatttttatgtttgcttcttttattcaacattctgtggttcatctgtgttgcttgtagcatcatcattact

SEQ ID NO: 114223 - DNA, 374 bp, Homo sapiens
acctgcaaaacggcaggcatggcactaggtactagagacacagctgttagcaaaacagacaaaattccttgccctccatgggcccacatgataataacaggacccacactgtaaacgaatacttgaatcatgcaagctactgtctgtgggcgctttagatatgttgaacactgagtcctcatgaaaatcctaggaagaaagcggtataatgtaacctgtcactagcccagatttctcttcagtgataactaaggatgagaaatttgccatcaaagtgttgcacttttctctgaggcccttggacatgatttcagcactgatgatttttctcttgtaactcctcaggcatttctcacaagagtggcaaagataca

SEQ ID NO: 114224 - DNA, 428 bp, Homo sapiens
gcatttataatagccaaaatgtggaaacaacccaaatgtccatcagtggttaagtggataaataaaatgtgatatgtccgtataatggaatattattcagccataagaaggaatgaagtactggtacatgctgtggcatggatgaaccttgaaactattgtgagagaagctagtcgcaaaggaccacacatcttatgataccattcatatgaaatgtcccaaataggcaaatgaataaagacagggagtggttgctagggtttcatgggttggtagattaggaagtgatgactaagggggccgggtatggtggctcacacctgtaatcctagcactttgggaggccaaggctggcagatcacctgaggtcagcctgggcaacctagcgagatctagtctctataagaaaaaataaaccgggggcagtg

SEQ ID NO: 114225 - DNA, 610 bp, Homo sapiens
gggaacagtttgtctttgggatatgtttgcctttgtcttacaatataaggtgggagatgctgtgagcatgtgtttggagttggaggaaggtgaagaagttggaatggtcaaaaactagaagcccaggtggtttcactatattttcctttcttcttcatcagggaagttaattaatgctaggcttctagtacaatttcgtatggaaaagggaacttcacatttgaatttttctcattaaaaaaaaaaggtagggctgggtgtggtggctcatgccttgaactcctgacctcaggtgatcctcccgcctcagcctcccaaagcactgggattacaggcataagccactgcgcccagccaaaagtgggcaagtttctagaccactttcactttggcctcactgttctcatttgcacatgaggacaataatagtacctttgtagggttgccatgagcattacatgagataacccatgtagaacatttaaacggtgctgggaacatcactcaggaacccgtgagcagggagaaaacattcattcactcactcattcattcatttattgagctagtgtacatggagtacctactgaatgccagccactgtgcacag

SEQ ID NO: 114226 - DNA, 394 bp, Homo sapiens
ctttcaggcaacatctgccaagcgcggtttgtgaggaagagaagcagaggaacacgtcatggagacggaccgagttgaaggagccagggatggtgacaagcggaaggaagtgtgttttgtccccatccagggaagcttttgtttcatgagacttacttgcgcacgtctggtagctgccctggacattcatggactttcgttttcactcagattttgtggttcacgtgacacaaagcatgaggacatcactgggcgagagggccaggtcaccccactgccgaggggcacgccccagctgtgcaccgctagagtgggcttgtccagtcctcggacacggggacagggtgtgcccatctcatgtaagacatgaataatagtagaaatttctgttgca

SEQ ID NO: 114227 - DNA, 385 bp, Homo sapiens
ttcgggaagaaaggaaaacacaggaggaagagaagcagaggaacacgtcatggagacggaccgagttgaaggagccagggatggtgacaagcggaaggaagtgtgttttgtccccatccagggaagcttttgtttcatgagacttacttgcgcacgtctggtagctgccctggacattcatggactttcgttttcactcagattttgtggttcacgtgacacaaagcatgaggacatcactgggcgagagggccaggtcaccccactgccgaggggcacgccccagctgtgcaccgctagagtgggcttgtccagtcctcggacacggggacagggtgtgcccatctcatgtaagacatgaataatagtagaaatttctgttgca

SEQ ID NO: 114228 - DNA, 403 bp, Homo sapiens
tcattcctcatggcaacagccccatacaaccagcaactcagaaaccccgatctgtgaccacatcctcccattctttcttgtaccttctccatttcttcagcctttatgaaataagcacccgcctccatcagacgtcttcatgctctggattccctgttatgcctccacttgtgctcagcgatccttttactggtctttatttgactgcccatgttattcctcccaaacaaggctcttcactttgttttttttaacccttctcagctatgtattctaaactcttactctttgtaagtaatattttattttaccacaaaggcatccccagcttcctcccattcctaacagggaaagggtactccaccttctttcctaacctgtcttctttaatccctttcatccg

SEQ ID NO: 114229 - DNA, 571 bp, Homo sapiens
aacaatgtactttcttcattgttgtgtttcagtaatggagaaagtacattgttcaaaataaaccattgtactttgagaggataggaatgaattttgtctataaagacaacttacctggatagaatttcagtaacttgaaaagcgaagcaagacagaaaggtgaggcaagatttgaatgagggcaaaatgaaagaccaacaacagtattgtttttgcaggacacaaaggaactttctcatacagattttggaagtgatctggaaataggcgagtatgggaggctaaacagtcggctcactagctagaagtttaatgcttctcaaaagcacctgataaattatttttttgactgacatacaattgacatacaataagctgcacatatttaaagtatacagtgtttcagttttgacacgtgcatccacctatgaaactgtcaccacagacaagatagtaaaacatatgtatcactgcccttaaattgggaacaagacaagtatgtccatttgtaccactcctgttcaacattgtgctggaattcctaccaagcacaagaaggcaagaaaaagaa

SEQ ID NO: 114230 - DNA, 292 bp, Homo sapiens
agcattttatctgcattttaataccatttaatcctcactattattatgcccattttacagctaggagaactgagtcacaaggacacaagtggaagttcttgaattaaaaccaaaataagcctaattctaacagctgagctctttgccaatttattttaagtctcatttccctgctgaccaactctcccttcgtcttgcttcaaaaaccacactaatttcttcttctcctattttcttttttttttctgagacagggtctcactcccatcacccatgcgtggattgccagtgg

SEQ ID NO: 114231 - DNA, 491 bp, Homo sapiens
cggcacctcctggcactccctttcagtccaggcagccagttgctgctttgcaggaattgagcagaaatgcactcggaatcgcgggcaggaaaagaagggaggtcggaggctttggatggtccccgaagtcgccgcctagttgagagctgtagagttggtgccactgcccctgttggagtgggcagttgtagttcttgtttcagaactagtggtcagcagttttctttgccggctgttgcaaggctggtggttctggcgttttccgcagtgtgttgggaggagtgtgagatgccgcggtgcagttgtgtgcggcccctgtggccctctgctgttgcgttagccattgtctaacacgtgtgaccgcatggatggtgtcctcatttaatttgaattttcaccagcactgcctaggtagccagaaccataaggtcctgaaatgccgtactattagctgggtccaaaattgagaagaattgagtagtgtaaatgtt

SEQ ID NO: 114232 - DNA, 443 bp, Homo sapiens
  misc_feature (321)..(321): n is a, c, g, or t
gggattgttaaaaggtgaacatttacttaatactatattttcaatagaaaatgacagtttgattttaaaaaaagcaattttgacacttcagaacatccattgaaatcttataggtttaaatactgaatgtgtaaaatatttagctgtataaaatataatagattaaaaaaatagaatgtttatgccctcctccccaatatttatattccttaaatctttcttttcttttcttttgttctcttcctttcccttcccttcccctcccctccctccttccctcccttccttctttctctttctttcgaaagaaagagaaagaangaagaaagaaaagaaaagaaaaagaaaatagtgaaaacgtcctctcacaggcttcattgccattcctcaaaatgtagcctttttatcaggttattttctatctttatagaccggggatcctc

SEQ ID NO: 114233 - DNA, 337 bp, Homo sapiens
  misc_feature (191)..(191): n is a, c, g, or t
agaccaacctgggcaacatagcaagaccctctctgtacaaaaaaatacaaacaaacatggggactatataaaacatgggtagtggataggagttaccattaaaaaaaaataaaaagccctgtcttgtctccaccagtgctctgtggatcctcatctccttggtcaaagccaggtcatgggcaccttatggntacacttcagaagcggaaaagagcatgaagtgtgtgctgcttatgtgtccatgcctggaagtggccacaccgcttctgctcactcttagaacttttagagcaggtggctatttaagcacagttatgattcaaaggagtcccgggtt

SEQ ID NO: 114234 - DNA, 680 bp, Homo sapiens
aacagaaattgacaattaattgaatgtggtgtagtcaggaagaggaagagtccaaaataatttctcagtttttaaattgagtaattggacagctcaggcagtgtgaaacagaaagaataacaagtttgggtgggaattttaggcctgtgtgataatcaaattagagatacttattatgcagttatctgtgtggttatgtagatctgagtatcatgtaaatttagaaaatattaacatatatatgatagctaaagctatgggggtaaataaggcattgcatggctaacatcctaataggggattctacagcaggataatatcagtgaacctaggagagggaaacaatgagggattatctgccttgttttccatttagagtccatctccagcattaatataatcaactactattgaataagcacttgataatatgtaagatgatgtgctaagtttctatcatgctgagaaaggaatgatacttgccttctgggatctttgtccagctaatgaaataaggaatgctctctattatatatgtaggtacatatgtatatacatgtgaaatccactaattcaattaatgccacagtggtgctggccacacctggaggaaggaaactgaaaggaaatctaagttctttattgtgtaataaagggtatcaagagtaaacagaggaaca

SEQ ID NO: 114235 - DNA, 812 bp, Homo sapiens
attcttttgtattggatattcagtggtcctagcatttaatgtttgtttttattattattattattattttttgagacagagtcttgctctgtcacccaggctgaggtacagcagcacaatcacagcttactgcagccttgacctcccaggctcaagcaacgctcccacctcagcctcccaagttgctggaactacatatgtgccccaccaccctggttaataatattttttttagagatgagatctcactatgttgcctaggctggtctggaactcctgggttcaagcgatcctcctacatcaccctcccaaagtactggaattacaagcatgagccaccacgcctggcccaacatttgtcgttaagactattttccctccacagaactgtcttgccacctttgctgaaaatcagttcaccatatatataagagtgtatttctggactctcagttctattctgttgatctctgtgtctgtgttttgtttgtttgtttgtttgttttttaagaggtggagtctcgctctgttgcccaggctggagtgtagtggcgtgatctcggctcactgcaacctccgcctcccgggttctagcaattctcctgcctcagccttccgagtagctgtgactatagttgcatgccgccacactcggctaattttttgtatttttagtagagacggggtttcaccatgttgcttatgctggtctcaaactcctgagttcaggcaatccacccaccttggcctcccaaagtgctgggattacaggcatgagccactgtgcccggcctgtgtcggtctttatgcca

SEQ ID NO: 114236 - DNA, 250 bp, Homo sapiens
tcaaggccgtgatgtctttgaaaacctgtaagggagagaatccttccttattcctaacttctggtggtttactggcaatttctggcattccttggcttgcaccggtagcatttcaatctacttgcattatcacatggtattctcaccttgtgtgtctgtgttggcatgacatctatttagtatattacatgtaaatgtttttccattatgctttttggttcatattttctgttggaggcagtgtccttcg

SEQ ID NO: 114237 - DNA, 515 bp, Homo sapiens
ttagtccagatacagctgcaggacagctccaagaagtcagagaagcgcgatttctagccagtcaaatgggaatcattgctacattccgatcatgggcaggtattattaatttatgtaaacctggaaattctgggatccagtctctaataggagtactttgcataccaaatatggaaataaggcgaggtctacttgaagtgctttatgatatatttcgtcttcctctacctgttgtgactgaggagttcatagaagcactactcagtgtagatccagggaggttccaagacagttggaggctttcagatggctttgtggcagctgaggcaaaaactattcttcctcatcgtgccagatccaggccagacctcatggataattatttggcactgatactctctgcatttattcgtaatggacttttagagggtctagttgaagtgataacaacagtgatgataatatctcaggagagctaatctttaggagagcttttacatatggcaatacttctc

SEQ ID NO: 114238 - DNA, 647 bp, Homo sapiens
ctttttcctgattcagaagaggatatctgttatcaagctgtaagtactctgcaggataatctttttttgttattatttaaagggcttttagaaacatcaccagtcacttatttttccttttgaagacaacaataatcatgttctgtggcaaaaggagctggtccgaaacctagaatgataatgaaagtttgcaaatatcaaatattatttcatcactattagccatttacagatgtgaagagaaatgagcttgaaaagtagtttgatgttttcaaccacacttttaatctttagatttgaaaacagaaaaggaagtctggagattagggtaatatattcaattcttccaccattttttaatttttgatttttatttttgagacaggatcttgctctgtcacccaggtggagtgcagtggcatgacctcccttgctcaagtgatcctcccacatcatcctcccaggtagctgggatgacaggaccgtgccagcacacccagcaaatttttgtattttttatagagataaggttttgccacgttgcccagtctggtcttgaactactgggttcaagcagtcgcccgccttggcctcctgaagtacagagattacagtcatgaaccaccacagtcagccctctactgaca

SEQ ID NO: 114239 - DNA, 625 bp, Homo sapiens
tcctgcctcagcctcctgagtagctgggattacacgtacccaccacaatgcccagctaattttttggtaattttgatagagacggggtttcaccatgttggccacgctggtcttgaactcccaacctcaggtgatccacctgccttggcctcccaaagtgctgggattacaggtgtgagccactgcacccagcctacttcatattttttgaactgacagagtggaaactgtaattagaagggagaaatgtaattttggatatcagagaactatggtaaattgggcagccagtgtagggctagtgcagggtactatggtgtggggagccttagagaatctgagggtagtgaaattaggggagaggagcttgtgcacaaaagtgcaatattgcaaaacacaaattgtttcattaaattactagggatggtactttaggcagtggccattttaggggaagtaaaggcattttttcttcaattctgtcatctaatgacctctcacttacttgctctgaactcattcattcttcagtggagtctcattttccaaatttgggggactagtggtggagttaaagattaggttgaatttggaaaagataaaagtgagtcaagtttatggaaag

SEQ ID NO: 114240 - DNA, 393 bp, Homo sapiens
gggatttattcagagaaatggttacatatgtgacagaagaagttgagaagcccatgaggggcagggagaccccagtcagaagtcattgacacctccaggcaggagggacaaaggacaggggtgatgtcactacagcctagaagaaggcagaatcacagggggcctgtccagcaggccctggagctgcatctggaagtgctgcccccacctccaactggtgcaccgctggcctggccagagtccagccagcagccagctgacctgggaacctaggagacgtcagggatcagctccctgcaggaggccgtggagcagaggaagggcaaggaagggatgcgaggacaaaccggtctggacttgcacaaaggaacaggcactgtggatccggaaaac

SEQ ID NO: 114241 - DNA, 785 bp, Homo sapiens
aaaaaagtttctaaacatctaactgtcaaaacaagaatactgggattacagacgtgagctatcacgcccagcctggtttttcctctttgagtaagctaagccgtgggagggttttgagcagaggaactacacatctgccattatttaaaggagtattctgttaatggtagaatataagtggtggatgcagaagtgattgctgtaaaattctttcaactttgctgtgtgtttgaaatttttcctaataaaataatagtttaaactggttattgtgaatagactttaggggagcaaaggtgagagcaggaagaccagttaggctataacaataattcaggtagcagtggaagtggtaggaagtggttgggagcagatgtggtgtttgaattacaagtcagtaattcagaggaaataccaggtaggaaatacaaatgtatgaatccacctaaagattaggaaaacaaggacaaatgtcttgagaattaaaagaaaatgctcagaagtgtaccctaaagcctcttactcatgcttttgttctaggctggttttggttgtagatagttatcagttattatatactgccattcagattatttatatgtattactgtccacaactcacttgtgttctaaagggttttttttaataatgttcttgtcttcccaagcagattacatgctttttgagaaaagatctatttttttgtatacaccccgcaatgccatattcctagaaggcattttcaatgttcacagaataaaaatatttgaatacagaaaaaaaaa

SEQ ID NO: 114242 - DNA, 367 bp, Homo sapiens
ccttacattttaaccccttctccgctgcctttttttccccaacactctgccatctgactatctaatctgctgtctctcatgtccccacaccccgaatcccccagtagcattcaactctgtgttttgtcccacactgcctccccagcacccagggcagtgctagaaaggccagcccagatggcattcatatccttggaaggtttgggaggtcaaggtgggaggatggcttgaacccaggaattcaagaccagcctcggcaatgtagtgagacccccatctctacaaataatacaaaattagccaggcatagtggtgcgcgcctgtagtcccagctactcaggaggatgaagtgggaggatcagttgag

SEQ ID NO: 114243 - DNA, 302 bp, Homo sapiens
tttcaacttttcttctcattctaatcatgttttcacataacatattaagaatagaagatatctgttcaacttctttacactctgaaaaagcagataatttccacaacataattatgcttttatttgggatactggtttctccaaaagcttaccaatccattctgaaaaccagtactgaaaatcaatcttgccaggcgcgatggctcactcctgtaatcccagcacttcgggaggccaaggcggatagatcatttgaggtcaggagaccagcctggccaacatggtgaaaccccatctctact

SEQ ID NO: 114244 - DNA, 333 bp, Homo sapiens
cttccttattgttaaagcttctcctccagtaacacatcagtactgactgcattcagaacactagctggttgttcatttgaaacagataagaaagttttagttgtaaagtggctggacttgctatttcaatatccttcttacattctgtgagaagataatgtgcttactaagcatttagcttcagctgttagcagggcttttggattgagagatgagtcttagaaagtgatctttgggaatatagggtcgagttggctctgattgtctttgtggttgaaactttgacatgtggaagaactctgtttcgagaggaagcatttagagaagaagact

SEQ ID NO: 114245 - DNA, 254 bp, Homo sapiens
ccctctgctggcctcaccgatgacttacctcatgatgagaccgagaccatcatccctgagggtgtgacttcctgttcatcacagcttctctggccagattgccgtatctgtctttttgcaattgtcacaattgggtgaagaattaccaagacctacttaactagattatctgggtgccacgaatattcactgctccattgcataacaccacttttgccttttcatcaacatgaaggtcaattaccattgccaag

SEQ ID NO: 114246 - DNA, 667 bp, Homo sapiens
gttgggtgaaactgaatcaccagatggtgaatgtgtgggcagtagcaaccctaataaccttttcaatacatgctcacagaagccaatccttgtccagattttagggctactgcagtagactgacctggtcccatctggagcaatcagacacaattccagtaagaatgggatgctacaatctagataactgcaaaagtgcagctcagtctggggaacccagcttaccttatgtaattgctttttttttttcgagacagggtcttgctatgttgcccagagtacggtggcataatcaaacctcacttcagcctcaaactcctgggctcaagcaatcctcccatctcagctcccccaagtagctgggactacagatgtgcaccatcacacccagctattatttttatttttggtagagatggggtctcactatgttgcctaggctggtcttgaacttctgggctcaagggatcctcctgcctcagcctccgagagtgctgggattataggcatgagccaccatacttggcccatttagcactttaaaaagtgtttataggccatttcccaatttctcgccactgtaagcatgttattcctgttttacagatgaagaacctagctcagggaggttaagtagtttgaccaatgtcacaaagcatgtgaaaaa

SEQ ID NO: 114247 - DNA, 302 bp, Homo sapiens
cactgggtgaagtcctggtgcatcatctgatgaactattgtcagctgctacaaaacaacgtaaagaaagcgggagcagggccaggtgcagtggcccacgcccgcccgtaatcccagcactttgagaggctgaagcgggcagatcacctgaggtcaggagtttgagaccagcctgaccaacatggcgaaaccccgtctctactaaaaatacaaaaaaattagccgggcgtggtggtgcatgcttgtaatcccagctacttgggaggctgaggcaggagaattgcttgaacccgggaggcagag

SEQ ID NO: 114248 - DNA, 654 bp, Homo sapiens
gatgagttcgtgggaaacagggaagagggcgatagagcctgggaaggacagcaacttgcagggaagggatgactatagtctacctggtgtagaggagctaagataccatcccccctagaaaggatttctcttgagatacgccaggcaacaaggggatatgaacacaaccactgcgctggcacactttgattcttagtctcaaaatgcttatccacaggatgtaaagctatggcttgccgggagggaggatctcgtggtagctgtgagtgtcagtgtgggctctggagctaaactgccttggtttgaatcccagcccatcgctcactgcctgtgtaacctggggcaacaggcttgacactgcccctcagttgtctagtctgtaaactgcggacggtaagcagacctaactcctaggaccgtcccgaagaatgaataagacaatacatagaaaccactcagaccagatgctggcacattaataaaccccatttctcatcgttatggatgtgataatttggtctgttccatctccctttcctttagggaacctcctttctcccagtctgcaccaattcaacccaagcctctgaatctaaaaggggagctgacgcctcccatgctacggagacaggcacgtgactcagtcacagccaa

SEQ ID NO: 114249 - DNA, 224 bp, Homo sapiens
gagcaggccacatgggatggtctggacaggctctgcagcacagcagccttcatgagaaacaggcagaagggcccgggcatgagaagctactgcaaacaaaaagcagcagcagctataaagggcttgttcccaagcaacatgaatcatctctgaactggtctggtccaatccctatagtctaactagcaaatatattttttaaaatattagcaaacacacacact

SEQ ID NO: 114250 - DNA, 848 bp, Homo sapiens
gtccactatataaaaatgaaaacaaaaactcacatttatcgaacacttgctataagctaggcactgtgccaaatgctttatatgttttagttcatttcaataatccatgaggtaggctttattattactcccactttatagatgaggaaatgggggtacaggtggttaaataatttcctccaaggctacaacctggtgagtggcagatttgggataaaatgccatacttgaatagctccaacagttgtccttcaaacaagttactaatttttaaattataaactcataaaatattgtttagttctcttattatctagctcttacttattaaacctgagagtgtcagcaaggtgggatgggaaaggaaacatcctcctttcctaatactctgttattttttgtgagttcaagaggtgtagaggtagaagtaggtatagccaaaaagacattacaaatattgcaaaaagaccattggttgttatagtgaacagcattgttggaaggtgatggctctccctcctcctccccatttcattggcgtaacgtaacagtgtattctgtacataatttaccaaataaacatttattttaatggttacttattatctagatatttcctcaacacttaaattcataaattaagaccatgtaaggtatgtctagagaatggagttggagtaaccaaagaacatctgtgatcttttaaagcagctcaggttgtggcaaattccatgtatttggatttgagcaaaaaggttctaagagcgacttaaggtagcttggtaggccttaatgggcattggaatgtattaaatcttacttcgaatgggaactggtttttagaacag

SEQ ID NO: 114251 - DNA, 1825 bp, Homo sapiens
tgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 114252 - DNA, 2051 bp, Homo sapiens
tgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccgggaaaaaaaaaaaaaaaaaaaaaaaaaaaaaaaagatacttgagtagagtttatagaaaccattccaggtaccctctctccagcttttcttttccaggatttatctcctcaccttccttttgctgtagttcttcaagctaggaagactggatttccctctggtgttttagctgccagtcatggtatgaactagaactcacccccaagtaaaagctgtacaaataagaaa

SEQ ID NO: 114253 - DNA, 1473 bp, Homo sapiens
  misc_feature (27)..(27): n is a, c, g, or t
  misc_feature (30)..(30): n is a, c, g, or t
  misc_feature (33)..(33): n is a, c, g, or t
  misc_feature (53)..(53): n is a, c, g, or t
ggcacgagcggcacgagcgcagaacgnacncgngtagagcggagatctgggantaacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 114254 - DNA, 1622 bp, Homo sapiens
tgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 114255 - DNA, 1621 bp, Homo sapiens
tgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggatgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 114256 - DNA, 608 bp, Homo sapiens
  misc_feature (8)..(8): n is a, c, g, or t
  misc_feature (67)..(67): n is a, c, g, or t
  misc_feature (74)..(74): n is a, c, g, or t
ccactttntctcgcccctcccattaccatcgcccttttttaatgccaagccaccttcttcactatanctacacntacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 114257 - DNA, 1425 bp, Homo sapiens
tgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcactgaaaatgtgggtgaggcttgtggactggaggtctcacagtggacagggcagagacccactgtctggggaacccccagtgtcaggatctgtccatctgttctctttgatcagtttcccagagagaaattcaataaggtcctgccagcaaggtgcagaggctcatgccctgtaaacaggtgaacctttctgtgtttgtacatactagtgtatgcgagacgtgtgtgtgcgtctgtgtgccgtccatctgcgtgccgcagccgcg

SEQ ID NO: 114258 - DNA, 1182 bp, Homo sapiens
tgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctcttttcttttccaggatttatctcctcaccttccttttgctgtagttcttcaagctaggaagactggatttccctctggtgttttagctgccagtcatggtatgaactagaactcacccccaagtaaaagctgtacaaataagaaa

SEQ ID NO: 114259 - DNA, 300 bp, Homo sapiens
ctgggtgctgccccctgcccaggaccagcccctggtggaagccaaccacctgctgcacgagagcgacacggacaaggtgcagtgacggggcctcggcaggagcgaggagcgggtgggcattgcgggccagactccagaaaggagcaagacctgggcctggagctcagggtcccttttaggtgggataaaaaaagagggacagagagagggaggaaaagagagggcacggagccccagaaagagagggggacagagacccagagacccaaagagagaaggacagggaccaagacggggaca

SEQ ID NO: 114260 - DNA, 2649 bp, Homo sapiens
tgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccgggaaaaaacaaaaaaaaaaaaagaaaaaaaaaacaaaacacaacaaaacaaaaaaaacaaaagcaaacaaaaaaaaaaaaaaaaaaaaaaaaaaagaaaaaaaacaaaaaaaaaaaaaaaaaaaataataaagaaagggggggcgcgtcgatagaaaacttctctcccagggggggcgcccacaagatctccaccacgacccacccggtcgtcagctgtagaagccacaacggggcgcctcccagacaagtggcggcccgcacctaacataacaagcagcagcccggcgcgcccgcctacaaacaacacccactgtccgtagggcagagacaaaaacagcacgcgcccgtgcgagccgcatatgcagaggaacagagaccccaaccaactccgtccgggcggagacgacacagataagcgcgaccacaccccacacccaacgaggaacgatcagccgcgcccgcacggcgcaaaaaataaccaacacccgagcgcgctagcaggtctacacacacccaccgcagtatccagccctgcgcggcaaaagaagacgccacgccgacaggcaccatagcgacaaaaacataccacgcgaggggcgacaaagaacaaaaccccccacacagcaacactgagcgacgacccaaacgacacacgagccagctacgacacagcccagcacacagaccggacaggcccaccgagcacgacaccagcagaacggcccaccaacgacgacacgcactacacgccccgccgcacaccgaacgcgaccgcgccagcgcccggcacacaccgcgaccacgccccaccgacccgcgagcacc

SEQ ID NO: 114261 - DNA, 1411 bp, Homo sapiens
cctctaagcatcccgccctcttttcccccatcgcccgccctttttgagcccgaaagcttgcagccaacttccaactccctgtcctgtcctagggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 114262 - DNA, 1609 bp, Homo sapiens
tgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggtgcagtgacggggcctcggcaggagcgaggagcgggtgggcattgcgggccagactccagaaaggagcaagacctgggcctggagctcagggtcccttttaggtgggataaaaaaagagggacagagagagggaggaaaagagagggcacggagccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 114263 - DNA, 703 bp, Homo sapiens
cacaaatgattgcttataagtcaggttttgttactaattccatcgaaacagaagaggacgctgaggcgagagagagggtagtgagttgctcaagggcctggttcaggaagtatcagagccaggatcagcccccagctccactagacccccagagctgcccctgaccttgtcccctctgtcccggcccccagcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggtgcagtgacggggcctcggcaggagcgaggagcgggtgggcattgcgggccagactccagaaaggagcaagacctgggcctggagctcagggtcccttttaggtgggataaaaaaagagggacagagagagggaggaaaagagagggcacggagccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 114264 - DNA, 1217 bp, Homo sapiens
cccagagcttgcccctgggacttggcagcaacattgggctgacccaccctggcctgttcccaggaatttgctgatgcccttgactacacacaatgaagtgagaattcaaaagccacgttagttcagcctcattggaaacgggagggagggtcagtgtatgccgaatggagaaaggaggaatttggtagggaaggaaacctttcatttcaagttttaaagtatgaactcaacagtagactcagagcttctacatatgagtctttttagccatcctctttcaaatctaggtgaagcttgtttcttacattagacacatttgtgaaaaggctttatgtaaatattgatttttctatatcaagttacatattataaatccaagagttcctcactgtgtaaaagaaccctgtgaccagtcactttttgaagggcataaatctgtcgatattatagattactcccaattcatgttatctaaagtcattttgatgtgttgagctttcttaaaatgaaacaagcattttttttttaaatgggaaagagactccagagaaatggggtcagtgttcctacaagcatgtatttttgaggtagtctgtattagattttcctgaattccattcagtaatgctcaagtgtttaatgacctcataatgtgttcactttgaatttaagggtaattgaaagaagccttctttagatttctttccatcttctgtatcttctctgaaatgtttagcctagctgttctttgtcctgcagttagtgacagaattcttagggagcttgtaaaaaacacctactgtgtgtcattgttggtttagagacttaactcataaatcagctgtctctaggctagtttcagaatttaggctttattcagattaggaaataattcttggtttcatgtttcaaaaacatagccaactaagtgtttctcagatgctgatcatgaattctctttagtattcacatgacattcttcacttcctcttccattctgcacgctgcattgcccattgcacctcaaaatggagggagttagaagaaagaaaaagaactgaaactttagctgagtgcaatggtggacgcctgtagtcccagctactctggaggctgaggtaggaggatcgcttgagcccaggagtttaaggctacagtgagctatgattgcagcactgtactccagcctgggcaacagagtgagaccctgtctcttt

SEQ ID NO: 114265 - DNA, 317 bp, Homo sapiens
gtaatcccatgcccacaatcattttggcctgggtcctactggcagggcacattgctacatttaaattttagtttcagagccactttgacctgtatctgtttaaggaaatttatatttccattgggaccgattaatttgttagactctgtagctttatgtaaaaatgggaaaaagttaagaagagtagagggttgggaaagtatcctatgagaagttgcctcagatatcagatgactggcatccaccttattcaaatggcctgttatttgccataaacataatcacacctaaaccatcgtgaggagctttgtcgctct

SEQ ID NO: 114266 - DNA, 155 bp, Homo sapiens
ctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcaga

SEQ ID NO: 114267 - DNA, 385 bp, Homo sapiens
ctaaagcaacacttatgaaggctaatataagagaaaaggtatattcagctaagaaactcacataaagtacagactaaagtattttgaaaacttggggattctcttagagactgttccaatcatatttagtccccaaaagaaaaaaaaattacatttaattaaaaaggtataatgagattattgaccagaggaccaatctctaatacaggtatactactaagctatttcttccactcttaaagaattcatggtcccaaatgtggctgggccttaaaactaaatcagcaatacttcattccctttgcttttctcctctgcaaatattccatacttttaccactctcttaagctttcaacctcatctcttttcttctaactctcagaa

SEQ ID NO: 114268 - DNA, 813 bp, Homo sapiens
gtcatgaagggccgccatcctccggagaggccaggatgggcaggaaacgccagcttggcacccaccgtccagagcatgcctcctgctctccctgcctcagtccccacagctgccgcccattcacagagcaaaaggctcacgtgaaaagactcaccacaattttccaaggaatggagtttattaaaatactgctggaggcttttggctggaatgttttttctccttgtaaaacgggaactatagcagtgttgtctataggaaagctcagaatacgctcagaaacatcagtcacaacagagactatgtaggggctggtgcatattaccagtgattccatccattccgcggctcctgctccagagataacattcggctcagaggagaaaacttccaggcagaccctaggatgggtaggagagaggaagccaagtttccccacccttaacataaacccacggggaactctggtggaaaaagcatttttttaatgttaaaatgtcttgcatgtgggcatgttatggattggaatacaatttattttttaatttttttcttacgagatggggtctagttatgttgcccaggctggtcttaaactctgggttcaagcgatccttccacctcagcctcccaagtagttgtaacttcagatgaatgccacatttccagagagaaaacaatttttaaataagacaaaacatacaatgctctccttgaggcaggcacctgtggattttcccctaaaaccccagaaatgtgtatttgctcttctttcttcctctattgacatgagtactttggggaaagaatgag

SEQ ID NO: 114269 - DNA, 339 bp, Homo sapiens
tgtgttcttcaaatatttagagatgactctgatatctcactctgtcccatatatctcagttcctctcagaggaggatctccaggaccagacatgatgctcacaggggaaggagtctctgatttctcatcacagacgccagctcaccagctgagcagctggtggcttgcaggctgaagcaatcccaccaatgagtcttgaacagctcccgacaatgtcagactatgcagtatttgatttttttttccatattttcacatgacaatcaacagaagttgagaaccaaccgccctcttagacaaataaattatccagttcaacaccatcctcaccaaccctaa

SEQ ID NO: 114270 - DNA, 609 bp, Homo sapiens
ggtttggcatgttaggagttaggctcagagaggtcagtcaccagctaatcagtgtggagtcaagtctaaatggaatatattttttattatgagatacttaggatgagaataaatggtgaataagggaaatagtaggacaaagacgtggtgccatcacagctcagtgcagccttgacctccaaagctcaagttgtcctcccacctcagcctcttgagtagttggggctacaggcaggtgccaccccatgcctagctaatttttaaatttttttgtagacatagggtctcactgtgttgcttaggctggtcttgaacacctggcctcaagccattgtcccaccttggcctcccaaagcaccgagattacaagtgtgagccaccatgcctgaccaaagactgtcttaagcagaaatgaaatccagttgttaacaaaaaagtgcttatatttcatgcctcttacaagtggaaaacaggtcttacagcatttaagagatttaaacaaaaagttcatgaataccaagattaaatattaaggttgattttgttattgattgactgaatgtttttgtggattaaattgctacatgttttaaaatgttatttataatg

SEQ ID NO: 114271 - DNA, 537 bp, Homo sapiens
gagactatagaggaccccgcgacacgagcacagtgctgggaatacagacgtgagccactgcgcccagcctccatattctaactacctcagacttcagggaaaactatttttaaaaacacatgtgggttttataaaaaccggtaagtttatgaaacttttacattagccctagccctcagtctccaagtccagtgtttatctcttaggttgtatagggatagttgttaggtcttaatttgcaggagtaacaatttgaatccagttaagcccacataaaaagtaaatgaaaaactaagagactcttccatttatggggatgacttgtattacatcctacagataccagaaaaatgttactgtaaggtgcgctctttttgaaatcttaagatgaagtcctttccagttacagaatttttgatgtaacacatcaaaaattgtttccctccaattaactgtaggaacagtaaactgtagcacagttttaaaacttacatagagagaagacagagaatctccctaaagcccaatgattaaaca

SEQ ID NO: 114272 - DNA, 579 bp, Homo sapiens
tggctggctccccgtcccttgtccgtgccgatagagcatctgctgggagccaggagctgctgcaggcacggggggcagtgggtgaggcgtgcagtcccagccgtcctgagcttagtgggagcctcgagccttcatcatgcagtgtatttgtttctgttgtgatccagctgatccattgatcagtggggttggggacgcttctgttctgctcatttattgctgtgtaacaaaccacctctaagtgagggctttaaaacaagatcgttcatttcttttgcacatgggcattggggtacctgggcgcagctacgcacttctcacctggggcctcatcagtcagatggggccaggttgggttagccccaaggcttctcgcattggcctaagaggcctcagacaatgagggctttggcggctggggctccccagccacacccttcacctcgtggcctccaggtagcctgtccacctgccaagaacacacacacccagccccacaggtcacccctcacctgctgctgctcctctctctccctgcacgctccaaagtccccagaagcctgagactcccagagcaac

SEQ ID NO: 114273 - DNA, 752 bp, Homo sapiens
gattgtcgggaggaccctgggcaaagacgcctaccctgccatgctgcgccatctgccctccaggctgccagtcaagatgtggggcaggactttggagaaacagtcatggagggacagcagtcagatcccctcccccatgtcttatccgtagacttgaccacatcgtgatgacggtgaagagcatcaaagacagcaccatgtgtaattccaagatcctgggcatggaggtcattgacctttgaaggtaagcacttccccaaatgccaaaattcaggtgggctaaaatttgttgataacactttaacatataacttaactctaagatggaaaaccacaggaaatctgagagaacaatataaagagatcaagtagaggagattccaagactgaatattgggacttccagagagagaatggcgaaaccagagaggcggccattcatcatagaaacaatgcaagataactttgcagtctctacatggcaacggtgaaccaagtatccagcatcgttgacagctctagacatcggatcccttctaaacattcatacgaacatcaacactgaaacacggtagatcctaaggagctttcatcagcagatgcaccaagccgaatttatcctacccacgcgacatccctacaacggaactactccggcaatctgcccaaggagaaccacgagaccacacagcatacacccggaacacctttccagaatcctgagggcgacaacctttcgacctaagaaatct

SEQ ID NO: 114274 - DNA, 228 bp, Homo sapiens
aaagaaagacagacagatagatagattacagatagataatagatagataggaacacaggaagatggatggatagataggaagatagatagatagatagatagatagatagatagatagatagaagacagatatagatagattgatagatatagatagaaagaaaaagaaagacagacagacagatagatagattacagatagataatagataggaacacaggaagatg

SEQ ID NO: 114275 - DNA, 871 bp, Homo sapiens
cagagaacctggcatttatacccttgtatcaagcagggatatgacttgaccttgaggaggggacttttcatgcagctgaggcatctccccaatggctgactgctggggctggcctccatgtcactttcagaagctgggggacaaggtctttagttttggaaaaaggatctggggctgcatcatagggtccactacaaaatatgcgcttgaatggcttttcttttttcttttttttggaggcagagtctccctctgtcgcccaggctggagtgcagttgtgcagtcacagctcactgcagacttgacctcctgggctcaagtgatcctcccacctcagccccccaagtagctgggactacaggtgtgtgccacaacacctggctaatttttgtattttttgtaaagatgggtttttgccatgttgcccaggctggtcttgaactcctgggctcaagcaatcctcccacctcgaaattccaaagtgctaggattacactatgcctgaccttgaatggcttttcaaacttctggaaagacagtggaccttgggtgatatttgtgtgtaaagaagctgatgaagctgatgcactgcgggctgaggtggaggggtaacccactttcttatttttccctgggtgcaaattctttagaaaacagccaaagtcataataaaaggggagtactgatgaagatgtgggaagactgacattttcgtattttgcttttggtgggggttggatttctaatttcagaaagtaatttggtaatatctattttaaaaagaacacatcaccatttccaagcaattccatttttgtagattttcttcagaaaagaaaggtcccttgtgtaaggatgtatctataaaaat

SEQ ID NO: 114276 - DNA, 440 bp, Homo sapiens
tgggattgagaagtgggggaagggaaaagggggaagaaagtagctggtggcaacaaaacatagcaacaaaaacagatctttttcctcacagttgctggggtttctttaccagtatgaggtcagccaaatcctaggggaccctggccttttgtgactctggcctcttagttctctatctcaagggagcagccactcccgtgccattgcagacttcctgtagtggtccctcacactaaaagggaaagcatttcctgccaacttctgttgtgggtccaagcaggaagcccttcctaacagtgccactgtcttggctccacctggactcgcttccattggctagtgcctgtcctctagctcgtgaactgatcagatccagggacttgagagagcagaaaagcttcgaaggccctgcccagtgtctaggattgtatgtttagggc

SEQ ID NO: 114277 - DNA, 347 bp, Homo sapiens
ggcaaagagcaccctcctgattcatggggtgatgaacagttgttaaaaaagtgctaaaggtggcaacatccaactgagtcactcttgcggtgtaattagaagacctaccaaggggaagcttttgcaaagggcaagagtggctaacctgaggcgtcaccagcagcactgccatagcatccatcactggacactgggccaaggcccctactcacatgggctcctttaacccttccagcgacactgtgaggcaggtatcactaaccccattttacagttgaagaacctgaggctcagagagattgaagaaactttctgaggttgaactctaatgacaggccctgaaactg

SEQ ID NO: 114278 - DNA, 421 bp, Homo sapiens
acacagtgtactgtcctaaggatgacactgtgacactataatatttatactgcatgttttattccacactttttattcctactttctaatattaaaaatgaggaagtgaaataaatttcttacacatttcttaaaattttgccaataggtaagtaaatgttaaaaatttaaaattaattttgttctgagtctaacaagttatagtgaataggtgaacttagtggtagattaagggatctcatgggatattccagtgtcagcataaatcattagaagtcagaggagtcaaatggaatcccatgtgcaataacatctaaaagacatgaattcaggaactaaaattatgaaattcttaaaacgtagagaatatttgtaatctgcaaattatggatttttttaaggacaagaaggtgtaaaaatg

SEQ ID NO: 114279 - DNA, 383 bp, Homo sapiens
taatatcaatatttcagaaattgcatgctttatgtgaaggccctggagatttttcaatgattttgctatttataatatgttcttttttttttttctttcttgagacaggttctcactctgcctcccaggctggtgtgcagtggcgtgatcatggctcactgcagccttgacctcccaggctcaagcaatcttcccaccttagcctcccaagtagctgggactgcaggtgcacaccaccacacctggctaattttttaaacctttttataggatggaatctctccatattgtccagactggtcttgaatttctgtgcccatttcattgaaatgggcacagaatttctaattaaagtcttctcctgctctgtttgcaattatacg

SEQ ID NO: 114280 - DNA, 709 bp, Homo sapiens
gtgggctcatgcctgtaatcccagcactttgggaggctgaagtggacagattacttgagcccagcctgggcaacatagtgaaactccatttctacaaaaaatacaaaaattagcagggtgtgatggcacacacctgtagtcccagccacccaggaggctgaaatgagaggatcacttgagccctggaggcagaagttgcagtgagccaggatggcaccactgtactccagcctgggtgacagagtgagaccctgtttcaaaataataataagaagaacacaagaaggttaagtctagtcccaaagaagagagaacactgtcaaagctggtttctgaaaactggtaccaaaatctacatttgtttatttaggctactataacagaataccacaggctgggtggcttaaacaacagatacttacttctcacagttctggaggctagaagtccatgagaaggtgctggcaaatgcagtttctggtgagggctgtcttcccgacttgtagatgaccacctccttactatgtcctcacatggcctttcctcagtgcatgcatgtggagagagggacagagtgcaagctctctggtgtctcttcttataaggacaccaattgtatcagatcagagccccacccttatggcctcatttaaccttaattatttccttagaggccccatctccaaatacagctataggcacatgggag

SEQ ID NO: 114281 - DNA, 299 bp, Homo sapiens
ctcaagcaatccttctgcctcagcctcctaaagtgctgggattacaggcatgagccaccacatctggcctagaataaatgtattttaaaacaccttttttgcacaatgttgggctcactcatgtttagtaaatggcaggaacaccagtgctgctgatacacagtccactggaatttcagttttcctagttccgtgcatccaggtatttgtcgagttcctgtggcttttccgtcagctccatcagctcctctccagccccactgctgtgctttaaagcaactccaggtttacttgttctg

SEQ ID NO: 114282 - DNA, 359 bp, Homo sapiens
ctatttgccacaatgtgttaaatttcactgtaagtcttatattacagtatgctttactgtgctctttaaatactcacgtaattaaattatgaaatcttttccaaatatttattaattttatcctttgtattctcagtttctctctgggaatcttattatatcagaccattaacatattgattctctagtctatataggagggcagcttttctgatctatattccgtatctttgcatatccaggatgtattcttaatgtactcctttaagccttctattgagtttttcttttctgtcatttgtaatttccaaaagcacattcttgttctctgaatttttcttgaataccactattatttt

SEQ ID NO: 114283 - DNA, 133 bp, Homo sapiens
ccgagatcacgccactacactgcagcctgggcgacagagcgagactccatctcaaaaaatagataaataaataaaaatttaaaaattttttaaaaagccatatgtagtcagacacttccaaatttatatctca

SEQ ID NO: 114284 - DNA, 428 bp, Homo sapiens
catccctattttactaatgaggagaccaaggctttgagaggctgagtgacttgtccaaaatgaggcaagtagcaaaaccaagaaaacccaagtctacctgaagcactcagtcttaacctctaaccctttacctcctgcaccctcagccttagtgtggaaggagcatagaattcaaggaggtgaaaggaggaagcacggattggctgggaaaggaggaagagctcatgttctggatgtcccaaaggtgtttcaatctgattatataaccctcacctcaccttttcctcttttccccaaggctgtctccacatgttttcacaagacagctggagcatcctgcaccttctgctacaagtggcgcattcactaggagatggtgggctcctccctccactagggacagagggagagcttcctaggcacaatga

SEQ ID NO: 114285 - DNA, 202 bp, Homo sapiens
tgtgggaggccctgacccacgctgtgggttcctaggatcctgtcttggtctttcttatccagctggaagcaagttgaagcaaacattgtttctctggacgtgatagagccctgagttcacctctccccagccagtccttattttactgagggtcgggggagagcggtcaaggaaggcagctttggagaagggtggacttgac

SEQ ID NO: 114286 - DNA, 462 bp, Homo sapiens
acatttcactcctttgcgagagaggagtcgggggtcgggtgcccatcaaaattggggctgcggctgggggctagcatctctgaacctgcagctgcaaagggataattttggaattggtttacgttaaataaaacacaaaaggcctttcctatcccctagcttgttgagtgttcccttagagaaatgggaactgcggatctccttgcttgagacagcaatccatgctgtgactgtggaaggcttctcttggcgagaattgtgtgtgcaaagggaacggtggagggtgggaacgaatttgtaagcgaagagaaaacgattgtgagatcttgatggtcgctgcagagtaacttcagcgctgagttcgtttgaaaccttcggtttgttaagattcagaataaccaattgctttgtctgttaaatctcccgatttctgttaggaaaataaaagcctcatttcttaat

SEQ ID NO: 114287 - DNA, 305 bp, Homo sapiens
tctgaattaaggtagtggctgtggggacaggagcctgggaggccgggtggagtcagaatggagagactggttggcaatgagggaacaggaggaggaggaggaggagttacgagtggcttgaggtgtcacttaccagacatttgggggatgggggatagccatgattgttgagcaactggtttgggaagagctagcattgatccctgctgttctgtgctagcagaacctatcagcatcttctgggcaggaaactggctccatgagactggcttagggagaggctgctagtcacctaatctgcagag

SEQ ID NO: 114288 - DNA, 398 bp, Homo sapiens
taaaatgagccaccagtgttttacaaagttgaataaagcataagagattagtctgccctcaggggctggaaggggcagaacctgaaaggacactgtgtgctcctgggctggttcgagctgaggctgtgctgtttggaactctgctgtgtttgttgtgtgaagcacagtctgtgtgcttcctttccttggtcccagacctttgctgcttaagctgtggagttgtcctggtctgctcactccaacctccctgaccgatgctgacaatggcatctcccctacagctcacagccctgtagtcacctcaccttcttgggggctgtcaggcctctgagcccaagccaagccatcgcatcccctgtgacttgcacgtatacgcccagatggcctgaagtaactga

SEQ ID NO: 114289 - DNA, 377 bp, Homo sapiens
aaaggaagatatccacctattcaaatcctgcctgttttcctccctctagcttcattctatagccttggaaggttcgtcctggcctgttcaagcctgttttcctctctctagcttgattccacagccttcgaagtttcttcctggcctgttcaaacacaagctcatggagctgcaccagactcttaccacatttgtcattggaaccaagtaatgcaacatcacatatgattatatgcgtgttctttttttaaattttatttctcacagccttggaagctgggaaatgcaaaatcaaggcctggcaggggctggcttttgagacagctaggtgttagctgttacttcctatggaggaaggggcaaggaacctctcttgt

SEQ ID NO: 114290 - DNA, 151 bp, Homo sapiens
cacttacatatgctttcatgtcttagctgacatgacacaatggttgagtgctggacaagcatctctccacatgacttgtccatgtagctagcttaactttcccccacagcatgatactctaaggggattaagactacttacattgtaatta

SEQ ID NO: 114291 - DNA, 351 bp, Homo sapiens
aaattgaacaaaatataagcactggcacctccccctcttttaagggaccatggcattcaacaagtgttttggtaatgagccactaccatatgctcgacaccgtaaggcatgtggagatgacaaaacacactcttgatctgctttaaatctggtaaagaagtccgggggtgtttgcatcccaagtagcacagcatggggcccagcactaggctaaacacgggtggcaggcatttggaggagagagcaatcatgagatctaagggaaggcttccagaggagggcatgctaacaggggctctcaaatctgaagcacgagcaggcgcttgagaggcagccaggcaaggaggggcg

SEQ ID NO: 114292 - DNA, 319 bp, Homo sapiens
attaaggaactcgttccaaaccacacagccaggaagcagccgttcagggattcgaacccacaccgtcggccgggcgcagtggctcacgcctgtaatcccagcactttgagaggccaaggtgggcagatcacctaaggtcagaagttagagaccagcctggccaaaatggtgaaaaccccatctctactaaaattacaaaaaattagccaggcgtggtcgtgggcgcctgtaatcccagctactcaggaggctgaggttgcagcgagctgagatcgcgccactgcaccccagcctgggtgatagagtgagattcagtctc

SEQ ID NO: 114293 - DNA, 771 bp, Homo sapiens
aaagggaaagggtcttccaggtgggacaaacggtgttcagagattggaatgaacctggcataccgggccaacactcagtgggagaggactagctggagtagaacattccttttgaggaactgagaaaggcatcatcactgattataacaggcacagagaatgcaacagaagagcccaacctcctcctctcaattctcaattgaaattgagattgatgggattcccgtaatcccacctttcacttttactccaccccatcaagaggacagggttctgattcaaccttgggcttctgatcttggggggtgggagcttggagtcataactaattatctgctctatttgaaaacactgctgggactggactgtgttggggacctgaacctgcaacctgtgaccttactccccactcgagctggcctttgaacctgctttgtcactgagaaatgatgaaaagctcagaagtcagacccacttgaattcaattactggcacttctactcaccaaccaagtgctcataggcaagtaatttaactcctccaaacctcagtttacccatctacaaaatggggatgataatagcactggcctcatagaatagttatgatggttcaatgggataacagttgcaaggggcttggcatagttcacagcaaaatgaaatgaataatctattcattatgttattcccctatcacactgaagctgtttgcaggtgcactgctgttattgtatctgcttccttctgaattaaaaaatttttaaatata

SEQ ID NO: 114294 - DNA, 145 bp, Homo sapiens
atttttgacaattttccagatttttgaggtgggaactgagattattggtttctgaggttttctctttttcagtgtatacattttgtactatgcatagtagttcaaattactcctttagctatgtgccaaacattttgatatgttg

SEQ ID NO: 114295 - DNA, 266 bp, Homo sapiens
atggtttggggccactcttttataagactgttttcgtcacgctgataaaaatctgttatctgaaacagtgtcattcactggtttttgttattgctggttctattccctttgtacccgtatacactgaaaaagtacaaatctcaaatccaggttgagtaagacagtttctaccacctttgtggacatctcacctccttatccctattgcagctaaggtgttacttaggaaaagtacttctccctagagctttgttgctaattgccaa

SEQ ID NO: 114296 - DNA, 661 bp, Homo sapiens
gtagagacagagtttctccatgtttggtcaggctggtctcgaactcctgacctcaggtcatccacctgcctcggcctcccaaagtgctgggattacaggcgtgagccaccgtgcccagcctggtttattattttgatttgcctggtgagtccaacactacgctgggctcagagtgtagcactgaagcagcaaaagaactagcacagcccactccacgtttgcttaaggggcctttccccactcctgcacataggctaggatgattttagagcactgaagtaataacgcaaaaacagcaatcatgtccttcttgaaaccaactctgggatgaaagaggaaatgtgtaaacagctaactaggttttattaaagatttgcggccgggcctggtggcttatgcctgtaatctcagcactctgggaagcggaggcaggcggatcacttgaggtcaggagtttgagaccagcctagccaacatggtgaaaccctgtctctagtaaaacagcaaaattagccgggcgtggtggtgagcgcctataatcgcagacactcgggaggctgaagcaggagaatcgcttgaacccaggaggcggaggttgtggtgagctgagatggcgccactgcactccagcctgggcagaaagagtgaaactcttgtctca

SEQ ID NO: 114297 - DNA, 271 bp, Homo sapiens
gttcatcagaaaacctcggcacaaatgtattacatgaatcattatccatctgtcttgcaggaagacctaagtagtgaaaatgagaatgagaactcccactaataagtgagattctcacaggggggaataaggaaggagaccacctctcttattgtctcatacctcagaaaaagaaagaggaagtaaaagttaaagaaaggcaaaaatgaaatcaatagtcagacagcccagcgccacaccccaggcctggtctggtagttaaaaatcaacc

SEQ ID NO: 114298 - DNA, 110 bp, Homo sapiens
caaacaaggtaatatcatatactgaaaataagatgatgtgacagcaattgaaggcactacttgaaataaagcgaagccgggtgcagtggctcacgcctgtaattccaaca

SEQ ID NO: 114299 - DNA, 307 bp, Homo sapiens
tcagaatgtaatatcaagggattggagatgtcagtatgtcttattactgatgatgttgactttaattgtgtggttaaggtagtttatgctgcatttggccagtgtaaaattactgtaattaacaaatatcttaagcttcacaaatcttgtttcttctcaaactttcacccattgatttttagtatctgccagatactaaatcttgtctacaacagttttttctgtggaattctgctgtaagaaaggatgtttcattctctctcatctatttaatcagttatttattcatatcagtatggattcatgg

SEQ ID NO: 114300 - DNA, 134 bp, Homo sapiens
acacattccaacacacctagacagcaaatctcccagtggagatgacagacatgctatggccagtatattcttgttttcttgtcatgctcattctgaaaaggcacgtgagatactactggggacaggaggaaaac

SEQ ID NO: 114301 - DNA, 431 bp, Homo sapiens
tataagtttccagcactttttatgtagtgtttcagccatgtttactgtttgataatttcattttacttggtccctggtattgtacaagagaaggtccttggcattcttacaaggcagtatgtgaaatgaaataaaaaggatgcaccggctgaagacacggctgcacttgagccaaatgatggggttccctaagagggatgccaagccaagctgcttcggtgatgagtcacgccatattcaattgaccaatgaaggttggaacagtaatcacagggtgcaaaaacatatcagaaaatgcacatggtgctgtgtaaaatgggtgctatgacactcacaggatactctcaagtgacaaggtcccccgtgaaaacccttggggctgtgagcccacctgaggggaggggaggctgaaggctgcttggccaatgctt

SEQ ID NO: 114302 - DNA, 181 bp, Homo sapiens
agttaccctggagagctgagtgtctcttgggggctgctgcgctggacgggaggtgatttgaagagggccggggagaagaatggtggtccctcgcctctttagcctacattcacagcccaaacacctcctcttctctatgctggttttcgatacagcaagcatggttcagcagtgggcagtg

SEQ ID NO: 114303 - DNA, 734 bp, Homo sapiens
gttgaagtgtgaggatatttaataacgttactagcaaagatgagtttatttctttaatttttcttgcttttctaccaagctcatttataatagttaaaatcatatatattcatatctttcttttccttcccttcttgttcagggtagctgcttagtcagtaacatggtagtatggagagaatacagaggcagaagaagatagtttcaactcctttttagccatttagctctgggatctaggattaatttacttaatcctggggagaaggagttgtttaaatattgtcctaaggattaaataaaaaactattagaatattttatagtgtctttcttgcacatagatctgccaaaactgatcgacttcccatcaaaataaattcttttatacaggatacaccaattgtttccatcttaaaactttggggaaagttgggtcagacggccagggtcatgtcttagcattgagttgctaattccaagagatcattctaacgaaatcatctctctgaacaaaagaaaaagcctgcagcttccctcagtaactgaaggtttggttagaatccctgcacaccacaggaataatttattctcattttgaccatgcaagattctaactgcctgggaaggaagctgctgagtacagaaagaggcagtgtactctggtataaagaggctttttacataaataggtcccattccaaattttaactttagcatttgccactgaatgaa

SEQ ID NO: 114304 - DNA, 530 bp, Homo sapiens
aggagaacggcagcctttcaaaacaagatgtcaagagactgaaaaaaaaatggtacattgggtttgaagtcaggagcagaatggaattccaaagttgtgctggtgatatgtgaaaggagagaaaaattaagtgtgaggtcaaaaaagaatcgatgacaatgaggtagaatagaacaaaatttgggaatcgatagggaaatacaagatcaccatgtggttgaaggaaagggggttttgtaggaatttgatggatatgagacgctgttggaggacaggtgagattgctgggccatcctggaagcctcaactcagaccttcactctgatctcaacccaggtgaagagctgccaggatgaggtacacaggcaaaatgccaagtgatcacagctgaattattccaggagggagagatttcagttactatttttttaatacctaaaacatggtcttaaaacaggactcctggtaaataaagcagataaaggatgcttcattagctgactttagcagagtggcctttcagaaaagta

SEQ ID NO: 114305 - DNA, 266 bp, Homo sapiens
ctacttagtaactgatactctaaacaacatgaatgaatctcacaacatagctgaataaagaaagccaaaagaagggtatatactatattatttcaattatataagtaagattctaggaaatgcaagctaatctgtagagacaggtagtagatagtgttacctgaggacaaagaaggggattataaacaggtataagaaaactttggccaggcacggtggctcacatctgtaatcccagcactttgggaggtcgaggtgggtggatc

SEQ ID NO: 114306 - DNA, 411 bp, Homo sapiens
gtctgctctgccagggcactggggcgaatgtattctctgtagaggctgactgaagatgccagggaattggggactcagctatggcagagggcagagcagaagcactgtatttgaagagcggtattaagtaaaagttcacaagccaagcaggctcccctccttacagttcaccgtcatcaggaatacctaaaacaagaaacacagtcacttctatctggagaaactgacaagtctaaaagaaaatactgacagaaaggactcatcaacaaaatcgctgggtccccacctaatcatcctatagcaaggcaagacctgacaatcaacaaaccctgctcacatgcactgaactatcagtcggccttttggtttctcactttcacatatgagtgaacagtcatggatcaccagaga

SEQ ID NO: 114307 - DNA, 396 bp, Homo sapiens
cttgaggatccccccgctgtacagttgcgctgtctaactgagagacctgggttacatttcagcatcccccatgtgattccctgctgtccacaccagcaagtctctgagtgcaacccgcagccacgtgcatcataatcagctgagctgctggtgaaggggtagattcctgggcctcacccctgacagatcctatcccagcccctgcgggaggggcccaggaatgcagccagttcaccagctgccctgccaaagcctggcaatctctgggcctagaggcttgagaacggtcaagcagctcgccctggctcccctgggagccaccctagcctggaacgctgcacaccagacaggggtggtagagctcctggccattcccaaatgccccacacccagcag

SEQ ID NO: 114308 - DNA, 417 bp, Homo sapiens
tgaatgagacaagtctagactaaggctagatccagccttaatactgtcccaaaaacacttcttggtatgtaagcctaaatatctcttgacacttaatatcacatgcaggtctttaagctgaggaataattcaaaacaacaatattatcttcacacacatttgtttactacggcaccatttatgctagcaaaagaaaaataaaagcagcagcagcaacatcacttccaaggatagcgtttggcataattaaagtacggaacatccaataagcataactagtcattggaaaactagagagaaaagtaaaacagcattatataaacttgctgcatcctacatagagtgtgtctacctatggacaaagatgaggtgggaatttacttataggcaaatacctgagttatggtaatggggtaa

SEQ ID NO: 114309 - DNA, 601 bp, Homo sapiens
aattttttgcatatgactccaaacccacaggtaactaaaggaaaaataaataaatgggattgcaacaaactaaaaaggttttgtacaacaaagaaaacagttaacaaagtgaagagataacccacagattgggagaaaatatttgcataatgtactctaataaggggctaatgtccaaaatatataaaggagttgcacgattaattagcaagaaaacaaataactaaattcaaaaataggcaaagaacctaaatgaacatttctgaaaagatgacatatgaaggaccacaggtacgtgagaaaaaaatgctcaatctctaatcatccgagaaatgcaaattcaaaacaaaatgagaggttacctcacacttggtacaatggttactatcaaaaactcagtagataagaagtgttgggaaagaagtggagaaaaggaaactcaactacattgttagtggaaatgtacattagtacagccattatgagaaacagtatagagattcctcaaaaagctaaaaatacaattaccctatgatcctgcagttcggcatctggatatatatccaaaggagttgaaatgtataaatcaaaaagagttgaa

SEQ ID NO: 114310 - DNA, 239 bp, Homo sapiens
gaagaggcctcaaggtcagcgtctgctgctgaattactgcaacagcaccatgcagggataactcgccgattggccttccacctgccaggctgcacatgctcaccagcccagggcatggcccctcccagaacctggtccttgatccagcctcatgccctccactgaaatatgttgggaacaccccactctttcccctatattcatgacatgttcattccccgtgaaatgtgtattcttta

SEQ ID NO: 114311 - DNA, 279 bp, Homo sapiens
agggctacagcctgcctttcaccggatcaagaacaaggagactcagcccacagcctggggtacgatcagtcctggtgacaaaaaaccctggcagcctgggacggcgtctgaggcaccttacggctcttagggggctcctgagatgtccacagcctctttcagttgtaccctttcctgaccatctagcaaaacactttctttcccctgaaaagctcctgggtaggaaagcagagagacatatgacccggcaaggcagcccgccccagcgaggagaaggga

SEQ ID NO: 114312 - DNA, 569 bp, Homo sapiens
ccggtaccctgctcgtccctctctgggattcggagatgctcctgctcaacctcccgggtggctgggatgcaggcgcctgccgacatacccggctaatttatgtatttttggtggagacgggggtttcaccgtgttggccaggctggtctcgaactcctgacctcaggtgatccgcccccaccttggcctctcagggtgctgggattgcaggtgtgagctaccatgccaggcatgttccttcatcacaatctcccatagtgccctgtacttcctgaatcagcattatcttaggcaacctctgaaggtctacatagattctctcattcactccttacaacaaaggtgttgattcctattttacagataaagaagcaggcacagagaggtctagtaatttggcccagtctggctccagggcccacactcttaaccacaagggtgtatttgcctcatgctgcttttgggactcttggttaaacatatgtcctcacttctatttgaagtccagtaagggtagtgagtatatctaacttaatcaccactgaattcctagctggcagagaggggcg

SEQ ID NO: 114313 - DNA, 233 bp, Homo sapiens
gccatttctctttatggagcatgtgcagtgttgagaatacgtattttgatgcagtacgtgtagtacagctctgaattgtgtcctttaactttgggtaagttctttttttagtagaccttgcttcttcggaatatttcttttcttatagtgcctaacacaataattatgcccaaattagacaaattaacatttgagtgttcacagatttattactgtatttaaaccattgatct

SEQ ID NO: 114314 - DNA, 428 bp, Homo sapiens
gccagcacctatcacccaagaaaaaagggaccaaagcaaagccaggagtcccagctgagctaatgatcctatcaacaattaaatgaaacacagccaacataaacgtggctactcacacaccatctcgaccactttattttgtaggtggtactgagagtgatcagaggcagacgaggacatgcttaaatacaagggcaagcctgcctggtatgctcgctgggaaagcctcaagccaagacctcagcaactgctgaggtggttatttagacttcacacaaaattctgcgttaggaggatacctccctgacatccactcttgatttaaatcttccaaacagatcaatttgggaggcagaggctgcttgtgtaggtgtttccatatctattttgatttgtgctagaagcaatgagcacgtctagaaaaagaa

SEQ ID NO: 114315 - DNA, 578 bp, Homo sapiens
ggtctggaagcaacttttatttggagaactagacttgagtacgttcaactgaaagccaatgcaagcttctgttcctctaaaatgatgtcttttgcctaagaatagacccctctttcagtctaaaaaccagataaactgtcctacagtgattcaaatagccagcggcctcactccccccaaacttgactaacaacacagcaatataattctaccgtttaaaacttggctgacccaaacgtgaactttcaaagaaaataagagtcattactaaaagagattccatttctttctggggcctaagttaagatgactttccagaactttgaaaaaacttactctttcaatggccacttaattgtgtaacaaagtaaacattcacaagggaggcaaaatataacattccctatgtttagatttttcaaatatctttaaggggtgcattttctttgttgggttgtcatatgtagtttggagtaatttaccaggttctacccaaaagttgtatcatgatcaaggatcgcttgaacccaggagcttgagaccagcttgggcaccatggcaaaaccctgtctctacta

SEQ ID NO: 114316 - DNA, 812 bp, Homo sapiens
tgttcttggctcactgcaacctctgcctcttggattcaagcgattcatgtgcctcagctgcctgaatagctgggattacagatgttcaccaccacacctggctaatttttgtatttttagtagagacggggtttcactatgttgaccaggctggtctcgaactcctgaccataagtcatccgcctgcctcagcctcccaaagtcctgggattacaggcgtgagccactgcgcccagctgcaggcttgctttttaaaactcttttctgcacacttttcctgtgcagaagagtacaaaaataattttgtacttttcctattttatatttatatttgaaagggattactttttccaacattttatttgctttatcatatctttccattaaatgagattacttttagacaaaaaaaattctttaagaaaaacattataatatttccattgcctgttgaaaataatgagttatctaggaaaacctgctgataagtataaattgctacttaactttttaggaaagcaacattaacccttgatatactatcagtgctaattggatccagttttagttttttgctttcttttttttgtaaagattgatatttccttatttgttatttgtagttatttgtaaagactgatacttccttatttcttagaggtcttcaaaagaacaaaaagaaaaattaaaaaaattaaaacaagctgagtgtagtagtaggcacctgtagtcccagctactctgaaggctgaggtttgcttgagcccgggagttcgagactagcctgagcaacgtcgtgagacccgtctctc

SEQ ID NO: 114317 - DNA, 641 bp, Homo sapiens
taaaactgaaattcgtgctatatctgctgttttacaacacaatcttgtcagagattgtgctcttattctctttccttagagaatgctctttcttcagattgtcatagatcttgcttttccattttatttttattttttaattttttattttttttcgtatttttaatagagctggggtttcaccatgttggctaggctggtcttgaactcttggccttaggtgatgtgcctgcctcagcctcctagagtgctgggattacagacatgagccactactccaggcctactttttgtattttttgtagaggtggattttgtcattttgtccaggctggtcttcaactcctgagctcaagcaatccacctgtctcagctggcctcagcctcccagagtgctgggattacaagtgtgtgagccattgttcttgtcctttttttttttctttttttttcctcgaggcaatgtctcagtgtgcctcccaggctggagcgcagtggcattatcacagctcgttgcagcctcaacctgctaggctcaagtcatcctcccacctcaggctcccaactactctgaaggctgaggtttgcttgagcccgggagttcgagactagcctgagcaacgtcgtgagacccgtctctc

SEQ ID NO: 114318 - DNA, 714 bp, Homo sapiens
ctgagatgtgtccagaattgctagctacccagctagaaaagctaccgcaaggtcatctcgggaaaagggaaccacaaatgtcccagttaagaggatggatagtttcccagggttggagtcctttcttttcctagtcacccccaaacacttaagaggcctatgggatgggcaggggagcagggagagcctcactcctctcccatctgttgggagagcctcactcaccaaaacagcgttgccttgtctgtgtcatatgcatcatgtgagtgcatgaagtcccttgctccagggacttcccattaggcctggagtgtctcccatgcaaagagcccgctcctctgttcctgggacacacctctggcagtcccagaggttgcccattcatcttgacttctggaaagaagcctatagtgagaaaggagcatgtagtcagaaaccaccaagtgcagcatagttctacataactcacagcattcagtagttttgtgttgttgcttttctttctttttccatacagtagttcatctgatatgtgcagttacgcagcacctgttaagtcagagggctgggatggtgaggtcgccctgtaaactctgggcaaattactccatttctgagccatcttttgccatctgttagaatttctgatcaggatttaatcggggttggttgtgaaagagtatatgaacatgctttgataaagaagaaaataag

SEQ ID NO: 114319 - DNA, 2487 bp, Homo sapiens
  misc_feature (1345)..(1345): n is a, c, g, or t
  misc_feature (1371)..(1371): n is a, c, g, or t
aaaatttttaattaactttttttaaattaaaaaaaattattaattatttttaatagacaggatcttgctatgctgtccaggctggtcttgaactcctggtctcaagtgatcctcctgccttggcctcccaaagcgctggtattacaggtgtgagtcactgcacctggccaagtttattttttctgtatacatttcttcagccacttcaatcaaacatttaattaacatgctataatgaatgacttttcttactaggctaacaaatgaggcacttggaaacttactttagttacagcctcactttctttttttgtgaggaaattctgtgttgacatactctttaatttctttttaccttttctgactgattttctgtaatttgggaatattgtgatgactgcttattctaataatattaacatatagcattcttttagcacataaatagtttcatttgcatagtaagcgccaggctttgccatcgaatttgataaaataatccatgcttcatggtaccttagagatgggatattttaagtccaattctctctctctctctctctcatttttttctttttggagacagggcctggagttacccatgctggagtgcagtggtgtgactgtagctccctgcagcctcgaactccttggcctcaattgatcctgccaccttaccttctgagtaactgggactacagtgtgtgtcaccacaccttttttttttttgacatgagggatatatgctggtaataaaaataaaattttggggtatggcaataggcatgctactcaaaatgctgccaagttacaaagtgtaactatgatttgtaatggatagcagcagtgacaagtgatgagaatggtctcttgtcatgactactctgttatagtgtaaaagcagccatagacagtagataaatgaataagtatggctgtattccaataaagttttactcatggacactgaaatatgaatttcatataattttgtgtcacaaaatattaaattttttttctagccattaaaaatgtacaaagcataattagctgtggactgtacaaaagcaggaagcaggttggacatggcttttgggccatagttggccaacccctgctagagaacatctatacatagcagccttttgagtagttttgttcatctgaggtcatgaaaaggaattagtattggcagggtgcggtggctcacgcctgtaatcccagcactttgggaggcaaaggcgggcagatcacctgaggtcaggagtttgagaccagcctgaccaacatggtgaaaccccgtctctacaaaaaattagccgggtgtggtggcgcatgtctgtantcccagctactggggaggctgaggcnggagaatagcttgaacccaggaggtggaggttgcagtgagccgagattgtgcattgcactccagcctgagcaacaggagcgaaactctgtctcaaaaaaacaaaaaacaaaaaaacaaaaaaacaaggtggcacagctggcttgagcaactgaactggaaacaagatgcaggaccccaacgcagacactgagtggaatgacatcttaacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaatgtgctattgaaatgtgcagacagcagagactggctgagtggaaagcaactaaactgaagaataaattttgagaagttttggagatctcagggaaggattatgttcaagaagttaccaaagctggtgagggcttgtgggtcatcttgcacctttacaaacaaggaattcccctctgtgccctgataaatcagaacctcagtggacttgccaggaagtttcctgatgtcaaatttatcaaagccatttcaacaacctgcatacccaattatcctgataggaatctgccccgatatttgtttacctggaaggagatatcaaggctcagtttattggtcctctggtgtttggtggcatgaacctgacaagagatgagttggaatggaaactgtctgaatctggagcaattatgatggacctggaggaaaaccctaagaagccgattgaagatgtattgctgtcatcagtgtggcactctgtcctcatgaggagggacagcgattctgagggtgactgaggctacagctgctatcacatgccgaactttcttgtgacaaatgtctggattttttaaaaaaggaaaaagcaagaatgaatccttctggtttttagttttgtataaattatgtttcaaatctttacattttggaaataatcattgctggaaattctgttaaatattttggaacttttttttaaattatagtatttcctctaaaaaaattaaaaccagccattagtaaaaaaa

SEQ ID NO: 114320 - DNA, 2077 bp, Homo sapiens
  misc_feature (1345)..(1345): n is a, c, g, or t
  misc_feature (1371)..(1371): n is a, c, g, or t
aaaatttttaattaactttttttaaattaaaaaaaattattaattatttttaatagacaggatcttgctatgctgtccaggctggtcttgaactcctggtctcaagtgatcctcctgccttggcctcccaaagcgctggtattacaggtgtgagtcactgcacctggccaagtttattttttctgtatacatttcttcagccacttcaatcaaacatttaattaacatgctataatgaatgacttttcttactaggctaacaaatgaggcacttggaaacttactttagttacagcctcactttctttttttgtgaggaaattctgtgttgacatactctttaatttctttttaccttttctgactgattttctgtaatttgggaatattgtgatgactgcttattctaataatattaacatatagcattcttttagcacataaatagtttcatttgcatagtaagcgccaggctttgccatcgaatttgataaaataatccatgcttcatggtaccttagagatgggatattttaagtccaattctctctctctctctctctcatttttttctttttggagacagggcctggagttacccatgctggagtgcagtggtgtgactgtagctccctgcagcctcgaactccttggcctcaattgatcctgccaccttaccttctgagtaactgggactacagtgtgtgtcaccacaccttttttttttttgacatgagggatatatgctggtaataaaaataaaattttggggtatggcaataggcatgctactcaaaatgctgccaagttacaaagtgtaactatgatttgtaatggatagcagcagtgacaagtgatgagaatggtctcttgtcatgactactctgttatagtgtaaaagcagccatagacagtagataaatgaataagtatggctgtattccaataaagttttactcatggacactgaaatatgaatttcatataattttgtgtcacaaaatattaaattttttttctagccattaaaaatgtacaaagcataattagctgtggactgtacaaaagcaggaagcaggttggacatggcttttgggccatagttggccaacccctgctagagaacatctatacatagcagccttttgagtagttttgttcatctgaggtcatgaaaaggaattagtattggcagggtgcggtggctcacgcctgtaatcccagcactttgggaggcaaaggcgggcagatcacctgaggtcaggagtttgagaccagcctgaccaacatggtgaaaccccgtctctacaaaaaattagccgggtgtggtggcgcatgtctgtantcccagctactggggaggctgaggcnggagaatagcttgaacccaggaggtggaggttgcagtgagccgagattgtgcattgcactccagcctgagcaacaggagcgaaactctgtctcaaaaaaacaaaaaacaaaaaaacaaaaaaacaaggtggcacagctggcttgagcaactgaactggaaacaagatgcaggaccccaacgcagacactgagtggaatgacatcttaacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaatgtgctattgaaatgtgcagacagcagagactggctgagtggaaagcaactaaactgaagaataaattttgagaagttttggagatctcagggaaggattatgttcaagaagttaccaaagctggtgagggcttgtgggtcatcttgcacctttacaaacaaggaattcccctctgtgccctgataaatcagaacctcagtggacttgccaggaagtttcctgatgtcaaatttatcaaagccatttcaacaacctgcatacccaattatcctgataggaatctgcccacaatgaggtgatttcttcacgatgaggtgatgggatcctctagatca

SEQ ID NO: 114321 - DNA, 372 bp, Homo sapiens
gtatacacccttctaaggtctgttctggcccttccctagggagtgccttcccctctacctgccaggtcccatagataaggatgtcctcccctgcaggcgcctggcctccatcacagcatgcccactctgtgcccgctgcaacctcctctgactctcccactagaccggtgcctggtacacatgctcctgcgtgcatgaacatcggtcagctatgggtcctcaagatgacaaaaccccctgctcctgtgtcctcacggggatctgcaccagcactgggctgaacactctccctgcaatctgtcagtcacgtcttctgtagcattttctttctggcaacaacggttggggtcattaaaagtgtctttgaaatgc

SEQ ID NO: 114322 - DNA, 691 bp, Homo sapiens
gtgaaaataaaatatacttaatggattggcagtcttttacgttagctcagctggtgtctgagtgcctgtttgtattcccacgtactttactaggccccagggatagaaagatgaataaaactcagtgcctgcgcttaagtcaccctcagattggtgaggaacacaggtggttttgtgagcgtcagggaaatgtggcaagtctcactcaacagaggttgcattgggcacagaggatgggtaacgaagttccctgggtgacatgaaactgaagttggcctaagggatgaggaagcattggctggataggcagaggtctttctagttacaagctccgaaacagcatgggatatagttctggagctaccagcaagagggggctgctgtgttaaaacctcgtgagggccaagtgtggtagctcacacctgtaatcgcaacactttgggagaccgaggcgagagggtcacttgaggccaggagtccaagaccaacctgggcaacacagggagaccacatctctacaaaaaataaaaataagtagctggatgtggtggcacatgcctgtggttccaggtacttgggagtctgaagtagggggatcgcttgggcccaggaggttgaggctgcacagtgagccatgatcacaccactgcactccagcctggatgacaagtgaggccctgtttcaaaaaaa

SEQ ID NO: 114323 - DNA, 584 bp, Homo sapiens
cctggcttgctcaggtctgtaatcgcaacactttgggagaccagagcaagcaggcacaggtggttttgtgagcgtcagggaaatgtggcaagtctcactcaacagaggttgcattgggcacagaggatgggtaacgaagttccctgggtgacatgaaactgaagttggcctaagggatgaggaagcattggctggataggcagaggtctttctagttacaagctccgaaacagcatgggatatagttctggagctaccagcaagagggggctgctgtgttaaaacctcgtgagggccaagtgtggtagctcacacctgtaatcgcaacactttgggagaccgaggcgagagggtcacttgaggccaggagtccaagaccaacctgggcaacacagggagaccacatctctacaaaaaataaaaataagtagctggatgtggtggcacatgcctgtggttccaggtacttgggagtctgaagtagggggatcgcttgggcccaggaggttgaggctgcacagtgagccatgatcacaccactgcactccagcctggatgacaagtgaggccctgtttcaaaaaaa

SEQ ID NO: 114324 - DNA, 654 bp, Homo sapiens
tttctctcacagaactgtaactagtccgagataagttagaggatggaaaagagtagaatggtgcaagaaattataggaactaagattagaaaaagagtcaaggaattcttaatggagcttttatatactatgctacaaaaattgagtttattctggaaataatgacgatgcatcaaaaggttgaaagtggttggaggataaattggatggaacataaaaatattttttaattggaaaatatgaaaatgaggagaatcataaggagggattccaggcaaggaaagcttgtatccaatgcatgttgctgacattatgctctgcagattctcattacaccaagttcttctgtgttcatctgcttcctcaaggccattatccattgcatctgtctcagctcagctgatgctctggcagtggttctctgcgttgagcattgctgccacacacctttggtctttaaacctgaactggaatgaagcttaaactgaaatgtagagggcaaatggtgtgcaaaacaaactttaagtagtagtgattaatctttccaatgaatttttctgtttttagcccattaattttcaataaacattaatgaagtacttatcatgtattagccactatgttacctccaaaaataaagatgatagataaacg

SEQ ID NO: 114325 - DNA, 412 bp, Homo sapiens
ggagaccggtggtgcagtcttggctcactgcaacctctgccttctgggatcaagtgattctcctgcctcagcctcctgagtagctgggattatagacatgcgccaccgtgcccagctgatttttgtatttttagtagagatggggtttcgccatgttagccaggctggtctggaatcattttaaaaccaaaaggtttgtatttaacttacttactaagattattgtattccgccagatgcggtggctcacacctataatcccagcacttcgggaggccaaggtgggcgaatcactagagcccaggagtttgagaccagcctgagaaacatggtgacaccctctctctacaaaatataaaaaaattatccaggtgtggtggtgaatgcctggagtcccaactgttcaggagtc

SEQ ID NO: 114326 - DNA, 350 bp, Homo sapiens
gtttcagtgagccgagatcataccactgtactccagactgggcgatagagtgagactccatcttgaaacaagcaaacaaacagacaaatatttagtgggtgtatatctcctttatgggccttccctgactgctctttctaaaattctatgcccctattcctttaccttactttattttccttagtaacacttttctatctggcactaatatgtatttgtttattgtgtgtcacctctccagatcataagctcctcaagggcagggactttgttggtcttgtccatctctgcatccgcagagtgacaattgtgcctggcactggatatacatttattaaatgaatgaatga

SEQ ID NO: 114327 - DNA, 205 bp, Homo sapiens
tatgacttgaaatacaaaatacagaaaaatagtaagagagctactgtcaatcatgagacagagaaaatatctatattccttgaatttgacttccagtttattacttttagctaagacaagccacgtcttgaaatcaagtcatctttgatttttcccttttcttttgccactaccattcacagttgtcactacctaagtattaaag

SEQ ID NO: 114328 - DNA, 552 bp, Homo sapiens
tgtggtgttctagaggatccttgcgatcatcggcaccgagttggcaggccagatttggatgagtcttctgtccaccattcaaaatgcacgccctctgttcctggagaaagcagtgctgggaagcttcgtcccgggggatttcctctccaaggcctttttcatttggaaaacccacaaagctcctaccaatggcttgcctttgtctgtctccccattaggttgggacctgaagagggcaccccttagcctagcacagggcctggtgcatagagctggtcatcccgcactgccctgcagagcacatgaatgcgggagtcggacgcactggccagcaaccgcagcagcaatgacaaacatctccccaaggccaggaccaagggaaagccacgtggatgggaaacccaccctccttggctctagggtgcctcgagctcaatattcctgcaggtaactgcccgtcgaccccttgctgatggcctctgccagagcagaagggagagggtctagcgggaggtggtctgagcaggtgcatggagcctccagcctgtcttt

SEQ ID NO: 114329 - DNA, 414 bp, Homo sapiens
cacacacacacacaccactctgagtacacatcttcacaaataatagtcatccctttgtcattgccgccaatatccaggcgaggtatcgggagacccccgacctgcggcttgctgcccctcctgctgcctccaaagcagctgagcacaaagttggggggggggtgccgctgagcaggaggcagctcctttggcaccccaccccaccacagtgccgaggtaagtgtcgcgcagggccggggagggaacagcagcaggaagaggggacctacggagcgcacagcagcactaggggaggctcgcttccttcctgacgcctctacacggaacatggatttgagtcttactaaaactgtgtacagagacaaaaagcccactcagcacaaacagagttgtctgttgttagccttcaaaatc

SEQ ID NO: 114330 - DNA, 522 bp, Homo sapiens
atcttgtttacactctccttgagtacctgcaaaactataatgatagtagagtgaaggaagagctgacgaaaaaagttaactttcaaatactttgactgtacccacctactaaaatctctctgtatgttatcaaattaatatttgttaatgaacacatagagatgctttaaaatttacataatggaatttatataattttttagattttttaaatctcatggtagattttttttggttaatgtgtacattgttctctaaaaactagatgtcaaggcccacctgttcccaaatcaagccctcaagcatgtccatttgcccacccaccatccagcagccccaggacttgctccttggagagcatgcttcccttctctctggcacaaatctctgctgtcctctggcaggcccttctctctggcacaaatctctgctgtcctctggcagatgacaggggacacattgtgactgacatcttattgagttacaggttctagattttaagcttcttttcttaaaaaaaaa

SEQ ID NO: 114331 - DNA, 302 bp, Homo sapiens
tcttggccacagggtgtaaaggaggctttggacttagtgatcccagaggttattccctgctctcatgccagtattcttctgcagctttcctcatcaatgtttatatatttctttcttttttctgaaacttgctctttcactctgtctctcccctagggaacactaaaaatagcctgtaggttaaggaatctccaaaacacaggtgtgatttgtttgaaattctgtttgactcatgtgtgttgagttacttctaaattcaaggtattgtgactacttgaatgatattttttagaaacaaaata

SEQ ID NO: 114332 - DNA, 383 bp, Homo sapiens
gggtacatgtgaaggtttgttatacaggtaaactcatctcacagggggttgttgtacagattgtttcattatccacgtattaagcctagtacccagtagtttctttttctgctcctctccctccctccaccctctaccctcaagtagaccccagtgtctgttgttccattcttaatatttataagttctcatcatttagctcacacttataagtgagaatatgcaatatttggttgttcctgtgttagtttcctttatcataaggaaagttatggggttatctcacagaactcaaggactgaaagttcagccaggctttggagttcttgaaactagtaaccgggaagcagtcagggaccaaggcaggatctctttttgtcttt

SEQ ID NO: 114333 - DNA, 156 bp, Homo sapiens
atgaatagattgcttaggaatttggtagctgtctctacttacaaatgaatttctattttcattaatataattttttataatagctatataaactagatcagtattgactttttttttttttttggttggaaagggggttggaattgcccccacagc

SEQ ID NO: 114334 - DNA, 304 bp, Homo sapiens
taatgctataacaacacatgctcacattcctatgtactgtcaaaggtttaatgaatttagtggtttttcttctaaaaccaggtttgacttaatatgactcccacatttattgtattaacaatagtttacttcttagacatgagtggaagtgcaaagtaaagtgctttactaaagtcaaaaatcagctgggcatggtggctcacacttgtagtcccaacactttgggaggccaaggcggacagattgcttgagcttaggagttcgagaccagcctgggcaacatggcaaaaccccatctctagaa

SEQ ID NO: 114335 - DNA, 260 bp, Homo sapiens
ctgccctgcttttaaaaaaaagaaaattagttttttagagatagggtcttctgattttgcccaggctggtcttgaacctctggcctcaagtgatcctcccatctcagcctcctaaagtgttgggattacaggattgagccactgcaccctgctttttgaaaacacttagaaagtttaagttattggaggaaattatatttgcataatcaaagaatttctcattctgcaaaaggaagcactcagtaataatagttaatatt

SEQ ID NO: 114336 - DNA, 430 bp, Homo sapiens
cttctatctcatcctgtgattagaatgtctaaccatctgggaatgcagcccagtaggtttcagccttattttacccagctcttattcaagatggagtgctctggttcagacgcctctgacactaacatacatggaaaatgcacttaaatatagccagaccagtaatatgataacctgtcttttgggcggggcaggcttaaaattgagtttttgactgtgtactcatataaagggaataccttcttgtaaactgactaaaatcaaagaaatggaatctctttagacgtttacattgttttatcttgtaaacaatcagggacagttacaacagagtgggacaaatgctagagtgggcagtgcgggtaagccagaagcccaggaggggagccttaagtcggggaaaagtgccccaggcagaaggagcagcagg

SEQ ID NO: 114337 - DNA, 389 bp, Homo sapiens
tactatgggcagatttagatattagtataatgtgctgggtaatatgaattcgtcaaagtaatagagtccattaatgtttatagaactgtctgttaacatgacatttggctcaaactagtaatgctacagagctacagaaacttgagccagcaatgtatatctgtaatactttttttctgcaattataatttgtgactttattgttggatacatccttgagactttttttccactccgccactcagtgctacaaagaatacatcactcttctactccagtttcccatgccagaaacagaagacttgtctttggcttccttcttgataattattggtattagattagagatggaaagtcaggagaatcccatcaattctgcctccacagat

SEQ ID NO: 114338 - DNA, 709 bp, Homo sapiens
ctcattttctccttttatcgtagaggtgttaacttttctttgcctttaaacgtagtgaaagtgtatcacagtgagaccttcttttcggggagttagagcaattttgagattggtggggaaaagccattaacacttttgttgataatctgaatctattggccaggtgtggtggctcatgcctgtaatcccagcactttgggaggccaaggcaggtggatcacttgaggtcaggagtttgagaccaacctggccaacatggtgaaaccccatctctactaaaactacaaaaatcagctgggagtgatggctggcgcctgtaatctcagctactcgggaggctgaggcgtgagaatcgcttgaacctgggaggcagaggttgccgtgatccgagattgcaccactgcactccagcctgggcgacagagcgagactctgtcttaaaaaaaaaaattctgaatctattgataatctgaatatctgatatatgtaaaccactcagtaacatcctgttgtcagagaaagctaaactaatcctgccctgagttttaagcctgcgcttacagttggacttgtgatttgatttgatctttgtgtttttttggggtattttgctccctagaactcaccccgaattattgtatatagtaatctgccgcagttttctaaagcaatttataaataaaaggaaaaattactacttttttagtga

SEQ ID NO: 114339 - DNA, 307 bp, Homo sapiens
agccaggcgtggtggtgcgcgcctataatcccaactactcgggaggcagaggcaggagaatcacttgaaactgggaggtggaggttgcagtgagccaagatcacaccattgcactccagtgtgggcagcaagagtgaaactcaatttcaaaaaaaaaaggaaaatgatgttcaggttctactgggagtcaatcacatgtgtccgtgtaaatcatggtagagacttaagtttttactctgagtgagttgggaactcattgaaagcttttgagcagaggttggaacataatataaatttgttttttaga

SEQ ID NO: 114340 - DNA, 292 bp, Homo sapiens
gaggcctggaatggagaaggggggtgtcagtgagatcagtggaggctgcagaggtccagcaatgctgaaggtctgaaatgaggcagtgatgggttgaagataagaggcagatattaaacttttatgaggtagaataggcaaatgttgatggcttagggaagtaggggggataagggatagggaagagctagagtgaatgagtcccagcttgagagactgggagagtttgttcactgagatccagatatagcccaataagatctatacccacctgcttgtgattcttattaag

SEQ ID NO: 114341 - DNA, 310 bp, Homo sapiens
ggacatttacatggagatctgaagagggaacagagtcttcctggtggaggtgaataatggttgggggtagaaggggaaaggtctcttaaaactgtacatgaagtatggattagagagactaagggcctcctttatggcagataggactttgccatcattatttcagttgtggacaggtgtttggggcttttcagatgcaagattcctagaagtcttacttctggaaaagtgtctcagattaaagtcacacttcctacaatttagatttcccagtttgacttttaagggaactccaacttcttgaaacttt

SEQ ID NO: 114342 - DNA, 457 bp, Homo sapiens
ggccgtgctcctcttccggggtgactctcacagctgtgttccttggggctcctccaacgtgaccctcctgtggcggccccaggcctggagccggtcatggctggatggggacggcctccggttcctgcctgcgtgtgtttcttgacgctgctctaaggtctcaccacagcctggcagtctcaagcagcacaaacttattaccctcctgtcctggaagacaaaactgaaaatcagtcttgctgggcgaaagtcaaggtctgggcagggcgggctcctgctgggggctcctcctgccttctcggacttcccaggctgcccaaggccctgggctgctgcccggtcctcccctcctggtctccactcagcatctgctctccgggtcctgctgctgctgtcacacttcctcccctgacccctccctcctgcatggagggaccctgagatgatgctgcatctg

SEQ ID NO: 114343 - DNA, 263 bp, Homo sapiens
agcttatttttaattttttgtagagatggggtttcaccatggtgctcagcctagtcttgaactctgggctcaagcaatcttcctgcttctgcctcccaaagtgctgtgattacaggcatgagccaccatactcagcctacaaacagatcttcatggctgaaattgcatgactgattatggttttaacagcaatggaaatttaggttctgatggtgttcctattcactttgctcctgctgagacttttgtactctctagagctg

SEQ ID NO: 114344 - DNA, 124 bp, Homo sapiens
acccaggagatgtcagaggtcatgcccatccccatctcaaagggggctctgggctctctgcctctcttcaggagtggagagggagaatggcctttgggccccagcagggactgctgagtgacac

SEQ ID NO: 114345 - DNA, 129 bp, Homo sapiens
aatcttagcaagcgagattctcagatacagagtctacgaacaatcagggctgcccgtagctgctgcctcccacaggaggtgcccctgggcagtccccaggccctgacctgcagtttctgtgaaaacacc

SEQ ID NO: 114346 - DNA, 735 bp, Homo sapiens
tatttgttctgtaaatgaatgaaactgtggagctgaaattcaggtctgttcaattctagccttccactatcccaggtgaacaatgcaagaccaagtgagataggttctgtgagtgggaggccaggagtttgctgtgaaattccacggaaagaacagacatactatatggggggttgaaggagggagcttgtgagcttgatcttgaaagatgagcagaattttaagaataagcaaaagggaaccacataactgacaaagcaggtgtgagtgagcatgacttacttggagagtggttaggtcagggttgttgggggagtggtggcagataagggaaataagagagggcatgataatgggaagatgaagtctaatttgggaccagattataaaaggcctttattttatgcttagtatcttgggttttattttgtaggcaatggggattctataactttttaagaaaaatctttttattataaaacacagatattgaaaaccacataaaataaatgtatagcttaatgaactcttataggcttaactcttgtgcaaccccgcccaagttgagaagtagttctttccagccatcccagaagtccatccaggtgttttgtcctaattacaacttccttccacaaaagcaaacactatcctgacttttatagtgtttcttcatagtttatctaccacatgtgcagcccctagataccctagttttgctcattaaaaaaaaaa

SEQ ID NO: 114347 - DNA, 148 bp, Homo sapiens
tccaggaattaggcaaatcaggattaggtcaggaagcaaggattgcctctccatgaaacctacacaaatctccatgccatggaaaagtaattagtaagtagatgagctcatttatgaagtcacctctcacggtgcctgatgcatatta

SEQ ID NO: 114348 - DNA, 343 bp, Homo sapiens
atgagacaccgttatagccgctgtgacagggaaatcgctggaggctttcacctcgaacgactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccag

SEQ ID NO: 114349 - DNA, 445 bp, Homo sapiens
atgtgaacaaatgaagagctgtttcttatgaatgagcagagaaagtggtttcttgagaacgaatcttctcatggtgaagatgctgtgaacactgttgaaatgtttgatatttaccagtttttacttaacaattgaatctattatttgtacagttcctagccataaaatactccagtattatattaaattatttttctctattttattcctttagacaaaagatttacaatagttcattgacttagttgataaagcaacagcagggtctgagatgactgactccaattttgaaagatgctctactgtgggtaaagtactatcaaacagcatctcatgctacagataaaccttttgtgaaaggaagagtaaatcaatgtggcaaacttcattgttgtgtaattttatgaaattgccacagccactccaaccttcaacaaccaccacc

SEQ ID NO: 114350 - DNA, 645 bp, Homo sapiens
actgttgagccttcctcatgaatggcacatcctgcgttaaggacattagggaaggttataaggaaacaattaagatatatgcccccttctttgcctaaaagtaactcccagtgtgcaccaatatattggctcctttgatagccatcattagaggatgcttcctgcaatcatcttccttcttaatcagtcaccaggcgtacttctcaaacaggaaaaaatggcttaaccacagcaagaagagacaaggggaggggagagtaaggaaaagattcctctacttttgagacggattgctttagaaagaaagcaaaacgtaatcatgttatccttggtctggaaactgaagaaagggcccccttactgcgtcaccccaaggaaagaagaaggacctgaaactcaacatccctatgcctttctagctgtcattcctagccattgtttctacatgtccacagaccccatgcctccatcctgagccttttggacttatagagtttaggttaagcaatatactatgaataggcacatgggttacagagaacaagagaaaaggatattctcttaggaagagccaagagagaaatgggacacaacagcatgacacagcggtcaacacaggccttggatcagttgactaaccttgaa

SEQ ID NO: 114351 - DNA, 249 bp, Homo sapiens
aagtaaaaaaaaaaatacagtcttatgtttttatgagatttggctgtaatttgttgtttaaataaccagctgaagctaacttgtaactttcagagctataatttccctaaattgtgaaatccaacaaacatattgaaaaatcaataaaacacaaaatattcagattaccaaatcattataaactaaacacttttgttagtataacccaagccaagcagttgaaccttgctaatactcccagaatccctt

SEQ ID NO: 114352 - DNA, 364 bp, Homo sapiens
gaaaatgagtaaaattttccaaaaagtcaaaatttacaatgtgtcaaacggaataattaaaataaatccacacgtagaaacattccacagaaattggaaaatatcacaagaaatcttaaaagctaccaaaaaagatagattactcatagagtaagactgacacagatgttcctccaataatagatgacgaagtatattaaaagtgttgagaaagtttaataggcaatccagctaaaagtaagggcaaaataaggacatgttcaaaaaagactcatagagtttattaccagagacctttattaaatgaactgctaaagaatgtactttagtaaaaatacaagtaagccctaaggaaggagaaaca

SEQ ID NO: 114353 - DNA, 130 bp, Homo sapiens
ccataaaatcatccagtactttttggggaaggagtggaatcttttactatattcaccatatttttctggttatgggtttactctatttttctacttcttcttgagggacaatttaggtaatttccatttc

SEQ ID NO: 114354 - DNA, 133 bp, Homo sapiens
actgcactccagcctggcgacagagtggtctcaaaataataataataatattaataataataattatggagcagtaaattagctactaatgctagatattctcttttggtaaaaatctgatttactttttggt

SEQ ID NO: 114355 - DNA, 169 bp, Homo sapiens
gggatacagcaatgagcgcaaagatctgatgctctctctgatactcgtggtctacttgagtagacaaaagtgaaacaagcgattccattaatcaatggatacttatgaagtataaaaatgaaagaaaagtgcacagtaatatgaaagacaataaaagaaaaacacattt

SEQ ID NO: 114356 - DNA, 308 bp, Homo sapiens
aaaagtaaagaatgatcatcactgttgaagaaatcaataaagaatggcaggaacataacagttactatggctgtttttatttgctttatagtttacattctaatctgctaatgtatacatactacttttataatcaggaagtttttaatttttaacacaaaaaattaacttttgtcttccctacatgaagattatattgttggacctgagctctgaatagttgtgactgacactgctaattaatcactatgtacttacaacatctcagagttctaatcccacctcacattcataaacagggtatgact

SEQ ID NO: 114357 - DNA, 787 bp, Homo sapiens
gtaagtaaaaaagcttcctttgtatacctggacagcaccagtgaataaggggttaataatactactaagcttatagaagggaagattggtttgcctttgttttcgggaaaaacttgatggtggctgaaaacatgatggctctgcttggagggaaatgcttgttttcctctctctaagtataaatgctcattcacacctttcctgactttttgagaggtggcaaaatgcccaagattgattgccagttacttgtgttacctgaatgaggcccttgtgagtctctgatctaggaaaaacaacttgaacactcctatcgttaggttctaatcagtttttgagattcctgttcatttcaactctcaactctcttttcataacaactacttattttagtgatttatttacatatctactgccttatgtcattttctacattctcttcccacacctactggtaccgacactgaagtttctttgtcacagaaacaaacccttggagtattttgcccttcgccttcacccactgctcaaatgaggaaatgcaacagggttggaaacttcacagagcatagtcatcatttgattatgaatttccaaacccttcatgtttgacactttctagaacatttcctgctggccccagacactgtgaagaccctacagcttaagatagtaggaatcaaaaggttgtgtattttgatacatttgctctactatctgaaaaataggcattgtgagaatatgttgcctttttaaaaaataacttctctttaaatagttacctagg

SEQ ID NO: 114358 - DNA, 522 bp, Homo sapiens
agtccattcatcattctccatttactataaacaatctttgatttcactaaccagttttttcatttagttttggttgactatacactcaaataagaatctgattaactctaggaaagcaactgacatctgttagcaataattcaggtagtgttccttgttttaaaagtatccaattgtgtgtgatggtgtacacctgtagtcccatctacttgggagactgaggcaggaggattgcttgagctcaggagtttgagaccagcctgggcaacataccaagacccaagcttcaaaaaaaaaaaaaaagtaaaaacatctgaaggaagagtcatatttttaaaactcaaacttgctttataaaaatagatctataacaaacttccttttgaaaattcattatgtcctttaaatgcaactcaagttttaaatatttttttttttgagccggagtttcacccttgttgcccaggctggagtgcaatggcgtgatctcggctcactgaaacctctgcctcccggggtcaa

SEQ ID NO: 114359 - DNA, 595 bp, Homo sapiens
gccggtggactcagaggtcagagaacagaactcaacactgcatggcttcccttagaacctttgcccaattctgaagctgtgggtggaagatgagaagccacacagagagcctccgaataacataggagcctcttggccatcttgaggtgctgatgagatgaggatcggcctgaccctcgagcccagcagagcagggcagcccagaagcagatgacactgtcccaaatgtgtggccaccctggagtcagctcagtccctgcacggtccaggggatccccctctactcggtctgcctggcggagcaaagggtgagccctctagaggaaaatgtcgccatcctagacctctgcagtctttcctatgcgttcagcaacagtttaccgggcatgccacgagacaggaccacagcaccgaaaaccacgagaaaaaaagagcagtagagccacagtgggagaggccgatgttatcagataaggagcctaaaataaggggaaaaaggaaaaattggagcatttcgccaggtaatttgaatctactaaaataatcaaatggaaattttaggcctgagaaatatagtaactaaaattcaggcctc

SEQ ID NO: 114360 - DNA, 1812 bp, Homo sapiens
  misc_feature (21)..(21): n is a, c, g, or t
ccggaaggcacggcgctcagntcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgctagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagtagtttgaatatag

SEQ ID NO: 114361 - DNA, 1796 bp, Homo sapiens
tgctggtaccggtcaggagatgttagggatgtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgctagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagtagtttgaatatag

SEQ ID NO: 114362 - DNA, 1771 bp, Homo sapiens
  misc_feature (21)..(21): n is a, c, g, or t
ccggaaggcacggcgctcagntcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgctagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagtagtttgaatatag

SEQ ID NO: 114363 - DNA, 1758 bp, Homo sapiens
  misc_feature (183)..(184): n is a, c, g, or t
  misc_feature (195)..(195): n is a, c, g, or t
  misc_feature (201)..(201): n is a, c, g, or t
  misc_feature (219)..(219): n is a, c, g, or t
  misc_feature (226)..(226): n is a, c, g, or t
  misc_feature (238)..(238): n is a, c, g, or t
  misc_feature (241)..(241): n is a, c, g, or t
  misc_feature (246)..(246): n is a, c, g, or t
  misc_feature (251)..(251): n is a, c, g, or t
  misc_feature (255)..(256): n is a, c, g, or t
  misc_feature (267)..(267): n is a, c, g, or t
  misc_feature (272)..(272): n is a, c, g, or t
  misc_feature (277)..(277): n is a, c, g, or t
catttacaatatactcatccggacaatgacaccataaacaatactaccaatcaatactcatcattaataatgatggatggctacagcaataaaactaggaatagccaccctttcacttctgagtcccagaggcttacccaaggcgtgggagaggcatgatgaggaggatggtgtggacaccanngaggaagaccngacacnggccggggaggaagacgntaaaganaccagggagganganggtgnggacnccanngaggaagaccngacangggcnggggaggaagagggtgcagactccggggatgacacagaatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgctagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagtagtttgaatatag

SEQ ID NO: 114364 - DNA, 1195 bp, Homo sapiens
tacccacaagtgggaatgagagcctggacttggaggtctcatgcatcctgggccatcagaaaaggctgtgatggtttctaaaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagtagtttgaatatag

SEQ ID NO: 114365 - DNA, 1083 bp, Homo sapiens
gacgggccaggggaggcgtctcaccagacagacgtgtagacgggccaggggaggcgtctcaccagacagacgtgtagacgggccaggggaggcgtctcaccagacagaggtgtagacgggccaggggaggcgtctcaccagacagaggtgtagatgggccaggggaggcgtctcaccagacagaggtgtagacgggccaggtttccacagtcgttcatgcagtggtattttgtgctgagctctgttctgattctctcttctggtagcttctcatctcccagatatgtcattctgtgtggaagcgtaggtttgagaccttccttaagagaggaaagcttatctttagtttatagaaataaaaacaaaactgtatttccaagcaaaactgactttatgtaggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagtagtttgaatatag

SEQ ID NO: 114366 - DNA, 876 bp, Homo sapiens
  misc_feature (21)..(21): n is a, c, g, or t
ccggaaggcacggcgctcagntcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagagaaaatgcccagagcaagccccaagcacagccttgcagctgcagagccgatggagcctccagggccctcaggagccagaggccaggagaagcaaggatgggacccctctctctctgaccctccaaggtcagtgtgggaacacggcacacaagaaggaagagcctttgagcttttttggttgcagttttaagcacagagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacggccttcgtgcgcttcgggatcctctagaa

SEQ ID NO: 114367 - DNA, 372 bp, Homo sapiens
  misc_feature (21)..(21): n is a, c, g, or t
ccggaaggcacggcgctcagntcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacacactggctctgagaccccgactgcccgacggctctacactgccagcgggcctcctgagggctacgtcccctgttggccggagcccagcagctgtgggagccccgagaacgcctccagcggggatgacacagaagaatcaggagtcctcatgaccagcaacagaatagactcctgtaga

SEQ ID NO: 114368 - DNA, 368 bp, Homo sapiens
agtgaaccaagggttcacaccccagtgaaatacaaatattcagaattgagccactgtgttgccatactgattatgtaatgtgtgattaacaagtataatgtgtcactttcaacatcagtttcatgccaaagttgcattttattagattatttgggagttcactttgggcccaaaggctcgtgtctacataataataacttatgatttttctttttgtctttgttttattttttgttttgtgttttttgctttctagaccatgccagagtaatctcagctttctttagttactggatcacacatatccttcctgagaagagcagtgactaaaatggaatatctctttaagaacagctcctctttaacaa

SEQ ID NO: 114369 - DNA, 1494 bp, Homo sapiens
  misc_feature (21)..(21): n is a, c, g, or t
ccggaaggcacggcgctcagntcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgctagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgatcaggatcctcatgaccagccaaagagaagaagaattaggaagcataaatcaaagaagaaactttaaaaatcccaataatgttcttatagaacaagcagaattagagaaacagcagagtctgttacaggagaaatctcagcgacagcacacagatggcaccacaataagc

SEQ ID NO: 114370 - DNA, 2011 bp, Homo sapiens
  misc_feature (21)..(21): n is a, c, g, or t
ccggaaggcacggcgctcagntcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagagaaaatgcccagagcaagccccaagcacagccttgcagctgcagagccgatggagcctccagggccctcaggagccagaggccaggagaagcaaggatgggacccctctctctctgaccctccaaggtcagtgtgggaacacggcacacaagaaggaagagcctttgagcttttttggttgcagttttaagcacagagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgctagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagtagtttgaatatag

SEQ ID NO: 114371 - DNA, 1527 bp, Homo sapiens
tacccacaagtgggaatgagagcctggacttggaggtctcatgcatcctgggccatcagaaaaggctgtgatggtttctaaaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgctagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgcctcgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagtagtttgaatatag

SEQ ID NO: 114372 - DNA, 866 bp, Homo sapiens
  misc_feature (3)..(3): n is a, c, g, or t
  misc_feature (6)..(6): n is a, c, g, or t
  misc_feature (10)..(10): n is a, c, g, or t
  misc_feature (18)..(18): n is a, c, g, or t
  misc_feature (20)..(20): n is a, c, g, or t
  misc_feature (23)..(23): n is a, c, g, or t
  misc_feature (100)..(100): n is a, c, g, or t
  misc_feature (112)..(112): n is a, c, g, or t
  misc_feature (123)..(123): n is a, c, g, or t
  misc_feature (175)..(175): n is a, c, g, or t
  misc_feature (297)..(297): n is a, c, g, or t
  misc_feature (393)..(393): n is a, c, g, or t
  misc_feature (553)..(553): n is a, c, g, or t
  misc_feature (725)..(725): n is a, c, g, or t
  misc_feature (787)..(787): n is a, c, g, or t
ccntcntctnacggcgancnttnactcgccactgcacaccagtctcagactatctgtccccactcctccgccaggagtctccggatcctccacaagatcntctcaccccccntttcaggctgntcagatctcataaatatgtccatttttctacaactgggtgtggagcggctcntggtggagagtgtccacagccttgaccataagtcacctgcccctaaagagggtctgctactgggaagtgtgccgctatttcagaggatggacaccgactcacgtgacacacagcaagcagangtctgcgaacagtgtttctgcaggcaccaggtagatgtttcaactggtcactggaattcacaccaattttttgtgctatgagtggcattttaggtncgtgatctcatccaagccttccaaagctgagaagaagtccttcctcacagacaagaggacacagtctcagaaaggcaaaaccactgctataaagccacatagcaagcaaaccagaaattcaaatcatgttctggttggttgtaaggtctataatactttntctttttaaccttttacttcgaaataatatcagacttaaagaaaagttacaggaagagtacaaagcattcctacatgcccttcacacagcacccagatttcctaaaggttcactttttaccatatatgttttgtccatctgtctatccatcattattttctgaaccagttgngagtgagctgcagccctaatgtctctgtattcctatatgcgtctgtgtagcttcctaaaacncagggtttatcttacctgattatagtacaatcacggaaatcaacagccttgttacaacactattttatgcttttttttt

SEQ ID NO: 114373 - DNA, 620 bp, Homo sapiens
gcaccatgtgcggtaagcattaggtaattacatttcacttgtttaattaagtttcactttctggttgccttgagggaactgtaggaaaggattttgattttgtttttgtttttgtttttcctgatgctttttttcttttttcccctagctagaagctgaataattccacacagtgttgaaatggatatgctgtgtttgtgttggccgaattaagcatctataatcatgtatttcctctcttttgtctatttgtgtcacagtcttaatatgtgggatagaaattttgtttagtggagacataattttttgattgtcttagggcttatttaaaccagctcatctccattataatgtgtttctgtactttactcatcagcttggcactgactccactattgttttcttcaaatactgtgtattttccctgaaagtccaagtagctgacaattttgctacctctgcaaggaaatctgctttattttctcctaggttttacacatatataaaactatacattagggacatactgttcctcagcaggctacatggcctttcattcactctcttaaaaatatctgtggacctattatgtgaaataatgtatgatttgctcaatggga

SEQ ID NO: 114374 - DNA, 493 bp, Homo sapiens
gtgatctagaggatctgcacactgggttcgagttctacacaaagccattcaaggtacagagggaaaacagtaaataatcggaaaaagacatgctagtaacaccaaacaagcatgacctgaaacatggataagcccctggcttttagtaacaggaaactgacaggacaaaactatggagaggttcctgatagttggcatgactatggaggaggaggccctatcattctctcccacccaagacacacagttgccaaagcttgagagaaaatgtgcaggttctcaacagacctaggcaaaaggcagatggcctaaggatgaaggaatttagccatgaatgctgcttaactttaccactggagtatttggagtgtttcagcacaacttccgcaatgatgcaagataaacattgttttaatagagaccattgttccacttatgggttctgaagggaccaagattgaactacacagttaagtgaccatccgacgtatca

SEQ ID NO: 114375 - DNA, 288 bp, Homo sapiens
ctttttttttattctagttgttggaaatcttaagatgtagttttggcaaggtgcagtggttcacacccctaatctcagcactgtgggaggccaaggcaggaggattgcttcagcccaggagttctagagcagcctgggcaacatagaccctgtctctgcaaaaataaataaataaaacaaaattagctggttttggtggtgcacgcctgtggtcccagctacttgagaggctgcagtggaaggattgaatgactgtactccagcctgggtgacagagtgagaccctgt

SEQ ID NO: 114376 - DNA, 437 bp, Homo sapiens
ccctggtgccaaaaaggctggggactgctgacctacaagatatattagttatgactcttggtgcatactcttgacagaaatcccactcaacctagtataatgcagaggacagttcacggagcaactcaaataattgccacttttacaatattgaagcttcctacgggaaacataatacatctctcaatttatgtcctttaatacgattaaacatttttcttcatgtaggttctccagaattttggttatgcctatgcctagattatttatgattgttgttggtattgcaaatgtcctctcctattgattatttaatggtatctatggaaagtattgatttttgtgtatttgctctgtgcccacttgccatctaactggttgttatattttattgaacctttcaaaggatataaattatgctgattttaatgtcaaaa

SEQ ID NO: 114377 - DNA, 330 bp, Homo sapiens
gaggtgtagaatactctgtgacaagggctcacctaggctttacttattacagatgtgatggctgttggcaaacaaaacctccgtagagcttgggtggtagaaactgaatcctgacactgatatttcactgtctgtgccgaggggagcctgatatttctgtgtttcatactggctctacctggtgtaatcattcctcaaacctcaaaccaagaattctgctgagaaggcagtggacattgttagaggcagtctccccctgcctgtcgctccccatattccaaggaactggctggtctttaatcctgaactgaatcattggattaagtagca

SEQ ID NO: 114378 - DNA, 3326 bp, Homo sapiens
ggagcaggaaatgctccaccagcacagccgactcccgggaatcggggtctgaccgccaggatggaagtggggccagccaccgagaccttcgtgctggaacttcaatgtcttgaggatgggggcccagggcctgacaccctctcaggtggcagcggtgggagcgagagtcaggaggaggaagagcctcaggagaggaacagcagtccacagcggccagcagtctcggccccagtgggggccagtgaaatcgctgaggaaacccggccgggacaacgagagttgcaactgcagcagttagaacagcagcccgagccgcagcaacagccgcaacacgagcagctgcaacagccgcagccacacctagaactgcaacagcagccgcagcaagatgggcaacaacagctatctcaactacaacaggaaaaacaccaatccgtgcaccatcaggaactgaaaccagaactgcagctaatgcaccagcagcaacagttacagccacagcaagtgcaagagcaacagcggttgcagcagcagcaggagcagttacagacgcagcaagcacaagagcaacaggtattgcagcagcaggaacagctacagcagcaagtgcaagagcaacagctgttacagcaacagcaggaacagttacagcagcagcagctgtacaacagcaggaacagttacagcagcaacagtttcaacagcagcaggaacagttacagcagcagcagcagctactattgctgcagcagcagggacagttacagcagcaactgttgcagcagcagcaggcacagttacaacagcagctgctggaacagcagcaggcacagttacagcagcagctactgctgcagcagcaggaacagttacagcagcagcagcaacagcagctgttgcaacagcagcaggaacaattgcagcagcaacaactgcagcctcctcccctggagcccgaggaggaggaagaggtggagctggagctcatgccggtggacctggggtcagagcaggagctggagcagcagcggcaggagttggagcggcagcaggagctggaacggcagcaggagcagcggcagctgcagctcaaactgcaggaggagctgcagcagctggagcaacagctggagcagcagcagcagcagctggagcagcaggaggtgcagctggagctgaccccggtggagctaggcgcccagcagcaggaggtgcagctggagctgacccccgtgcagccggagctgcagctggaactggtgccagccgcagggggcggcggagcggcggtcccgggggctccggccgcggtcgtggtggctcccccgggctacgtggtggtgcaggagctcatggtgctgcccgccgtggcagcgccggccgtggtggccatcccgggcccggcaggcagcgcggcgttgacccctgcacggcagcggcggcggcggcgcgctcgggaccggccgaccatctgcggggagtgcggcaagggcttcagccgcagcacggacctggtgcgccaccaggccacgcacacgggtgagcggccacaccgctgcggcgagtgcggcaagggcttctcgcagcactcgaatctggtgacgcaccaacgcatccacacgggcgagaaaccctacgcctgctcctactgcgccaagcgcttcagcgagagctcggcgctcgtgcagcaccagcgcacgcacaccggggagcgaccctacgcctgcggggactgtggcaagcgcttcagcgtctcctccaacctgctgcgccaccggcgcacgcactcgggcgagcggccctacgtgtgcgaggactgtggcgagcgcttccgacacaaggtgcagatccgccgccacgagcgccagctgcacggcgcgggccgctccaggggcctcggcctgctgcgcgcctcgcggccggcggccctcggtggcccagcccgcgcggagcaggccgctacagccactgcgcccgcagacaaggcgctgtgagggccgtgatcggggctgcctggccgggaggggaccccccacccgcctccacctgaaaagctccttgacccgggttcatgggcgctggaggcgtcctggaatatccctggagtaaaaggcttccaccatcatcatcatcatcatctcccggattccctgagaaaataccaggttcacagatttcaccgccagaaaaatccatccgccaaaagagaagtggaccggggctgaaacagcacacgggacacgtttgtctgccctttgaggggtctgccaaaggttttccctccgggaaaactggacttactacgaacgaggaaaaacccccagtggcgagacgattaatgacactggccgaggactggacacccaccagggaatcaagacgtggtgagacacacgtggaaaatcttcgatcctggtgaaaatgatcgcaaggagaaattcggggaggaagcaaacttgtttgcactatgtagaaactgaccaaggcatcgaatcgtcctcagaggcatttgccttgaaaatactttccaagatgaaaattcatcagggtgggtataattctgatgaaaacgcctgtgttcatcaacacagggtcagagcgctcaccgggtcgatgtgcaaatccaagccaggaagtcctgctccgggtggaaggtaaaaccttccctccagggaaccaggggctccggcgggcatcggaggcagcttcttggcctctgctgctgtgtcccccagtccccccagcccgcattaatgtcctctggaataagagcctgtggctgaagcagagggccttctgggagagctctccaaggtctggaaggagggtcccccagaaggagctccggggtagccccactgtggcccccctggactccaccagcttcatgcttctcagatgctacccaggggccggcccggggagaccagggcagatttctcccgcaccaggctgtggaggtttggagggctgcctgagcagacactgtgccattgctggggctggggaaagaatatctgagacgacgtttgggagcaatgctctttaccacgttcaccaaatcgtctggggcaggggttgtgagctgcagcagttgctggtgccttgtgggaaggtggggcagggaggaggctgcccgccacctctgcccccagtcacttcctgcttgacctgactcttcacatgtggctgcttaattcctgcccctctccccccagctgcttctcctttactaacacacctgctacattttacacatgtgttggtaagtgagaaacagaaacgaaaaataaattaaaatgcagaaatacaaaagtccttgtctt

SEQ ID NO: 114379 - DNA, 2847 bp, Homo sapiens
ggagcaggaaatgctccaccagcacagccgactcccgggaatcggggtctgaccgccaggatggaagtggggccagccaccgagaccttcgtgctggaacttcaatgtcttgaggatgggggcccagggcctgacaccctctcaggtggcagcggtgggagcgagagtcaggaggaggaagagcctcaggagaggaacagcagtccacagcggccagcagtctcggccccagtgggggccagtgaaatcgctgaggaaacccggccgggacaacgagagttgcaactgcagcagttagaacagcagcccgagccgcagcaacagccgcaacacgagcagctgcaacagccgcagccacacctagaactgcaacagcagccgcagcaagatgggcaacaacagctatctcaactacaacaggaaaaacaccaatccgtgcaccatcaggaactgaaaccagaactgcagctaatgcaccagcagcaacagttacagccacagcaagtgcaagagcaacagcggttgcagcagcagcaggagcagttacagacgcagcaagcacaagagcaacaggtattgcagcagcaggaacagctacagcagcaagtgcaagagcaacagctgttacagcaacagcaggaacagttacagcagcagcagctgtacaacagcaggaacagttacagcagcaacagtttcaacagcagcaggaacagttacagcagcagcagcagctactattgctgcagcagcagggacagttacagcagcaactgttgcagcagcagcaggcacagttacaacagcagctgctggaacagcagcaggcacagttacagcagcagctactgctgcagcagcaggaacagttacagcagcagcagcaacagcagctgttgcaacagcagcaggaacaattgcagcagcaacaactgcagcctcctcccctggagcccgaggaggaggaagaggtggagctggagctcatgccggtggacctggggtcagagcaggagctggagcagcagcggcaggagttggagcggcagcaggagctggaacggcagcaggagcagcggcagctgcagctcaaactgcaggaggagctgcagcagctggagcaacagctggagcagcagcagcagcagctggagcagcaggaggtgcagctggagctgaccccggtggagctaggcgcccagcagcaggaggtgcagctggagctgacccccgtgcagccggagctgcagctggaactggtgccagccgcagggggcggcggagcggcggtcccgggggctccggccgcggtcgtggtggctcccccgggctacgtggtggtgcaggagctcatggtgctgcccgccgtggcagcgccggccgtggtggccatcccgggcccggcaggcagcgcggcgttgacccctgcacggcagcggcggcggcggcgcgctcgggaccggccgaccatctgcggggagtgcggcaagggcttcagccgcagcacggacctggtgcgccaccaggccacgcacacgggtgagcggccacaccgctgcggcgagtgcggcaagggcttctcgcagcactcgaatctggtgacgcaccaacgcatccacacgggcgagaaaccctacgcctgctcctactgcgccaagcgcttcagcgagagctcggcgctcgtgcagcaccagcgcacgcacaccggggagcgaccctacgcctgcggggactgtggcaagcgcttcagcgtctcctccaacctgctgcgccaccggcgcacgcactcgggcgagcggccctacgtgtgcgaggactgtggcgagcgcttccgacacaaggtgcagatccgccgccacgagcgccagctgcacggcgcgggccgctccaggggcctcggcctgctgcgcgcctcgcggccggcggccctcggtggcccagcccgcgcggagcaggccgctacagccactgcgcccgcagacaaggcgctgtgagggccgtgatcggggctgcctggccgggaggggaccccccacccgcctccacctgaaaagctccttgacccgggttcatgggcgctggaggcgtcctggaatatccctggagtaaaaggcttccaccatcatcatcatcatcatctcccggattccctgagaaaataccaggttcacagatttcaccgccagaaaaatccatccgccaaaagagaagtggaccggggctgaaacagcacacgggacacgtttgtctgccctttgaggggtctgccaaaggttttccctccgggaaaactggacttactacgaacgaggaaaaacccccagtggcgagacgattaatgacactggccgaggactggacacccaccagggaatcaagacgtggtgagacacacgtggaaaatcttcgatcctggtgaaaatgatcgcaaggagaaattcggggaggaagcaaacttgtttgcactatgtagaaactgaccaaggcatcgaatcgtcctcagacactgtgccattgctggggctggggaaagaatatctgagacgacgtttgggagcaatgctctttaccacgttcaccaaatcgtctggggcaggggttgtgagctgcagcagttgctggtgccttgtgggaaggtggggcagggaggaggctgcccgccacctctgcccccagtcacttcctgcttgacctgactcttcacatgtggctgcttaattcctgcccctctccccccagctgcttctcctttactaacacacctgctacattttacacatgtgttggtaagtgagaaacagaaacgaaaaataaattaaaatgcagaaatacaaaagtccttgtctt

SEQ ID NO: 114380 - DNA, 1870 bp, Homo sapiens
atacacaaatgtttatagcagctttattcataataatcaaaaactgaaaacaactcaaacatccatcaacaggcagatggataaacaaattatggtatgtccatgcaacggaatacaactcactgatgaaaaggaataaaccacaaatgcctgcaacgccatgatgaatctcaaaacatgctgagtgtagagaagccagacacaagagtagatactcctatacaattccacttacatggaaatctagaaaagacaattcgaatatatagtggcaaaaagcagaagagtggttgcctggaaccagggtgggaatgaagattaactgcccagaggcataaaaaatggggtggtgggggcggtgatggaaaagtgctatgccttcactgtacctttgtcaaaacttgttgaactgtatacttcaaatgggtgtgtgttttattgaaggtaaatttgaccccaataacatttatttttaaaaattaagagcaaacagaaaaagcttagactaggaatctttaatttgaactataattctgtctactgtttccactgaggtggtctttcagcaaatgactcagtagttttaagcctcagtttcttcagctgtaaagtgggaataacaacaggcaccccatggtgttgcctatgaaatgcagtgatgatgacctaatccttagtgagcgccctatgtgccaggcactgtgctgaatgctttgcagaaacgaattcatcttatcagatagttctgaacactgcaaagcactatacaaatgtaagttacaggaattcttgcactttgcaggtgcttgttaaattgtgaagaagaaagcaaaacataagtgtaaaggattaccaaactgcactagtatgaagagagccatgttcctcagctgtacagggctgatgaatggggaggaggcctgcgagcctaccaggagaaccggggagactctctgtctaccgagagcctggatatcctcccgagtggcccctcatgagactatctaccaacgtgtaacagactgtctgtgacaggccatgggcataatatgtattagtatctctaagaaagaggtggcttttcctatacaaaatttgttggtgacagttggtcaacacttatgtacctgataagccatgtgggtacagtcgatcctcagtacaaatggcagtggtatgctgggtagctaatgatgacagttattaccgttactactattattatcaatatcctgttttgcagaggaggaaaccaaaaccaagaaggattgttcctttccccaaatcccaagctagcaagatttcccgatcctccctccatgccctttcctaacgtctctgtgatttgggagcttctgagctggagttctgtaaattcccaaggaatgggcagttcagaaaaataccaaaaattctaacattattagactttaaagagatttattgattccttttgaatggcagcagatggaacattctggactggggaaggacagtctgtgatgtgaaacccttccccaaggtagacaacaaaagcgttttttaaatgaacacttagtagaacaatctagaagaggaaaaacctcataagtaggaagcctagctgggcggttgggagaaggagtataagtgatttattacagcttatgaagagactgtgtgtgggctgccagggtcccagctctttctcagccccaactgagaaagggtggggtggtttgcctctgcctttgctgtgggtcacaaaccttcagtggcccaaaaggtggcaagcctgacagatgacctggaaaaatcaaggatatcaatgttttaaatgcttttattcataagcagggtattggtggtgggtctgctgaaaaaaaaaaac

SEQ ID NO: 114381 - DNA, 429 bp, Homo sapiens
aggattgacataatccataggtgctcctaatgcagtagtctataatttgactttcttattacttttccccttaaaaattctaagacagcattgagtttttggtatcctcagaggaaaagacagttacctctaagatacctactttcagggcaggcgtggtggctcatgcctgtaatcctagcactttgggaggccaaagcaggcgaatcacctgaggtcaggagtttgagaccagcctggccaacatgatgaagccccgtctctactgaaaatacaaaaattagtcgagcgtggtggcaggcgcctgtaatcccagctacttgggaggctgaggtgagagaattgcttgaacctgggagggggagattgcagtcagccgagatcacgccattgcactccagcctgggggataagagcgagacttcgtct

SEQ ID NO: 114382 - DNA, 651 bp, Homo sapiens
ctataaaggaaacaacagagtgggagtcccccccgggtggccggcccgtctaaaactagtgattccccgcgggcgtccagaatttccgccccaacaaataaggaaacaaatgagttcttcaaaggagatttagtgttcaggaaaggattctatggaccctgagagggtttggagaagaggtgtgtaagcaagagttcattgcctaccgttttattacaccaggcatcgctaatgtagattgccactgttctagagaactttttgaaagatggtttgggaccacaaatacaacgaagatctcccaggatcatatagaccattccatttcccattaaggtctcctacttttctacccgccccataaacttcaagagtcactgcaagggcctggcacggtggctcacacctgtaaccccggcactttgagaggccaaggcaggcagatcacccaaggtcataagttcaagaccagcctgaccaacatggagaaacccctgtctctactaaaaatacaaagttagccgggcgtcgtggcacatgcctgtaatcctggctactcgggaggctgaggcaagagaatcacttgaacctcagaggcataggttgcggtgagccgagatcctgccattgcactccagcctgggcaacaag

SEQ ID NO: 114383 - DNA, 652 bp, Homo sapiens
ggctaaggcaggagaattgcttgaacctgggaggtggaggttgcagtgagcagagattgcatcactgcactccaacctaggcaacagagcaagactctgtctcaaaaaaaaaaaaaaaaaaaaaagagatttagtgttcaggaaaggattctatggaccctgagagggtttggagaagaggtgtgtaagcaagagttcattgcctaccgttttattacaccaggcatcgctaatgtagattgccactgttctagagaactttttgaaagatggtttgggaccacaaatacaacgaagatctcccaggatcatatagaccattccatttcccattaaggtctcctacttttctacccgccccataaacttcaagagtcactgcaagggcctggcacggtggctcacacctgtaaccccggcactttgagaggccaaggcaggcagatcacccaaggtcataagttcaagaccagcctgaccaacatggagaaacccctgtctctactaaaaatacaaagttagccgggcgtcgtggcacatgcctgtaatcctggctactcgggaggctgaggcaagagaatcacttgaacctcagaggcataggttgcggtgagccgagatcctgccattgcactccagcctgggcaacaag

SEQ ID NO: 114384 - DNA, 595 bp, Homo sapiens
gaaggaggcttatccaacactactgatctgacctactttttacttaggaaggtcatatttctctacactttgctcttcctgaggagatatacaacaacattgacagaaactgctggaatagtctgaactagaaaacgtgtaggctactttagagacttctgaaggcattctgaaaccccaagtcaggcacggtcagcaagagcattcaagatcctaggcaaaattgaaaagtaacagtttaacaccttcctcctcttccctgaacccaagaacttctttcctacaagctgccctgtcagaatctcccaccttaccaagaatgccttcctctcaaggatctgaggtttcctcataaaaattttccattttctggggaagaagtaaatttatgttgatttagcattaaaatatatgatcataaggtgtgaatgactggttaacaaccatgcatccccaaagagacaagttaacccaaatgatctctctaactgggggatctgtgaggacaacttgggaagaaggggaatggagattctcttttggtactccttccctacaccaggcaaacatataactaaatactagatactttaaa

SEQ ID NO: 114385 - DNA, 408 bp, Homo sapiens
gtccgtgagtatgggagcttctaagacttgggcagagctgctaaaggggcactggaagggaggactctggctctgtcactatctgatgaggacagcagcagagtgactacagcaagcatttacagagagtctattgcacatcaagcactgtactcttgatcttccatacccctctctaatccccatcatcacactgtaaactggtgttactattattgtcattattattctgtgtgttgtgatatgatttttctttttaattttagagacataatttcactctgttgcccaggctagttgccttcccttcctatttttttctccaatctgtcatttgtagcccctgtgcagcataattttccttctgttttgatttcttttctcaagagattcagctcccctactccc

SEQ ID NO: 114386 - DNA, 315 bp, Homo sapiens
caatccagttaagagtgggcaagatactcatatatgcatttcaccaaaggagataggcagatgtcaaataagcccttgaaaagatgttaatcattaggaaattgtgtagtaaaaccataaggagattccactacacagctattagagtggctaaaatggaaaatattgactataccaaatgttggcaaggatacagagcagctggaactgcttgtgggaatataagatggtatgactactttggaaaatagtttggcaggtttttttttttttttgagacgaagtctcactctgttgcccaggctggagtgcagt

SEQ ID NO: 114387 - DNA, 154 bp, Homo sapiens
tagaaacataccttaggataagaaccttagaataacttctagtccaaacccttgtttgacagtaagtaaaccaaaatttagagaactatctgttcatttcccatcacccccactctcgtagctagcatgtggcaggacttggattccgactgaa

SEQ ID NO: 114388 - DNA, 424 bp, Homo sapiens
tactggcatccattcctatgtcagaaaaataatttgcctttgctggactgacactatttgaagaaatgattattgggtatccagagggattttacttgatactgctaaatggtagttatatgtcaacatagtaattaactcatacatggagagataagaataatttggtttattatcaaatcgatattttgaaaccaatttattatattctcaggatgctagtgagaaacttcatctgttatccttttcgtctccttattttcttcatttaaaaatgttctattagtaattataaattaactttcagtttttattcttttatattggaatattaactaccaattgccaaactcctccacattttctgcaatgataagagaaatctaagcatatgggggtggagaaaactcttggatctgtcgat

SEQ ID NO: 114389 - DNA, 445 bp, Homo sapiens
cccagcactttgggaggctgaggcaggaggatcgcttgagcccaggagttcaagacaagcctgggcaacttagggagaccccgtctctaccaaaaatcaaaaaattagccaggtagagtggtacgtgcctatagtcccagttacccgggaggctgaggtgaaaggatcgcttcagcccagaagttcaagactgcaatgagccatgattgcgccactgcactccagcctgcgtgacagatcaaggccctgtctcaaaaaataattaattaaatacttgacccattgcacgatctttccatgcacgacagctgctcttctattattcttccaggatgaactgcacagcctgcccccttgggtttccaggttgtgggagatgagcaaaactgaatgacctcagtaggccaagagcaaaggatgtgggtccagacctggtggccagttg

SEQ ID NO: 114390 - DNA, 561 bp, Homo sapiens
tgggccactgacccaggaaacacatgtaaacatgccaactgtagggcctggcatgtaacaggtgccgaataaactaaatgttaaggattcatgtggttttattactccccttcctctcaacatgttcaggactctcatgcctcagcagtctgtgaacaccaaaaacaacttggagcaaaagtgtgaacaatgaaggttgattaccctcaaaaattaagtttggagatttttgtgtatttcaagcacgcatcagttccttccttgtactcgcataatattgggtttctcagaatctgttagttccaactgttaaatacagttatctggggaggaagggaattataagaaactaataccttcttccttatgtatttgtgcaatgtttgtagacacttatggcaaaggaggaaaagataaattacaagtacacagcatgaggccaggtgcggtggctcatgcctataagcccaggactttgggaggccaaggcaggtggatcacttgatgtcagaagttcaagaccagcctggccaatatgatgaaaccccgtctctactaaaa

SEQ ID NO: 114391 - DNA, 218 bp, Homo sapiens
gtattaaaaagcttgataatgacagtcatagtttcttctccactcatatcccaagcaaataatctgaaataaggacaaagatttgagagtaaaattgttcagctcagacatgttatttttgaggaaatttttttttaatttaacttggagattagttgaatgtaatgcattcatggttggggatattttatagctgttataaatggtgcgtacaaaag

SEQ ID NO: 114392 - DNA, 134 bp, Homo sapiens
tgttggtatggcagcctgcaccattccagttcccaggaatgggcttaggatcaaaggttgctatcactccgaagtcttcacatacacgatgtaagatgaaacaggtcacccagagatgatcttccatgctgatt

SEQ ID NO: 114393 - DNA, 305 bp, Homo sapiens
gtgagagtatgagaataaagattgtaaatgataagttggctgggcgcagtggctcacgtctgtaatcccagcactttgggaggctgaggcgggcggatcacctgaggtcaggtgtttgagaccagcctggccaacatggcgagaccctatctctactaaaaatacaaaaattagccaggcatggtggcgtgcacctgtaatcccagctacttgggaggctgaggtgggagactatcttgagcccaggaagcacgttgcaccactgcactccagccctccagccttggtgatggagtgagacactc

SEQ ID NO: 114394 - DNA, 430 bp, Homo sapiens
ccccgactagcccgacagctcgcgaacggtgtttcccccgactagcccgacagaacaagagaggtgcatgggatggtaaggttcagaggaactcccagaggtagcagttagaactcaccaaggctttctatcaagtccagagacccagagagtgggaagcaggtcaaggacacacacagcagagtcaaagtcggaggacatgacaagggaggagcccagagaagctgtcgggctagtcggggccccgactagcccgacagccccgactagcccgacaggcacctcatctcagttcagacctgatctttccctgggtcctgcagaggacaaccctcccactgttctctctcctccactgtcatctcttgctgcgattcctggtgcccacctccagcccagcctcctgtcgggctagtcgggggggtaccga

SEQ ID NO: 114395 - DNA, 282 bp, Homo sapiens
gggggagggggaattatttaagtggctattctgagtaatgctcccttgtttctagggggatggtagagtgggcagaaggatctcagaagatgctgatcccctaatcccttagaattcatagatatgttacattaaatgataaaagagactttgcagataccattaaggttacagaccttatgataggaagacgatattggaatatcctgatgggcccaatctaatcccatgagctcttaaagtagagaacattctcctactggagggagagcgatgtggaaa

SEQ ID NO: 114396 - DNA, 157 bp, Homo sapiens
gaggagacctgggtggcggagacgctgtgtggcctcaagatgaaggcgaagcgacggcgagtgtcgctcgtgctccctgagtactacgaggccttcaacaggctgcttgaggatcctgtcattaaaagactcctggcctgggacaaagatctgaggg

SEQ ID NO: 114397 - DNA, 755 bp, Homo sapiens
aggggaggacacaattcaatctataacaactatcactggctgattttggcagaggcctgtggcctccagtattttgagggagctgagggccactgatctctccatatgctctcaacatcatgggactagtaggatgaaagcaagcctcagaccagattctacctcaagcaggcacacaaacattcatgcagcttctacttggagcctgatgaagttcaaattgtttgtcctctgaggctctctttgcatggaaatttctcccatgacagatgagaaagttctggggcagcattcagctttctagttggattaggcaacagaatcctttgaaaatgtgtgtgcacagaccaggtggctctctgggccagtgtactctgaaagatgtgtgtcctggcctagctggttgaggaaaagcagggcaagcctagccaaatcacacatcttgaacagccctcattcgttatactaactttcccaccctctggtgtgtataggagataaagatggcagacgtgctattaggctgccaatgggagtgggctctgatatggtctttcaaatatgaatcacccctggcatgtgtgtttcctgtttaaggttctcaggtattacccaactgcaccaatattaaaatggacacataccgtgtcatgcagttggtgccgaagtgttttaagggaagttgtaggcaatgtgagtttatcagaaaacttcaccatatcagcattttgccctgagcttacaccattcccaga

SEQ ID NO: 114398 - DNA, 221 bp, Homo sapiens
cagttctaaggtctcctgctcccactttgtcctttctggcctcttgcttgtcctttatttccaaatgtgcacctgagtcccctgtgtgatgtacacccatttcccgggctgcagtgggggctactgtgggcatcaggggccgtgggcagggcctggggtggggacgcatcagggagacaggggaagaggaagtgcctttggtcctggggaaggttggcttg

SEQ ID NO: 114399 - DNA, 389 bp, Homo sapiens
cttttaaccaatgctgacactttattggacaggaaatgatgtatacttgagaaaaattatgcaaatgtaaagaatgtgaagaagccattaatatctgttcacatcttattcaatatcagagagttcatacttaatagaagcattaaagatgaaattactgtcaatagatttttcagaaaatataagcctttaaagtgaagaagagtatttattttgaagacaagcattaaaatatcaagagtgtaagctgggcatggtggctcaggcctgtaatttcagcactttggaggccaaggcaggtggtttacttgaggtcagaagttcaagaccagcctggccaacatggtgaaactccatctctacccaaaatacaaaaattaggtgggtgt

SEQ ID NO: 114400 - DNA, 377 bp, Homo sapiens
ggattgtctggaggtcatagtccaaaggaagggttgtaaatttagacattttttgaagattcacgtgtttggttcaatataaaagtatcattccccacccagacctgtcccagtgtctagggaaatgcaccttctcctgtgacattgcatatcatcttccatatcaggtaccctggtttgaaaaatcatacttttagaagaaattgccctttccattttcttaactgctctggagaccagcaggaattggagcagcctcattccgtgtcgaagaagacctatacggcttgcttctttttttctttttttcttttttttttttgagatggagtttcactcttgttgcccaggctggagtgcaatggcatgatctcggc

SEQ ID NO: 114401 - DNA, 171 bp, Homo sapiens
gggcagcaaaggcttggctgttacttcttgggagacaggggtcagggagtcttggtgaccggggccaggctctctagtggagcgactctccgtggaggaacagagcatccgatgcacactcagggacatttgcaagctgcagtttccctgtcatacgcccttagctgttgg

SEQ ID NO: 114402 - DNA, 230 bp, Homo sapiens
tggtttatcaattactatgagaggtatgttaaaatctctcactacaagtatggatttgtctatttttcctcctaattttgtaaaattttgctacatatgttttaaggtgatcttgctaggtcaatggaggtgaatgtatcttaatgaactgttccttttatcatatgtagtgactatttttctctttaaagtgtttttatacatgtattaaaaagtccattttgtctgtt

SEQ ID NO: 114403 - DNA, 564 bp, Homo sapiens
ctgttgcttgtctccaaacctactcttctatttactattttttgtgatgctggggctaggactgagcagatcacatctcttctttgccagtgaatcctgttaggttctgccaagaggagttactggagagagccagcaaggttggaggaggagaagggagggagaagcccatgcttttcagcttcctctttctgtcagagtctccatttatttctgggagcagcagctgaatccagtttgctattttgtcaatactcacaggaccacttcatcatacccacgcagagaggccagcacatagcaggaactctgctttagaggctggatcccagccaacctgagcttggaccctggcaccagctgagcatcactttcaccgacattcagctctgcagggtccctcatctacagagcccctaagtttgtaagttttaataattccaacctcttccctttgttcctcctgccctaggagtagtagctgcctcttgaaggtagaacctcctagtatattttgcctttccagttctttactacatagtacttccttaaattctctctgtt

SEQ ID NO: 114404 - DNA, 628 bp, Homo sapiens
ggcagataccttcatgaatattactgataaaacatgtcaaggggtcaaaccaggaaatggcacaagtgaaacttgcagaatatgatcatgccattcccctgcttaaggttcgtcagtagctccaaggataaaatcccagcttctgagcagggcattttcgaggtccttcttcatctgactgctgcctccttatgccatcaggcccttccccatgctgtttcctctgttgaggatgcagttcctccttttcttctctgctcagcaaaccctagtggtcttgtaagacaccacctcctcccagggccctttcactactcctctagggaagatcgacacctgtgagctcagggacctgtggctgcctccattaaagtggcaactgccaccttttatatatttgtctgcaccccctggtagatggagagctctttatgctagcgactttgtgtccctaacacccgacacggaacctgggacacagaaggctcggtgtgtgtttgtggagtgaatgagcacacgtgtgaacgagtgtcagtcattctttgctaccttctcaagtcttgggttgaatacattagttaaaagatcaattaaagtgaattgggaagcaaaaattacttctttgcca

SEQ ID NO: 114405 - DNA, 395 bp, Homo sapiens
aatctctgggttctcacaaaaccttttcttcaagctagtatttactgacaacatgcccaagcctttttaggcattctcctcctcacaaaaattctacaggcattactactatcaccattttccaaatgcaaaaactgaggcttagggaatgaaaataactctaagtcccaccagttaattactagtggagctgggattcgaactcgtgcttttaaattctacctatagtgtctgaaatgctgtgtggatttcctggatgcatgtctccctctacaagacagcagcactaaggggtggtctgtgtgggtgtgaaagaggtagggactgttagcataatattactccgcttccccctatcagccaactgctccgacccaggcagccaaaccaaaagc

SEQ ID NO: 114406 - DNA, 765 bp, Homo sapiens
gcttcattgtgctactcttcattgtgctttgcagctaccaccttctttataaattgaagttttgtggcaaccctgcatcaagcaagtaattggcaccatttttccaatagcatgtattcatttcatgtctctgtgtcacattttcataattctcacaatattttaagccttttcattattattaatgctagtggtgatcgatgatctttggtgttttgtactactgccattgttttggggtgccaggagccacaccatttaaggtggcaaacttaatatataaatgacgtgtgtgttctgactgctccactaactggctcttcccttgtctctctctctctttgcttgggccttcctattccctgagacatgacagtattgaaattaggccaattaatagccctacattccctcttctgagggttccagtgaaaggaagagttttacttatctcacttttaatcaaaaactagaagtgattaagcttagtaagcaaggaatgtcaaaggctgagataggctgaaaactcggtctctggagccaaacagttaaccaagctgtaaatgcaaaggaaaagttattgaaggaaattaagtgcccctccagtgaacccagaaatgataagaaagcaaaacagccttcttgctgagatggagaaactttgatctggatagaaaaaccagtcacaacaattattcccttaagccaaagtctaatccagagcaagaccttaactctcttaagttctgtgaaggctgagaggtg

SEQ ID NO: 114407 - DNA, 206 bp, Homo sapiens
atacaggtaagacttcaatctacacatttttaagaagctcaagatctttaatcaggacaaattctaggagatccacattgagacacagtatagtcaaactgacaaaaacaaagacaaagaatcttgaaagcagcaagagagaagtgattaacacatacaaaatatccccaataagattaagagccaaattctcatttgaaaccata

SEQ ID NO: 114408 - DNA, 153 bp, Homo sapiens
gtatgtataagactgagagcaaggctttgctcccagtgcctttgcatcagagagaaaggagtcactttttttatcatctgttgtccaaactcaaaacaaaacatagttgtaagtttatggactgattccaggaatctaaaaattttagattcc

SEQ ID NO: 114409 - DNA, 557 bp, Homo sapiens
ggtgggtgaccagagagtcctgtctatcctaggaggagaacattcagcccaaatcccagccccatcatgcacagatcagagccatttctgaaaatgtcgctgctgattctgcttttcctgggattggcagaagcctgtactcctcgtgaagggacaacattctggaccacgcatgtaaccttggccaccatgctgactctcctggatgggctgccatcagggatcataggtctcatgagcagactgtcaccggatgacggactgaaccccaacaggtgttcttgctgcatctatgcaccgccagaacccccacacctcccattcttcaaatggacgtacagctttctccttaagtcaataaacttgaaaaagttgctttataccgcttgagtaagtggtcagcctcataaggaggagacaactgtgaagataaatatcatgaaaacaaaacaagattaaattataactagacactgttttctgccaaggctctttgtgtgaaggttgttcccgctgttcggtggaaataaacactagcaagtgttatgagttaaaaa

SEQ ID NO: 114410 - DNA, 602 bp, Homo sapiens
tgcctcccgggttcatgccattctccaacctcagcctcctgagtagctgggattacaggcacccaccaccatgtctgcctaatttttgtatttttagtagaaatgggtttggccatgttgtccaggctggtcttgaactcctgacctcaggtgatccacccacctcagcccccaaagtgctaggattacaggcctgagccactgcgcctggccttgctatgattgatagaggtaggaaaggggattaagtgggaataatgaggcatcatgactgaggcattatagccacacttcctgaagaagagtttgttacatctgttgaactgggagaaatccattaattaggcatatttctttctgctgcatttgcacatcatgtgttatgtcttcttcctcaggtctcatgagcagactgtcaccggatggtaagtgtcaggattgtatcttttaaacctggtctttctcttgtccgcaaggtaatgtagacttattgagtcatttatgcttttaggtagagtctaaagaacacttcaggtattatccaagcacatgttttgtttgaactttgatgtaatgaaaatctttattgctatataaggtta

SEQ ID NO: 114411 - DNA, 342 bp, Homo sapiens
  misc_feature (260)..(260): n is a, c, g, or t
  misc_feature (282)..(282): n is a, c, g, or t
  misc_feature (306)..(306): n is a, c, g, or t
ggtgggtgaccagagagtcctgtctatcctaggaggagaacattcagcccaaatcccagccccatcatgcacagatcagagccatttctgaaaatgtcgctgctgattctgcttttcctgggattggcagaagcctgtactcctcgtgaagtcaacttgctgaaagggatcataggtctcatgagcagactgtcaccggatgagatcctaggcttgctgagcctccaagtactgcatgaagaaacaagtggctgcaaggnggaagttaaacccttctcaggnaccaccccatccaggaaaccactncccaagaggaagaacacgtggaactttcctgaaatg

SEQ ID NO: 114412 - DNA, 484 bp, Homo sapiens
  misc_feature (25)..(25): n is a, c, g, or t
taattttatgtatacggaacacaanaacttcgggcgacatcttgagtaaggcaaagtagaatttattgagtgacagaacggctcttggcagtgagaggggacccgaaggtgggttgctggccacgagcctgagtctatgggtttttgtgggctagaaatgggcaagtgcatgctgattggtctgtggctatgcttgacaaagcaccattcagaaataggcacgatagtgtagaggaccaatcgcggaagggtaggtatgtataaaataggtgaagggtaaggaccaatcaggagagagggtgccagacgagaatgggagctctcagtctggctcatggatttatccagaactcatagcttggttttcaggctttagactgtccttggcttgaaggttgagtttcaccagggacccctccctgtctgcctaggaatttacctgcctcctattgctatcactgtgttgcccaggctggtctgaaac

SEQ ID NO: 114413 - DNA, 343 bp, Homo sapiens
ttggtccaagccagggcaaaaacataaggaaaagaaataaaagagagaagaattaaaatggaagaaacacaactgttattatgcacagctgacatgatcgtgtttgacaaaaatctaaaataatcatcaaactattagcatccataagtgaagtttgcaaggtcattgaatgcaaggtgaaatacacaattctatcacatttctatacacaaacaataaaaaataaataaacagtgcagtagggaaaacgagactttcccgtaaatgccacagggtcaagcagatgtttatagttaatgaaaatactaggttgggcacagtggttcgtgcctgtagtcccagc

SEQ ID NO: 114414 - DNA, 393 bp, Homo sapiens
gcactccctcgtgccgcactccctcgtgccgcactccctcgtgccgcactccctcgtgccttgagtctttgcccagatatcatcctctcagcaagacttcctgggaccaccctgctgagaacgcgtgaacccttccgactcggcctccaggcccctctcccgggtctgttctctggagcgctctccccatccgcagtgggattcggtgcactcctctgttttgtctcctctgtctcctgccactggaacggaagctccaggaggacgggatttgcctgattctttgctgtatcccagtgaactgaatgagctgctcccagacagttagaatcgcagccggggcccaggcggctgactgcacagtgaggagccaggccggacaggccccaggcg

SEQ ID NO: 114415 - DNA, 209 bp, Homo sapiens
atgacacacacctctgaggcaggcacccagatcaagaagcagaaccttcttagcacgccgggacaggcctcgttttgatggataacacctggttttggactcgtgctctcatggaccacctccccattttgcacgcctcagcctaagctcaaaaccctcccacacaactgcaggtggtggacactccctgcctcacacccctgtgtctg

SEQ ID NO: 114416 - DNA, 288 bp, Homo sapiens
tgtgaggaagaaatcaagggggtttccacatttcttacttgagcaacagggtgggttggagtactagctactgaatggtgagggaaaggttttaaacacagaaagcttgtgttgcctatgaaatttaaagtggaggtggcaaataggcagttgagaatctggaactcagaaaagaggtctgatcaagcaaagcaactgtgggaattgctagcatggcatttatatttacagtcatctctctgatcagattaactagatatagagaagagtgccaaggacagagccctg

SEQ ID NO: 114417 - DNA, 1045 bp, Homo sapiens
caatatagcaagaccccatctctaaaaaagaaaatataaatttcattgtgatattctgaaatacatatttgatcttcaaccctgtttcctgacataataactcctaaaatcttaggctctccaaagtgatgtctttttgtatgctattgattggtttatggctggcagctcctaggtagcttcaggataggggtcagtcaccagaacgaccaaggcaggattagaggattgggactttctgcccacccctctcccaacctccagggagtggagaggggctgagagttaagttgatcacctatggccagtggtttagtcagtcatgcccaaataatgaagattccatcaaaacccaaagggacagcattcagagattttctagacatctgaacacacagagtttcctgaaggttgatgcacctagggagggcatggaagctccaagcgccttccctaatacttcgttctatgcatctcttcatctgtatcctttgtaatatcctttataataaactagcaaatgccattaagtttccctgggttctatgtactgctctagtaaattaatcaaacccacagagggggtcatgggaaccctaacttgaagcagatcagtcagaaattctggcagcctgaacttgtgatatgtatctgaagtcaggcagtcttgtgggactgagcccttaatctgtgagatctgacagtgtctccgggggaatcgtgtcggaacggaattggaggacacccagctggtgtctgctatagaactgattgttttcttggtgtgtgggaaaaacctccacacagttgaggacagaagtcttctgtgttgattgttgtggtgtgggagcagaggaggaacagtttgtttttttccccactcatggtgaactacacaatgtgaaatttaccatcttaactactgtatactacttttagtgtacggttcagtggcattaaatacgttcataatgtgtaaccatcaccaccagcagcatctctataattctttatctcttaaacctgaaactctgtacccgttaaa

SEQ ID NO: 114418 - DNA, 427 bp, Homo sapiens
tagaattaaatgtatatagtattgcgctatcattatttgtgtaaaagtaattttaatggacagataagacaatatttcatactattctgatcaaaatactgtgatcacacagtggttttcaaatatcacaggctaataactcaagactcagtatttatttagacatggttctaatgttggtaatgggtgtatatctttatttttaatagtcttaataataatttaaagttttcagggtcattttcttgtatcattagattttcatggctttacttttatagtggactaagatgaatgcgtgcaaggagtgacagtgccaccacatttcttatttccttatgatcacatgctcaggtttttgttgtttcagttttcttgaaaaatctgtgcttggtgcctttccattttgccaggagttaaaaataga

SEQ ID NO: 114419 - DNA, 140 bp, Homo sapiens
gggtcaaccctgacctgtctcctgagctggtggactacatctccaactgctgctacacacttccatttggagatatctaaaacaaaagtatttcctctctcctgaaaaatgttctacctactgaccttcctacttctgat

SEQ ID NO: 114420 - DNA, 787 bp, Homo sapiens
  misc_feature (398)..(398): n is a, c, g, or t
cctcgctctgttacccagggtgggttgcagtgagctgaaatcgcgtaccacactccagcctgggtgacagagcgagactgtgtttcaaagaaaaaaaaaaacaagcagccttttgcttggttggaatctgattttctgttgcgtgttccttgtagccatagatgtgattatgtccacaccgggctgccttaatctgtcctgcttggagagtgacttgtaagatgctgaattattcatgataatacagtgaatgttctgggtccatgtactcagataaacatgaagaaaataagcaaagaaaaatggagactgggaaagcaaagctgttttcatcctataattgaagtagtgtggagcattaacttgtggatgattcagagttaaaagataaaaagacnccagagttctcgctgaagaatgtgagaattcctgtgcatgttttttctgatgactatctaaaaatggtgccctgatgtaggttggggggaacattcttaaaaacaagggtgctatgtgcctgtaatccagcacttggggaagctgagtgggcagatcacctgaggtcgggagttcaagaccagcccggccaatacagtgaaacctcgtctttaccaaaaatgcgaaaattagccgggtgtggtggcacaagcctgtatgtagtcagctactcaggaggctgaggcatgagaatcgttgaattcgggaggcggagttgcagtgagctgagatcgcaccattgcacttcaggcctaggtgacacagtgagactgtctcgaaaaaaaaaaaa

SEQ ID NO: 114421 - DNA, 266 bp, Homo sapiens
tctgaccccaaatgactttaaccctgacaagagcacccaagactcactgtgggaatacagtttccctgtgattgcccaggagcaaaagtttcctttcaggagctcccccacatccgctggcaatgctgctgaagggttcccgctcacaggccaagctcacggaacaactggatcccaggcgtggagccacactggctgacatgttctcaagctgctagaacttttacgcttctgaaaccctcctgcatcattcctaggcctgcagt

SEQ ID NO: 114422 - DNA, 305 bp, Homo sapiens
tggtctccagcaccttggaacactcatgaagtctggattcaatatttggaaattggaagacagcatgaatgctaaaccagagatttacgacggatagcaccattgcaaatcacactcaaacaaaagtcaagatatgactttgggaatataagagaaagcaatttggaagatggagaaattaactcacattgttaaacaatcaacacaactcctgttctcacattgggggatttcttccagtcccttttctctatgtatcttaattactttcttctttttttttttttttgagacagagttgcatt

SEQ ID NO: 114423 - DNA, 435 bp, Homo sapiens
ctggcctgtaaaagctctttaagagattcaggtggacctctgggtaagcgtgactccttcactccaacagatggaaaccattatgctgtaatgtgctgtttaagggggaaagaccaaggactgaatttgctttgagatcaaagcatggattttgaaggcaaaatgatgatagatcccacgttaattattaggacgaagatagaacagacagcatcatagagatttcagcaagacaacaaacattcaataacaggaaaaggtcgggtgtgccaactgaaaatagcaatctaggatgctccatgctagggtgctctttggactagaaagccgtagaccctggacctaaatcagtaattttcaagcttgttggacccatgagcccaatttagtaggcagaaggtcctttggatcctttgctttaactagacacactca

SEQ ID NO: 114424 - DNA, 243 bp, Homo sapiens
agagaagggaggataagagagctctggagaatgacagaaggtgctggcttatgtagaaagacctcaccttgggcagattgtggtgaagttcctggactattgcaatttgagatttctagtgcaagaaccaagatgtcaaagcccagtgggagccagggccaggaatgagtttattttatttatttattttttgagacggaatctcgctctgtcacccaggctggagtgctgtggcacgatctc

SEQ ID NO: 114425 - DNA, 756 bp, Homo sapiens
cagtgcatgctatttcccatgcagtgtgcatgctctgatgtcactcctcagagggcgcagccttaggcatgtacacagtttctctgacctcccttcccagagatgactatacatagtccagttctcttggactatctctttccctgaatactcagttaagcttgaggctgatatcacatctaacttgtagcctcctccaattgctagctgattactacattgtttttgacaacactttgggccatacattgctccagtctgatccaattaaagttgggttcctttgcaagagtggtctttacatctggctttacccagggagaactcttcttggctatcttgttccccgattctctctatttttgtcaggtttgtcaaagatcaggtagttttaggtgtgcagttttatttctaggtactcttttctggcaagctgagaggcaaatcatgaatgaactcccattcacaattgccataaaaggaataaaatgcctaggaatatagctaataagggaagtaaaggacctcttcaagaagaactacaaaccactgctcgaagtcagagatgacataaccaaatgggaaaacattccttgctaacagataggaagaatcaatatcgtgaaaatggccttactgcccaaagcaaattatagattcaatgctactcccattaaactatcattgaagttcttcacagaattttaaaaagacctatctaaaattcatatggagccaaaatagagcccaaatacc

SEQ ID NO: 114426 - DNA, 427 bp, Homo sapiens
ccaccctactaggagagtagatataacacttccctgtcttgaccctttgattccatcttgaccctttgattccatattgaccctcccatgaatttgcagtcccaaattacactccctaactgcctcttccaaaccttaagttgttaattaatttcaaagacagacagcactccataatacaggtaccagacaaagaaataaacacatcctttctggaggaattcatttttatccaaaaacctgcaagagtttctatgaggaaaatgattatttcagagtttaaaaacaaagaaaatcatgaaatacacaaggaagcaatgcatcatgagtgagagctaggagagacaaaatcagcaaatgcagggttgaaaaggaatcatactggacttatcagacatagactgtgcttaacatgttataagaaatg

SEQ ID NO: 114427 - DNA, 173 bp, Homo sapiens
tacttacaaatgataaacaaacattcctttatatctttattatatcattatactatatttacttactccccctttaagagtaaacatgtcactgctttgagcaatgaaatacaagcaaaagtggtatgtgatacttctagtcaaaagtttcaagtgccatttatcatgtcctt

SEQ ID NO: 114428 - DNA, 592 bp, Homo sapiens
ggcagatcagcagaaggcactggaatacccacctgacaatgtacataacttgtactttaggttttgctcttctggggttgcgtgcgttatagaccgggttccaaaagaaaaggaggtgattgcaatgagatcagatcttttattacttgacaggaggttgtggagtgtcatgcaacctgaaatcaagccacaactgtatcattgattctgtgcaagttgatgcaaatatcttgtgttcacctctctgtcccaaccccctaaacagatgcttaaaagggcatccctggctgggcatggtggctcatgcttgtaatcccaccactttgggaggccaaggcaggcagattgcttgaggtcaggagttccagaccagactggccaacatagcaagtctgctaaaaatacaaaaatctcttccaaaaatacaaaaattagccagatgtggtgcatgcctgtagtctcagctactcaggaggctgaggcctgagaatcacttgaacctgggaggcagaggttacaatgagccaagattgcaccactgcgctccagcctgggtgacagagtgagacgctgtctttaaataaataaataa

SEQ ID NO: 114429 - DNA, 495 bp, Homo sapiens
gaaaatgacaaccagtattcacagtttgagataatggctgtctatgatgggatcattagctgttctgcttcataatttccagaaaattcataataaatgcaagtgcagcaaaatctgaaggagacagtttttatcctgaaattgtttttagaagccctgcccaaacagcttgtaggttaatagaggtgcaacagtaaggttggatgcaatcaactttgattgtgggcttctcagagttggttcgtctcgccttgagtttcctatacaagaatgcaattaaggaaacaaggcagcttaatgacgttaatgattgttattcagaatgtaaaggtgttgggattaatcacaaaggactggaatctggattcagggcgcaggccctttcttcaacatgtacttttttaggttctaccattctctctgggtttttggagtgacttctgagatatagaatagctaagcttatagataagttggttttctggagcatgggag

SEQ ID NO: 114430 - DNA, 2046 bp, Homo sapiens
  misc_feature (678)..(678): n is a, c, g, or t
agtgagaattatcaattgttaatgattcttaattaaacttcgagcacagtcttttaatcatatcaattcacctaatgatctatcatcaagcctacattgtcttatctattccaaaaaatacagtgagttgctttgtcttgcctaaattctgatgcatagggccctgcctgtaggattttactgagatcaccagagcaacagaacagggtacttagcctacttcagctcactactttcattgttaattacacaaaagtcctttgttacaatctgttatagaattttgtctggcatcaaccctgatccccattttagcaactatcttccttataattaaaacaacgacaacaacaaaaatgaggctactatgttctgaaatttattttaattccagtggaacttcagatttatgcatttatttacttgtttgcttgtttgtttagttgacaatgtttttacctgcaaacttacctttttttattttttattttttatttttttgagacagagtcttgctctgtcacccaggctggagtgcagtggtgcaatctcggctcactgcaagatccgactcccaggttcacaccattctcctgcctcagcctcccaagtagctgcgactacaggcgcccaccaccacgcccagctaatttttttgtatttttagtagagacgggntttcactgtgttagccaggatggtctcgatctcctgacctcatgatctgcccgcctcagcctcccaaagtgctgggattacaggagtgagccaccatgcccggcctgaaacttatcttcttttaaatgacttgactgactttgcaatttccttatccatttcgaattttgtaaaattattttttattattgactggctatcttctgaagtctggagattgttcttctagaccaaactagaaaaggtaaaaaagtaagagttaactttggggctgagattgaaatatgcttctaacacttacaggcagcaagacatttgcaagttaaacaagatctaagtgcttctgttctgttcccttgttgtaaaacggggaaaataatagcactttacccacagaactgtggtaaaatttaaatttgattcttgtaaagcactcaaaataatgcctcgaatatagtaaacattcaaaactattagataatttttttagtaacaacattagatactaaactcatgttgtttctctaaacaacttaaaatcaattttattggtattatcatttttatacaagttagctcatttgaaattataaatcagtcagtaagatcatatacatctgggccactggtatatatttaagttttatcatgcataaaattctcaacttcttctacagtttctggtgcaataaggcattttaggtctctggttgcaagacagacactgacctttgtggtgaagaacctaggttccatgtgagactgatgggctctaccacctgctagaggcttgctcttagacaagtgcattactattcagatggaattatgggcagttccctctttgggttgtggcacttgaagcctttttaatcccaaatgttttattacatttacagactcaggggcaaaaggtaagaattccatttattctcctttagatctttcattgtttttttgaggacaaggaagaaaatcttcacatccctgagctctagatattgatgtggtttatgtgtctgtgtagtctaatgcttgctggtctatttggaggctgctctccacgttctcacttttccctgcaggaaagtgttagatcagttatctccactaggactccaacagggttcaaggtctggttgcaaacatcttctctctagcccaggctatagctaagacttaagggcaaggtggccatattctagttgctacaatgcaagagaatctatttgtgcagaacagaacatactcataaggcacaaagaaacctattacattatagtcatcagatatagtagaatgagacttttataaatatttatttctgcaaatcctacagaagtaagtttttaaaagcaaaaaaaaaaa

SEQ ID NO: 114431 - DNA, 740 bp, Homo sapiens
gtcaaccaaaaattccttacctaacaaagctgccctttggaaatgagagataaaggctttgtcaaaaaaaacaaaagctaaggggttcaccaccattaacctgctttacaagaaattctgaagaagtttttcacactaaagcaaaaggatactaattactaacatcaaaacatacaaaaatataaaacttacttgtaaaagtaagtacacagtcaaattcagaatactctaatagtgtaatggtcagataaaaatcacttatatctctagtagaaaggttaagtgacaaaactatttaaaacacctacagctacaataatttgttaagaaaaaaatatataaaaatatgtaaactgtaaaatcaaaaacataaaatgtgaggagaggaagtaaaagtacagaattttgtgtaaaatcaaaattaagttgttatcagcttaaaatagcctgttataattacaagatgttttatgtatgcctaatagtaaccacagtgtaaaaacctatagtggatacacagcagacaaaagagaaataaaccaaagcatgctactacatcaaaccatcaaatcataaaggaagacatcgacaaaggaagaaatgaacaaaggatctaaaaaacacaccagaaaacaacaaaatggcagcagtaatatcttacctattaataattaccttgactgtaaatagattaaattctccaatcaaaaaagcatatatactgagtagctcaatgggtt

SEQ ID NO: 114432 - DNA, 350 bp, Homo sapiens
attgtgcagaggccacctacactcaacataagtccaacagatgtccctaaagtcagaggtccagaaagcaaaacctagaaagtttttttgaaaaatcaaaaccctcccacaagtgctacttctcatgaatagtggcaaggtgaagaatcctgaagtcattgtgtgtaacctattaaagtaaacattggtatttcagcattcaagaagatgtgtccacatcttagtgggaacaaggatataaactctacatgggtatgggttctcttttataatgttatgtgtctgtgagaatactggattccttgttttgctgctctgaattttgggctccttattggaaaatattgcgt

SEQ ID NO: 114433 - DNA, 638 bp, Homo sapiens
cagcaccagctttccctaagcaaagtgcaagcccactatctgtcagtcaaagttggggaaaacactagctcacaattcgttcaattattcaatacaaccctatggagcccgtaagcccaattcatacgtgtgccctgtccagaaagggaggcagcagtcccgcgtccaccacctgcagggtgctcaaccccctgctcagtcagaggccacactcggtcctggaaggcagctgaggatgctgaagaggtccaaagagcacattacatgaagaggacattctgcaagacaactgactaggcttttcaaaaaaggtcatcattggctgagtgtggtggagcatgcctgtagcactcaggaagaaaaggaggaaggatcacttgagcctaggagttagaggctgccgtgagctacgactgcaccattgtactccagcctcagtgacagagtgagactctgtctctttaaaaaaaaaaaaaaaatcacattattaaaacaagccagagaggactgttctggacggcaagggcctaaagaggcaaagccaagtgcagtgtgactattgattgaatcctagtacaaaaagctcagctataacatatagttttacgtcaaatgaataaattttaaaatgaactgta

SEQ ID NO: 114434 - DNA, 470 bp, Homo sapiens
ccacagggacctcttcctaagaaagcctgtgcattgtccaaggtttcccccaactgagacagcctgagatatggcctcatgggaagggaaagacctgaccgtcccctagcccgacacctgtaaacggtctgtgcttaggaggattagtgagagaggaaggcctctttgcagttgagataagaggaaggcatctgtctcctgctcgtccctaggattcgaatgtctcggtgtaaaacccaatcgtacattctatttactaagatagtgtgataccctaccttgttttaaccggattgactctcttttagctgagagagccagacagactccatttttgtttcttcacttgcagccccccttatccccctcccttaaggacataactagtgcaagctgactccaagcacgtccaggaatgcacttactgataagatatagaggcaagctgaaccagcagctcctggggatgc

SEQ ID NO: 114435 - DNA, 284 bp, Homo sapiens
atttaaggaacgctgagaaatctattctttttatattctacttatttctatttttgccatagtctgtgataccgatcagcccttcaaaagaccgagctgggtttgtccagtggttgaatgatcatcaaacagtgaatgatggcagagttcttatgggcactttggaccatgggctgcggcatggcctggtggataagcatttgggctccatgtggccttgggcaagaactttgacctcttcgagtctcagtttctccatctctagaatagggataataatatat

SEQ ID NO: 114436 - DNA, 371 bp, Homo sapiens
agaggtgtgcagggtggaagggtggcagaggccaagcagggccctggcagtgctggcctggggtatgtgagtccagtctagaacagtgggagacatgttgaagaggaactgtgacaagacctactaccaggaggaatgtattgtgaagaatcaaagctgactcaccaggtttctagcctttctttctttctttcttttttttttttgtcggagtttggaatgtattgtgaagaatcaaagctgactcaccaggtttctagcctttccttctttctttctttctttctttctttctttctttctttctttctttctttcctttcttccttttctttcttccttccttccttccttccttccttccttccttc

SEQ ID NO: 114437 - DNA, 366 bp, Homo sapiens
aactgtacccagatcaagaagccagacattacctgtaagcccttcttattctccagtgaccgctatcctaacagcataggttagttttgcctgttttatcctttacagaaacaaaatcatatagtgtctgtttttttgggcctgacttcttcactcaacattgtttcagaggttcatctatattaagcatagcagtggttcatgcagtctcattgctgtctgggattccgctttgtgactataccatcacaatgtctgcgatccattctgttggtgggcatctgggtcatttccaatctgggctattgcaaatatactgggtatgatattctagttcatatcctttggtaaacatacacactgatt

SEQ ID NO: 114438 - DNA, 237 bp, Homo sapiens
tgatgtagtaggatatgtaatgatttagaaattttcatgacacatttaagtgaaagaagtattttagagaacactgttgtaagccgttagaaaatagttcttaacctttgtttggttcaggattacccttaatttaacaaagaacctgtcaactctctgaggctgctcttgtttataaaaatgcctggagtcaatgtatcagaatattgagttgttgcccttggtactgactagatt

SEQ ID NO: 114439 - DNA, 212 bp, Homo sapiens
cctgggtgattctcccagagtcccgcggctcataggcggtgggatacccgggtatgggctccagcgaggacacgtacgtctttggctggctcttccctcttgggtgtgcatcctcaggtggggcctggggtcttactcccttgtcccagtgccttcctggcccagtgcctgtgtggagggggtggcaggggcagctggagtctctagagctt

SEQ ID NO: 114440 - DNA, 378 bp, Homo sapiens
gtgctgcgtcgacataacctctgtctgcattgtgcattttgatagccactagccacgtggtactgttgaacacttgaaatatagctaatgtgggctgggcgtggtggctcacgcctgtaatcccagcactttgggaggccgaggcgggcacatcacgaggtcaggagatcaagaccatcctggctaacacggtgaaaccctgtctctacttaaaaaatacaaaaaattagctgggcgtggtggcaggtgactgtagtcccagctactggggaggctgaggcaggagaatggcgtgaacccaggagacggagcttgtagtgagcggagatgcaccgctgcacgccagcctgggcgacagagcgagactccatctcaaaa

SEQ ID NO: 114441 - DNA, 719 bp, Homo sapiens
gcagtcaatgtagactatttaagggttgatgatcaaggcaatagattattcagcccttattttctactttctttgacttgttaattttagagtgattttgctgcttattagtaccttttaccagagataggatagggataatggaagaacaaagacttccccacattattacctcttagtcaatgaggggtagggctcttccataagggaagagtagaaattgtattgaataaaggaggcttgtggattttctctaaaataggtttcctcacagaagattgagaattgctcacacctgggaactctgtacctctagcatcctatcatgagtaggtgagtactgagtaaatcaaatgtgtatggtagaccaacttccaagatggtggccaatgactcccgcctcctggtatttatgttctgtgtaatcctttccccctgagtgatttgattttaaccagtggatgttactttcatgattaagttgtaaaatggtgacttccacacaggcagaatctctttcttgtcttcatcttgcatgatttaatgaagcaagctgccttgttggagaggaaatgaatgtgtctctggccaacagccagagaggaactgacactgtcagcccaataacctggagaaactgaatccagccaacaactacgtgagcttggaagtggatccttccctaattgagccttgagaaacctgtatcttagccaaga

SEQ ID NO: 114442 - DNA, 1052 bp, Homo sapiens
ttagcttttcttcatgtactaaaaagacccttctctctgtcgtaggctgaaccaagtaaagctagacctgaatataaaatcctgggctgtggtataacagttcacattcacgtaggcagtacacatggtatccatgggtaaagtttccaccaagccagtattttactatccaagtgatggaagagacattgatctagcattcaggagccccacttccagttcttgtttaactgttcacgtttagctgggtgattttatgcaagtcaacctctctgagccttaggtttttaatcttacatcttcatcattttttaaattaaaaaaaatttaaaaatatttgttgtggcagagactgctactcaccaaaatccattctttccttcataagacaagactataattcgaaacttcccttgaagcaggtgggattcaggtcttgccaacagaatgtaaacacaagtgatgtctgtaacctgtgtttacttgttgaaggccctttagtcaggctggaacggcaaggactggagcaatctcaaaaatggcacattagagatggtagagctgctgtcagactggagtcctaaatgtggaacagagtcacccactgacctgcagcctttgattaggactgttaaatgagaaagaactaagccattaactttttggaatatatttgttacagcagctagtgtttgtttaacaaatatatatgccctatttatattataaattgtgagagatagatctaatgtatgggaatgaacagtgttgggaggtgacaagtgctgcatgcatttgtcatcatattattaatacagagaaaacaaatgtctagtagaatgtctgacataggatgtctaatatctgttgaatgaatgcatggatatcttgctgaaaaaagtcctgagatttaaaaaaatctacaccgaacgtggtggctgattcctgtaatcccagcactttgggaggccgagttgggtggattgcttgaggccaggagtttgaaatgagcctgggcaacatagcaaaactacatctctactaaaaaaaaa

SEQ ID NO: 114443 - DNA, 698 bp, Homo sapiens
gggtggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgaaaagaccaaaacatctacatggagtcaagcccttcacctatctgagccacaacttgctagctgtgttgaccatgagaaagttacttcgcctttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaagaggtgctggagaggatgtggagaaataggaacacttttacactgctggtgggactgtaaactagttcaaccattgtggaagtcagtgtggtgattcatcaaggatctagaactagaaataccatttgacccagccatcccattactgggtatatacccaaaggattataaatcatgctgctataaagacacatg

SEQ ID NO: 114444 - DNA, 479 bp, Homo sapiens
cacagtggctcatgcctgtaatcctggcgctttgggaggcagaggcaggaggattgcttgagcccaggagtttgagacccacctgggcaacatggtgagaccctgtctctaaaaaaacaaataaaacaaaagggatctttctttggaagcatcactgatcaatcatcttgtagttaggttttaattatctttaggtgccaggatggacctgtcctgggttgttggtatggtcccatgttggagggagtgcttgtcaaactaggagtcagtgtcaggaccctttcagtcacatttgagcacacaagggaagtttggagggagtgattctcaggctaagtctgccgggaatccattattaagatcagtttttgtctgttccttaaatgtaggctatcatctcagggtttagggccagcccagtataattctgttgggtcagtataattctgtactactacagaaatgtaacaaataacatg

SEQ ID NO: 114445 - DNA, 301 bp, Homo sapiens
gctctatttgcaataaccaaaacctggaaataatccaagtgcccttcctgggtgaacggttgaacacaccttggttcatccagatgacggaacaccactaagtaattaaaaagaaacacctatggacatgcttgccaacccggatgggtctcaagggaattgcgtttagcggaaaaagccagtctcgaaaggttgcatagtgtatgattccatttatagagcattcttaaagcgacaaaattatagaaaataggaaccatactgtggttgccagcctcagggagggggaaggaggaagtca

SEQ ID NO: 114446 - DNA, 185 bp, Homo sapiens
cactgcactccagcctgggcaacacgggcaaaactccatctcaaaaaaaaaaaagaaagaagaaaagaaaacaaggccatcctgctccctttggcaccaggaacagatatcagaaatgcatgtcgttgttttcaaagctggacagggaggtggcaccagggtaagtttaaatgatagaaagcgct

SEQ ID NO: 114447 - DNA, 423 bp, Homo sapiens
ttcaactctagagagaattgtttctgggtgtttttcactatgtgactcaccactgtgaaggtatgaagatgagtttatgccgctaatggggtagctttgttgtgatgtaatttcagtagctgcccatggcagctgttagtcgaaggtaaattcaaagccagatggtttagatatcacagtggtgaagatcaacagagtaccgtgaaaccaggactcggtcatggcaacctgagactgttctagctaactctttctaatgtgtttcatctggcactttgccagttcagtcccttgcttacctttccccatttgaaaaactctgcttttggagggagaatggattacaggtcttgacagaggcttggactcttgacttcttggtttgtttttttaaatttaaaaaagaatttcagttcttttgtg

SEQ ID NO: 114448 - DNA, 390 bp, Homo sapiens
gagcaaggccccaactctttaaaaaaagtaaaagaaaaaaaaaagagagaggcatcagagttttcctggaccaaaaataattccttaaggatttaacagacacaagagaagagtaggcctcctccatcccccacagccagtggggttcaccttagaagcaaatttataaatacaaaaatcatgtagaatctcattgtaacaaacaaactaaagccctggagaggatgtagggggaagggaaggacatcaagaagcaaaaacatatccagatcacaaaactgaaaccagtcctagcccatctatcaaactctaagtgcattctttcattcatacttggtccaaccacaaatagttggtaatagaccagagagatcatggaaaacacattgt

SEQ ID NO: 114449 - DNA, 1182 bp, Homo sapiens
gctgagtttaaataaagccaccttggaattctgaacaaccaaatggactacttggatctcaagggataattgcattactagtgttctcatgatcctcttatttaaatactgcccatcctttggtgtccagctctcaagtcacctgttcatgaagctgcctcagttactccagccccatgcctcctttgcctgaggtcttttgaacctcgactgactaccatattgttcagtgtttcattatttcatacttggtgttttttccctccaaagcttgcatataaactctgaggaaatgtgagctgattctatgctttataaattttaaaatatctggtacagagtggataaattgatgctccacaaatacttggccataggttgatcaaaattgaaggcgtgattttttttctcccctcttcaaaattatggcggaccttaaagttttcatacattaaatagctatggctattttaattaaatactgttatatttttgttattataatacctattcaagaggcaagttctaattccagtaaaggaacactacaagtcaataatctcattttctaaaaggggaaacttgcgtatcactcagcttgctaagtaatctttggtttctctaacctgtaatttcctcatctctgaaaatgagaagttatgtctttagccacttgcctctttcattttgttgggagagtgcacatggctgaagatagtgatgtttctcagtcttggagagaggtgctatcagtacttacttcatcattcactgtgtgcaagaaggaacttgtgaagacctgatcaatgtattatttagcaattttcatttttgatttaccaggatgttgtgaacacatttcttttctaaaacagctttctagtgtgaatcccaagagaatgtataattttgcctcttactattggtttatttccagagtagatgattcagggaaactttttttttttttttttttttttggtgaagtttgtcctgaactagatgctagcaatttagttttgtggtaaaactttaaaatggaaatgtgatgacaaattaaagggtaagatggttctctgctggtgggaaggcgtgggatttccattctaatggcaggaaatcaacatatgttagcacattttttgcagatctgcagtaaataatggtagtgcttagattcgg

SEQ ID NO: 114450 - DNA, 455 bp, Homo sapiens
atgacttgctcctttaacccatacttttttaagaatttaatttgtcctacatttatctttctaaatcacttcctgtaatactgtcactatcctcctctaaaattttcagtgtcttcctaccgactataaaaaataagccccatcttctctgtctggcaaccaataaaacccactaattggtctcaacctatgtctccagtaaattgctgttattactccctgacatgtagcctctacacccaaacaaattaatctcttcattgcatttgaatataccatgtgtatctgtgtcccttttcagaaattacgtgcaaggtttggcttcattgaaatacattccttattcctatccacttattaaagtctaaagtatccgtacttttatctttcaaactagcactctttttgctggggagaaagaagaggggaaggatgattactcagagactgctcaa

SEQ ID NO: 114451 - DNA, 721 bp, Homo sapiens
gagatttcagcatgtgcagaggaatagggaatgaatgcatttcacatgtagtacatcagtagatctagtctacttgaataaagcaaggaaccggcatcttattgccctacctgtgaaccaaaatggataaaaaaatatttgatcaactatctagggttatggttagaaattagcaaattgtcatatccaggttgtatgtaaaaaacaaaacaaaacaaacccaaaaaaactaaaaaaaaggggggaaaaattagcaaattgtcgttaatggaagaaacagagacaactgtgtaactaaaaacttggaggacaaccttcttgatttagggaacagaagtgaaatatctctatgagacaagaaccttaggtgtccagcaaaatatctacttctgaaatggactccaagagccagactgagggaacttccaaaacatctgatgaggagtacatctgtggatggaaaagaaactaaaacaaaacacctcccatcaaaatgagtttcctcagtaaaaaaattataaagctggagagcgaatctttatcaagaaagatagtcaaaatgtaaacaaacaaaaagcaaaatataatacactcaaggaaattgaaataaactttaatcttgagaattatgaacatgtttattttaaactatgaccagtagccataaaacaatgtgagataataaagcaaaagctgataattacgtattaagaacaggtgg

SEQ ID NO: 114452 - DNA, 489 bp, Homo sapiens
aaatccagtgaatcacataaatctatatgggctaataaaaactttcagaaaggaaacaagattaacatataaaaatctacagcttttctaaaatcagaaaaaatctatttaaatatgtaatagaaaagaaagctatatgcaatttcaatagaccttgggttacctaggaaaaaaaacttacaaatatgaaagctgttgccaggcatggtagctcatgcctgtaaccctagcactttgggaggctgacatgggcggatcacctgagtccaggagttcaagaacagcctgggcaatgtagcgaaacccagtctcctactaaaaatacaaaaaatagctgggcgtggtggccggtgcctgtaatcccagctactcagggacaagagaatcgcttgaacaaaggaaaggaggcagaagttgcagtgagccaagatggcgccactgcactccagcctgggcaacagagtaagactccatatcaaaaaaaaaaaa

SEQ ID NO: 114453 - DNA, 289 bp, Homo sapiens
gtatttttagtagagacggggtttcaccatcttggccaggctggcctcaaactcctgacctcaggtgatctgcccatcttggcctcccaaagtgctgggattacaagcatgagccaccacacgcggcccaaagggcattttttattattactgtaactatcaggattatttgtagtcatacaagttagtagcagatgtggaattaaagcccagactcagggacatgaatcccagtgcccttttttgctgtatcataataagtggaacattagcatctgccagctctcta

SEQ ID NO: 114454 - DNA, 663 bp, Homo sapiens
actgtctgtgtggagtttgcacattgttctgtccaggatgggtttctgcttggctacctgagctgtcaggaaggactttggccacctgtgaccatgaactgaaataatagggtaaataattatcttacttgtttgtattaatctttcttaaatggatgtatagcttacatttatctcaaggtttaagattagaagggttttgttttttagttagaagtttggtgacatttttgtgagcagaaatacactctaagaatttatctcttttttatattagttagcctatggtaaaattgacttcaatagtcatcatttcacttaaagttgcagttttcaagaacctaccaataatgttatgtgagaccttattgtacatcataaagtttttcaaactggagaagaaaagaccatgaaagagaacagagacttagtactatggtgacacagaagaggcaaagaaaaaagtagaatgattcacccattaaacctgcctttatggaaatttatataaggcactgttgggtcctgtagctaaggaattatggaattattaagtagcttacacagtctgttagggaacagagacaattctacaaagaatactataatggagtaaggacaatttaaaaggaaagtcatagagtggtatggccactaggagtg

SEQ ID NO: 114455 - DNA, 314 bp, Homo sapiens
aaggctaacagtacccagtgttggtgagaaggtggcagatttagaactatcaaacattagggccgggcgctgtggcttacgcctgtaatcccagcactttgggaggtcgaggcgggtggatcacgaggtcaggagttcgagaccagcctggccaacatagtgaaaccccatctctactaaaaatacaaaaaattagccaggcgtggtggcgggcgcctgtaatcccagctactcgggagactgaggcaggagaatcacttgaaccccagaggcggaggttgcagtgagccaagatcgcgccattgcactccagc

SEQ ID NO: 114456 - DNA, 817 bp, Homo sapiens
tatggcctgcagaacccaggaatgaatcggtttctgggactctacggcgaggatgatgattcctggtgttcttcctcctcctcctcttccgactcggaagaagaaggatattttcttggacaaccaatccctcaaccccggccacagagatttgcctactatacagatgacctttctagtccaccatctgcacttcccacccctcagtttggtcagaggacaacaaaatccaagaagaaaaagggacacaagggcaaaaattgtattatttcttaaccaagtagtgatgcagagcatttgtttaaaacttagccattaaccgtctgaatcgtttccttttcttccgtaggaaagttgtgaaaatagtttaaagtgctttctttgcccatgtaaatgagaactcaactgctgtttacagtgtcagattaacatttgaaaggtgtgatttctccaatttaccctctttggatggtgccaggtggacgtgacatctcgtgcctgtccggtgcgggtgcgttacagatggacgtagctgccttggttttccagtcctcaagggaatactgaagatgctgactgaaggggattggatgttgattttagaagatggagaactccagccacctttgtaaagcactagtgtttgtcatttatgtaagtcaggtcggctcaggtcttgatagtccgtcttggtgtgaggcatgcctgtcacgatgacctagctaacactgtgcatcttattgtgaggccagcttgtcccctcgaaccctctttggccaggtaaacattgtattgtatcagcgccagctacagattg

SEQ ID NO: 114457 - DNA, 219 bp, Homo sapiens
tgtttcgttcaacctctatcaaatttacactcctcattttccaattatcctaggtaggtatgactaagggggaaaccgtggagtcagtgtccgaggaaggctaacctagtcttaaaaactacctgggaattagcttcaggtgagaagcagcaatgccagtaggcagatggggtggtgccaatgccaggcgggctctgcaatcagcatctcccagcctcc

SEQ ID NO: 114458 - DNA, 288 bp, Homo sapiens
tttgaagaggccagggctacacagccaggcagatgaaggatgcagatgttcccaccctttaccagctgtggagccttcagcaaatagcatgacgtcttcaggcctcaacttcccttatttgtaaaagggggagacatcaattcatggaaaggagcaccgacgacgtggagtttaagtctggagcaggcactgagctgtctgtgcgcggtgagtacagcgtgggcctcctttgcctctggtttgtgacagtaactcaataataacaccctccattctttgagcaatgat

SEQ ID NO: 114459 - DNA, 326 bp, Homo sapiens
gatctgcctgcctcggcctcccaaagtgctgggattacaggtgtgagccaccaaatactatatattttaaacaaacaaatacttttaagtgttatgcttactaccgactgctgcttaccagtgtggtgcatgttagctactctgaatgttggttttttatctgtaaaatgatagtaaaggcgtgagccaactgtgcccgactgcatcttgtattcttaagcctgtagagcatctcagtcttcaggcagccaaggacatttattagaattggagcctctggctgccttggaagaggatgttttcaacacttttagcctgtcgtaata

SEQ ID NO: 114460 - DNA, 313 bp, Homo sapiens
tgggaagagctttcacatcgctgtgaaatcctctaagaactctggctggcagtcacagcccagcttcagagttgatgattcagttttaacttgtgatcaaatcaaggtttacatcatgcatggaaatcaaggtttacagcacgcagaactgaaaactgggtcctcattagatctgccaaactcctagagcttgcaaagggacaagggacaatagtctctgctgccaggtcccaggggacaagcagagggacccaactggggagcacttgcagccagggatgtgcagagggagagggagtcatggcaggcagcc

SEQ ID NO: 114461 - DNA, 387 bp, Homo sapiens
  misc_feature (387)..(387): n is a, c, g, or t
attatgaagaatgcatatcccacatcagtagtgagcaatgcacgaaataatggaacactagagctgaacttcccaaaaagacctctaaaggaaaggaaccctggccgggcgtggtggctcacgcccataatcccaacactttgagaggccaaggcaagtggatcaccagaggtcaggaattcgagaccagcctggctaacatggtgaaaccccgtttctactaaaaatacaaaaaattatccaggcatggtggcacgcacctgtaatcccagctactcgggaggctgaggcaggagaattgcttgaacctgggaggtagaggttgcagtagccgagattgcgccattgcactctagcttgggaaacaagagtgacactccatctcan

SEQ ID NO: 114462 - DNA, 192 bp, Homo sapiens
gggtccatgtgggttacggccgccacgcgctggctgatttttgtatttttagtagagatcggatttcagcatcttggtcaggctggccttcaactccggatctcatcacacacccgcctcagcctccccacatgcggttattatagttgatatgtctgaaccaaaatgatatgggaagcttgagaataaaag

SEQ ID NO: 114463 - DNA, 249 bp, Homo sapiens
ccttgatggtgtggggaaagatgtctgaatgggcagaggcctcctgagtccacctttgtggcaacccagttctaagaacccgggatgggaaaggggtcagtgtgaatggggaacctgccaggccccctgggcaccagcctctagctacctgtgggccctgagcaactcccacccgctggagggtagggagccacaccccaccctgcctgctgccccagggtgccagcacagcatctcccatcccctggc

SEQ ID NO: 114464 - DNA, 436 bp, Homo sapiens
atttccttaggctgcttaaattgtagccaaagcttttgtatgtatgtttgacagtcatttggctaaggagtacttcacttgctcttgaaaatagttactgtaaactcatctttgacatagttggaaatcctggcgcttaaagtttggtcacatgacatagcttttgccagtgttgtagtatgtactggggtttctagtatcttcaatttcattctggaaagagcctgagatatctgagctgtctgttcaggaacatgtcaggactgttaaatgtggcatatagaaattgccaagtagattatattttttaaagctgttggagcatctttcagcctcaagtattgctatttcatatttaatattcttcctcgtctgtttcagtatgacttttctaccaagtggaaaagataaggtaggcttgctgagttagaagccc

SEQ ID NO: 114465 - DNA, 395 bp, Homo sapiens
gtggcagaggcagtatttgaatccaattatttcatctccaaagtcctgctgcttctgactttgggtgtgggggcaagagaaagccagaataaatagactctccacagtctcataaaattcagcattggggatcatgggaataactaaagtgaagacaggaacagcaaagaattctagtcttggctagcttcacagattcagccttgagagcatcctttccaatgaaacctttttccccccctttctagtgaattaaccactaacgactttctgttacgctaggcactatgtgactttatttcaagtatttgtttcacctctactactcctaagttcagataacttatttaagtcagctacttccccccagcatctagcatataattggcatataa

SEQ ID NO: 114466 - DNA, 515 bp, Homo sapiens
ctacatgcttacaactggctcgattcaaacattaaatgaagtagagaaatcatcagataaattgctggccctgtgtactggagagtgaaggctctttctccagctgacgacagcgctaggcttttgtctgacctaatttatttctctttcaggttagaataaagcactctttcctgtcgcagggtaacctcttctgctcatatattgaactctagcataagactcagggtgcagtctgcagatttcttcaacttgggaaagaagacattataaatctagaaatcctatgatcaaaagcacatatattccccatcactagattacatgtttaggggagaaatcctctcattaaaagccatccataaaggacaactgtttggggtgaaagatgtgatcaagactggctctagcaatcacatactctttccaaacaaagttttacatgttatttgagtcggcattttaaatctttggggaacggtgctatttcccttagttcagtgggaacattacct

SEQ ID NO: 114467 - DNA, 214 bp, Homo sapiens
attttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataag

SEQ ID NO: 114468 - DNA, 246 bp, Homo sapiens
actccagggcttgttcttgtgggtttcttctgggctccatgttagaatcacctgggaagctttaaaaatgacggacacctgggccccactcccagcaattctgattcaagtgatctaggcattgctattcaaaatgtggtccatgggccagcagcattggcatcacctaggagcttgttagaattccagcatcttagaccccactccagacccactgagtcagaaccggccatttaacaggatccc

SEQ ID NO: 114469 - DNA, 303 bp, Homo sapiens
caaaaatttctgtcagattacatgtcagtgagataactacagaagatgagagaaggttgtaaaaataagagttttgttagattattttagaaatatctttaaattctcccactacttaaagtaaatggaactggaaatcttttatgatgcattatagatacgcattatataagaaagatgctgtggagctccaattattaacagacattattaaatttaaatttttgcctctgcataaaaagattggccaaagaatgtacatacacatgctcaaagttaaaatgtttaaggtgcatatgtctc

SEQ ID NO: 114470 - DNA, 628 bp, Homo sapiens
ttcacagatctcagattgggaaagacttgtctacagcacacatgcatggttaggaaattatttttcaataaaagcaattacattgttattaaggacaatgacactgaccacactgagctaagtcaaagtttaagtaaatcaaacttgtcattagaaaagcagcttagaggtttattgcaaaagccttctccagaaactttcccggcccggggaatctgcctgtgatgggaatgtgctgatactctccagacccctgttttagggctgggaagattgaggcctagaaaaggaagtgcccgtggcagagttactgctagaacccttccctaaacatggggtcctaccccttcccaggtcagggcgccctcacctccttccctttcactggcccctgacgaggcactaagtcaaccaacaacctaaagagccacttagtgaagaggtagagagtgaatatacctagcgttttattccacaaagttccagaaacccagtgactgggcatttcctttttttttttctttttttttttgagacagagtctcgctctgtcacccaggatggggtgcaatgacacaaccttggctcactgcaacatctgcctcctgggttcaagtgattctcctgc

SEQ ID NO: 114471 - DNA, 776 bp, Homo sapiens
  misc_feature (696)..(696): n is a, c, g, or t
gtggcagggacagagacgggtccatggcagtgtctcctcttctctgtgaaggcaaagggcctctgagggagtattacagccgcctcatccaccagtagcatttccagcacatccaggtctgcaccccctggctggagggccgaggactacccccgcttctagagccaagagctgggtagagctgcaaggacaccgcctgcacaggatgcccggggctgggcattacctgctgcaatgacaacatctggctggacggcagagagctgacagaccgtcgcgacgtcccagtccagctgggccactgtcaccctggggccgtctaagttggcagtgatgtctgcctctaatgagaggccattgagaaggacattccctcggagctgctcgaggacccggctgtgacagtcgctgaagatgtacgcccgggggcggcacatcttgcagatggccaggcctgtgaggccggcgccactgccaagctttaggacagtcctggtgggaggaaaggggaccgtgtctgtgactgcaccaggtaagcctgctcggtgccctgccctgcgccccgaggtcacctgtgagtgaaggctgctgggttctcggcccattctgcaaggtagagggcagcgtccccatgtgaccaggcctgtggtgccgtggagatgatggctgtgctcttggagagtgtgacgagcctcncgagggctgcaccaaagagagggcgagagagtcagtccagcaatcagacgacagtggcattgaagacagtagcattcaca

SEQ ID NO: 114472 - DNA, 402 bp, Homo sapiens
cagtctggagtgcagtggcgcgatcttggctcactgtaacctccgcctcccgggttcaagcaattctcctgcctcagcctcctgagtagctgggattacaggcacgtgccaccacgcccagctaatttttgtatttttagtagacacagggtttcaccatgttggtcaggatggtctccaactcctcaccttgtgatccgcccaccttggcatcccaaagtgctgggattacagggatgagccattgcacccggcctgtattggcttttaatttttaggaagtaacacatggctgtgacctgacaacttcatagtggccgtagggtagggcactgttgtcattattcctgtcactgacaatgtcagccccacctgcagatgtgggagagtagatggggaaag

SEQ ID NO: 114473 - DNA, 344 bp, Homo sapiens
tccttgtgcccctcgaggaaggctccctggaatgagttagttgattaaaaatgtggcttaagggaattcgaagttgtttaggcaaaaggaaacctgactgaatttctccccacctgccccccttgtagctcccccaatcccaggatcatatccaccccaacccccttcagactggttcctgagttgccatttcgggggctgggcgccaggccagtcaggaacaatggccaatggaacttgagctgccaactgcaacaccagcaccgactgcccccccaagacccccaagtttccctgccccctcctgcctgggaaccaccctcccaccaccaccctcaccaccc

SEQ ID NO: 114474 - DNA, 633 bp, Homo sapiens
gctcggtaccgactgaagttggagtcatgaatgttgatcttaccaccgagggataggatctgagcattgcacctcaaaactacccgggatgagatacccagccaaagccaagggcacattctagtcggagacagccatcagaatttcgcctgtggtcttccagctggtagatgtgaacacaggtgctgagctcactcctcatgaagaacctgaagttttcactccgtggcataagcaagaagcgctaactctactgaaaggacatttgaacaaagacctagaaacaataagggagcaaaccatgtaggtacctgggagaagacccttctgagcagatgaaatagcaaatacaaagaccctgaggctgaagcattttttgtgtgtacatggaacagcaaagaggcacatgtagctgtgatcaaatataaacaggaagaatagtagcttataggatcagagagttgataggggccatatcttgtagctgtttaagctacaagatatctgagctacagattcagtttttcatactttgttttgagtgagtgtcgctctgttgcccgtgctagagtgcagtgagccgagattgtgccactgcactccaccccgggcaacagaatgggactccatctc

SEQ ID NO: 114475 - DNA, 5941 bp, Homo sapiens
accaggactaggaggcagcggggagcgtgcctgcgtcgctcggagcggtgacagcaaggagcgcagcgcggaggccgggcggcaaggggagtttccagtcctcgataagtggagtccctgctctgcgctgcgccagcgccttccgcctgggcccgcggtgctagacacctgccgagtccgaagcgggagtcaggctgagccttcggcccccaagatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcctttccccccccccaatagtaaaatttctcctcctttaactcctcctaccccccaaggtaagaaacaaaaaacaaacaaacaaacaaaaataggaagacaaaaggaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcggaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattatatcctgcctcttg

SEQ ID NO: 114476 - DNA, 839 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagggaaacttttatttcccgtcttgacagcggcggtgtttgtccctggtctgcagaaactgatacagtagcctccttccttgggtaatttaggagggcttgaagcttcttctgtcatgtgtaattcttggattgaaatgaaaggtcataaaggacttggaagtgtgcacgagaattgggtttgaaaaatttgtgctccatccactcttgggaccattgctgtcaggtgattgtttaaatcctgaacttgttaaaaggcgaaatgtcagggagctggcgggggtgggggtgtggagggggattgaagtcccggtatgaatcgcagcgtttgaggaacttagggcagtactccctgttctggggtgaccattcggtaactgatgttccagcatcccgagccctcagcgccgtcagctggatgatctcacagggaaggcgcagcacatcgttact

SEQ ID NO: 114477 - DNA, 640 bp, Homo sapiens
  misc_feature (8)..(8): n is a, c, g, or t
gcaacgangggagaaatctggcaatcatcaaatctcatcccctgatggactctgcgccaacccattgttaataaaccctggcccaaaaactggggggaaagggaaaaatttggcggccttttagggcccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtaggtatatgttacgagaacgcccttcagcactgctcaaaaattttcggcatgtatttcatctagtcattctcattgaaataaatcttgggtttgtttttttcccgagcctgctagggcgaggggggtgaatggttgatgagtttaaaaataatgcagcccttgtttttcacctgtagaatatgagaacattttaacagcacctctcttatcttgcagatatattccaagatgctacatgcagcagacagctgtgagcttgcatacacacacacacaaatatacatgcacatacatacacagaatgcagtactagttaagtatttccttcctatctttaataagtaagagaatatttagaccatt

SEQ ID NO: 114478 - DNA, 438 bp, Homo sapiens
gaaggcggcacacccagagagagcatggtagctccatgctgcttcccccatacctcaccctacacatctcttcatctgtatcctttataataatccactaaatgatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggggattctccagtcccgatggagccaaccaagtgcttttctcctatagcacctgacaaagaaaacagatagcgagaaagcctgcagtcaactctgggaatggggatggaggccccgaccccagccttccctgcttagaggaaacaggaaactctgtaccagctgggtgcatgaagggaagctt

SEQ ID NO: 114479 - DNA, 4808 bp, Homo sapiens
tcaatcaactatgtagaagtgcagtcccgggttgttatttcagtacggggactagagtttagtgtctaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgacatggaggtatcttcatcttctgttaccacaatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcctttccccccccccaatagtaaaatttctcctcctttaactcctcctaccccccaaggtaagaaacaaaaaacaaacaaacaaacaaaaataggaagacaaaaggaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcggaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattatatcctgcctcttg

SEQ ID NO: 114480 - DNA, 2290 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtaggtatatgttacgagaacgcccttcagcactgctcaaaaattttcggcatgtatttcatctagtcatgtccttttggtcctctaaattagcagtggtttggcataatagtgttttgtgttttttttctcattgaaataaatcttgggtttgtttttttcccgagcctgctagggcgaggggggtgaatggttgatgagtttaaaaataatgcagcccttgtttttcacctgtagaatatgagaacattttaacagcacctctcttatcttgcagatatattccaagatgctacatgcagcagacagctgtgagcttgcatacacacacacacaaatatacatgcacatacatacacagaatgcagtactagttaagtatttccttcctatctttaataagtaagagaatatttagaccatt

SEQ ID NO: 114481 - DNA, 5925 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgacatggaggtatcttcatcttctgttaccacaatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcctttccccccccccaatagtaaaatttctcctcctttaactcctcctaccccccaaggtaagaaacaaaaaacaaacaaacaaacaaaaataggaagacaaaaggaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcggaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattatatcctgcctcttg

SEQ ID NO: 114482 - DNA, 5890 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcctttccccccccccaatagtaaaatttctcctcctttaactcctcctaccccccaaggtaagaaacaaaaaacaaacaaacaaacaaaaataggaagacaaaaggaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcggaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattatatcctgcctcttg

SEQ ID NO: 114483 - DNA, 662 bp, Homo sapiens
gagagagataaaatgtcctctattaatataaataagactggtattaatagtgtcttagtccattttgtgctgctataacagaacacttcagactgggtaatttgtaatgaacagaaatttatcgggctcacaattctagaggctagtaaggccaagattggggggctgcatatggcaaggaccttcctgctgcatcatcccatgatagaagcataaaagggcaaaagagcatgtgtgcacaagagagcaaaagagtgaactcacagcctcaaacccttttataatggcattaatcattcatggggatggtgccctcatgacctaaatgcctcccattaggcctcatctcccaacactgttacactggggattttcaacacgtgctttctgggggacacatttaaaccacagcattccaccctggctccccaaattcatgttcttctcacataaaagacacattcatgtcatgcaatagccccaaaagtcataactttccagcatcagctcagaagttcaatgtacacagtctcatctgaatcagatatggatgagattcaaggcaggattcatcttgagggacacttccctctagctgtaagcctgtgaaatcaaacaagttacttacttccaaaatacaatggtggaataggcaaaggata

SEQ ID NO: 114484 - DNA, 229 bp, Homo sapiens
ccttaacttagcaatgtaaacctccatccatgaaaagcacctgctgacagctagtcattttaagaaatatagcatttcttaaaatggtacatgagaaagtttgcagaagcaattgtctagaacccttctggtcttgcttcacactgccagctgagttatcttcctaagtgaatcacagtagaatcctgctttgacgcatttctaaccagttggaccagctgcagctcac

SEQ ID NO: 114485 - DNA, 135 bp, Homo sapiens
ttggagaaaggaaaccacaagacaaccctggaatatttagtgtcagaaatcaagggagtgctcaaagattggaaaagacatgtctaggtaggatgcggtggctcacgcctgtaatcccagcattttgtgaggctt

SEQ ID NO: 114486 - DNA, 208 bp, Homo sapiens
ttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgggccttttttttttttttt

SEQ ID NO: 114487 - DNA, 141 bp, Homo sapiens
attcctgttgttccttgttccccacagcatggattctgatttcctgtactgattccctcatcttcagaactgactctctgtgactcagtagcactgatccccaccgaacaaatctaaaatagacaacaccttccaggtctg

SEQ ID NO: 114488 - DNA, 409 bp, Homo sapiens
ggaatttcacaagataatgtcatcagttaaggcaggaactgaccattttcacttcttttgtggtggaatgtcatcatttaaggcaggaaccagccatctggatgtgtacctgcaggtcacaggggatatgatggcttatagagttttccagtaagataaatttgccttatggctctattacttccttgctgtgtgaactttgataagttatgtaacccatgtgctttaatatctttaacagtaaattagaaaaatgtactattcaagcctgtgctttcattgctatgcactgtgtctcaaaataaagtgcaaaataaaataaaatataggccatatttatcatggagagagcaatttaatgggggaagacacatattaatttaataaaattaattttttacaaagaaca

SEQ ID NO: 114489 - DNA, 525 bp, Homo sapiens
cagtaagtcttttcagaaaaaagcaacgaagaaagctctagaccaatgagattttagtcatcattaatcaatgccaagcgaaaaaatcttaagatgtatttaaatttgtgatgccagtgtgattcagaaatttgaaaaatggatttcaaagtaatgctgtgagcagataggtcattgtataaacataactaatggttcattcattcattcctacaataatgattcagtgtcagatttgggtgttgaaaatacagcagagaacaaacacaacagaaggtccatatttgcggagcctacattttgtgggggaagagagatgataaacaaaatgaatgagttaagtagatagcacgttagatcatccaaaatgctatgggggggaaaaaccctgggaatagggagatggcatgtgaagtggaagaaggttatgattttcaatagagtgatcagagaaagcctcattgagaagacacgctaaggaggccatgtggctggaggggactgagttagggggtgaatagtagg

SEQ ID NO: 114490 - DNA, 459 bp, Homo sapiens
ggccctacgcctgcatccgcgtatctatgtaccgtcgtctacgccacgctagtatgtagaaaatgactaaagtcaaaagtaaagattcctaagagtcattctgaccggcatgtggggccagggacagtgctggaagatagaggacaggcggttccagatgacctgcgagatacactgaagccctgcattcctgcccccacctctccagaccaacgccagcctcacagtagtagagtagttgatgtgtttcaataaataaatatttctctaggcatttagtaaagccagggcatgtgatccatttatttggaaacagaattttatgtagtgttttattatttttcccttgtaagacttttttttcccaaagaagagtactcattaatttcaaccatggcccttaggtatgttgaaatcttctacttatattggctaccagagaacctaagttcaaatacc

SEQ ID NO: 114491 - DNA, 303 bp, Homo sapiens
ttgatatttctgcaagttaaatgaaattgcacatctgcttttaataaagcacagcacacttgacttaataccagtgtctttgcagcaaaattcaaattctagattcttatgacccaattaggtctctaagtgaaaatgttctttatttactcttttccacttaaatctggctttgccgggagcaccaggtttagtaatctgattaacaagtaggcagatgaaagcaaagaggcagccttcatattcatgttgtaaagacctccagggattactgagaacaaagataagcagtccccatcaatg

SEQ ID NO: 114492 - DNA, 375 bp, Homo sapiens
tcagtggctcacacctataatcccagcagtttaggaggctaaggtgggaggattgcttgaggacaggagttcaagatcagcctgggcaacatagcaagatcccatttctacaaaaagttaaaaaatgtatccaggtgtggtggtgtgtgtctgtagacccagatactcaggaggctgaggtgggaagatcacttgagctcaggagttcaaggctacagtgagctgtgattacaccattgcactacagtctgggagacagagcaagaacctgtctgaaaaataaaaataagtattatttttaaaaaggattaactgaagtgaaggttaaagagtgaaatattttttaaaatcttgacaaaactaacaagaattgta

SEQ ID NO: 114493 - DNA, 286 bp, Homo sapiens
gaaattttagagtttaaaaggatctagtagggtttgtttggaagcctttttcataaattcagtcttaacatgaaagcagagtggtgatcctacagctgactgatctcacccaacaccctcgtttttcagataaactgaggtccagtgaggttttgtgacttaatccaggatcgtcaatcaagatagtaaaaccagatttagaccaggtcttctgattcccaactgaatactctttctgtctcacaatagataaaaaataagttgctttgaaatactttaatcctga

SEQ ID NO: 114494 - DNA, 460 bp, Homo sapiens
ttgtgtctcccttactacactgcaaactcctggcagaaggaatggcatctgtcttcattgattcctagcacatgctgcagtttctcacacacagcaggaacttactaagtttttacttaatgaacaagtgtcatcgttatttatttgttttagctttcttgtcattatttaaagacagatttgaaacaagaattatgaatcatctttgtactttctacaatgcctagcatgacatctaacacaaaggacagacctgaaaaaatcatttagtgaggaaataaatttctccatcttatgctgcttcatcggcaggtgaggaatccctccccactctcctgtggacattgcacctggagggaatgatgttagaaccaaatagaactttgcctctggctttttcaattatttctctacctttctgtagtcacttttaatctggactccccactttctcattctg

SEQ ID NO: 114495 - DNA, 659 bp, Homo sapiens
gctgatgcaaattttaaacagtccattgcaattttgctcaatggctttaggtaaaaatgctgatgctagtgtcccagagttccacttactttcctggcttctctacaaaatgactatggatgtataaagaagcttattgggtcttaatagtgtggggttcaaggggaggaagccccacctctgtatgggatgtccctgtaatgtcttcttaccctggggcttctctgtcctggccatctgtttgccagtctgatgccagagtctgtatattatgatttgtttgctgtttattgacttgttcatagtgaggtagagtcaaggactagctatagctcacttaggctcccattgaccctccctgtgtgtctttgccataccctccacctggactcctggcctgcttctagcttctgctggtagccactttgccaggccacagctgatctgatggcaaaatctctgtctcccaactcagcacccatgctacatgggaaccaagggaggctcatttttgggaggctagcccaaaagatgacaccctcaaggctactagtgtaaaagcctagactcatgggggactatcccggaatgacccaaaagggagtagggatacaggaacataatttttcttttttttttttttttgagatggagttttg

SEQ ID NO: 114496 - DNA, 458 bp, Homo sapiens
agtgggcctgaaatgtaccatatgcaaacaccacaaaataaggatgtggagcctatggtgtgtcatgtgtagtcatttagctgcttttgtcaccagagttcatgaggaggtttccagaatttagtccaggtgaagtgagagggcagaagaattatgtaatatgatagaaatgtttatttgagtcagatttcggagagaacccctcctcaccctttgggacactattgccctcaggttctctctcaggcactcccgaggccgctgagcctcagcctccaggactttcctcttgcacgtactgtatgtggaaaactatctagagtagcagttgaatcttcagaaattttagaaagaaaaatgacagcatttattaaagttgatgtgattttttccccttattgggatgagtttggacgatgtgtgtcagcattgaatgagccttttatcaagtccagaac

SEQ ID NO: 114497 - DNA, 367 bp, Homo sapiens
aaaaagtagtgggggctggaaaagttctcgaagaaataatggctaaacgctctccaaatttggcaagagatataaacctacagattcaccaagtttactttcaagttttctaaattacatttgatggttgaagcaaaaattacaacactgtctgatgtggttctaaatgaatgtatgtttaatatgtatgtatattacaaatataaatgggagagaataatgggatataaaggaaggtaaggtttctgtacctcacgctggtaaagtgacaacacccataaaattgattgtgagaagttacatgtgcataatgtaataccaagggtagccactaaaaaagctatacaagaagacatactcaaaaaca

SEQ ID NO: 114498 - DNA, 425 bp, Homo sapiens
aactgcatatgtgaaggtgtggcctcatgaaaccacagcacactgttaggagctaccagcctgtcacaagtgggtgtgaaggttgcctagaggagactaccaggagataacactgaaggggtggattaggaaagcccttgtgcaccatcttgaactttaccttgaatgcaatggagagctgtgaaagggctttaagcaaggcccaggcctcactgaatctgtggtttagaaagaactctctggttacaagatgcagcatggatgcaagcgaggttagaaaaaagtgaacatctggacaaaatgaggactcttgactgtaaggaggaaggaaagaagtggccactgggtggagaaccaagtgtaacttcatccaagtgaagtgtgaaaacttctctgaaaaaagatcatataaaatctggattctc

SEQ ID NO: 114499 - DNA, 921 bp, Homo sapiens
actgaaactttcaatgtttagagaccagtgagagaaagaaccagcaacagagactcagaactatatcatattctgctgataagccaataagatgataatgataactaagaattgacattggctttagtgatgtagacataattggggaccttgacaagagcagtttactgggggtggttgagttgaaactttgattgtttcaagagagaatggaatgagtggaaagatagtttgtgagtgctagcaattattcagagaatttctgctataaatgggagcaggaggatgtatcaggagctaatgggagaaatgaggtcaacattatttcctgtgtagctttctcttatgcccaaattccactggatatcatccacttctggttacttctggtttgggatgtataggtgaaggaatagttttggatcctcctttattacctgttttatttgcataattggacaataactaaacttgctttaaatatctcttaaagcattttaaattcaaatttggagagaggaatatgagagtggtttttggtcattgtttagccatatacaatattgtcttaccttctgcatttgaagtttttgatacctgataaatgtttgtattgtgtagttgaacaagaatttgccacatgaaggtttacagttgtagttttatgttaagttctttacagtagtcccctctcatctttatcccccacttggaactatctacagtagttccaggacccccccctcccagtggatgattgaaaccatggatagtaccaaaccctatatacatattatgtttttcctatacatacatacctatgatgtttaatttctaaattaggcggagtaagagatgaacaacaactaataatgtaatagaacagttgtaacaatatactataataagagctacatgaat

SEQ ID NO: 114500 - DNA, 372 bp, Homo sapiens
gctgaggtgggaggatggcaggagttcaaggttacagtgagctacgattgcaccactgcactacagactgggtgacatagtaagaccctgtctcttttttttaagtctcattttagctaaaaattggggcaaagagcagcaacagggacaaagaggagcatcagagccaggaatgactggcaaaaaaataaggaaaaatgcaagaaatctagtgcccagccctgagaccacagatcctcaggatggggcgctggtggaccagaaaccccaccacgtgagaaggctgcactttaaattagaccgtcctggtgtctgccttggtcacaaaattagagtggagataagcaacacagacaccagccctggcctcag

SEQ ID NO: 114501 - DNA, 375 bp, Homo sapiens
atcactgcactgccattgccacaagggggcagccacgcacagggccaggctcgggatggaagtgtatctgccactaccagggagaactgaggagcctgcgtctcctcactggctagacaggaacaatagatatggacacctcatagagttgccttgagagcacaagtgagctgatgttctctcaggagtgagagttcccttctgcttgtctgaactaaactgacaacagctaacatgtattgagcagctgcgatgcattgggcatctcctctgagcactgtttgcatgaacattttggggctcagaacacaattccaaagcatggcgccggggccagcagagagctttgaactaacggaaattggaaggcctcag

SEQ ID NO: 114502 - DNA, 488 bp, Homo sapiens
tctagacgatccctactgatctgtgctcagaattggtagaaatgaatggctcttaagaccaccaggctcttccttgtcagaacctgtcccctaggtcctgccagtgctacgaggcaaggcgagttttccagcgatgcctgctctttggaaggaatattgagaacgggttaaacgggcctcaaccgagaggaaaagggaagccacgctagctttttcctatcagaacaaatgaagaatccctgaactggggaaggaaggaaaagctttgaaaactgtaactactcaggttatttggtgcagagaaattctaaatgcaaggtatgcatgcatttaatctgtaatgatctacagccatacatagcattttaagatgacaccaaattttagttgctgaataattccattgtttagaaatcgactgaacatttaaactcatggcatcatggaacactatgtagagcatgattggagactagcattgataaagt

SEQ ID NO: 114503 - DNA, 451 bp, Homo sapiens
gtttctgttaatttctttttttttttttcctatgactgggccatattttcttgtttctttgcatgcttagttttttgttattgtcattaaatactgtacattttgaatattatgatgggcaaaaaggaaaaaaataagaaaaaaagatatcttctccaggtctgtgcattttggttctgtatggggacactacttcagtgcttagccaggtctttcacaaccctgccttagtcctgtccttagcctagagattagccagaggttgaagttatgctcccctcagatctcttctaagcatgcattctgccctgagcattcaagtggctttctagttccctggtatacttgagcactttttccaagactttattccccaaagattctcattccctaccttttctttccttggctttcagcatatctgttgtttgtctcaactgtgcttttgccc

SEQ ID NO: 114504 - DNA, 323 bp, Homo sapiens
gcaaatggaatattttcttaactcaagaaggaaaagaccttgccaaaccattttttaatggtttctgccatttcttgactccctggctcaaacaagaatttttaaatttttgttttgttgtgttttattttgtgttcctttactgattattggatatttaggctcttgctactgaatagcaggttcactgtgcagtggttaccaacttcagagtccagtggacagaatactcatgcatgtaacatttgcatgaagaggctgagcacagtcactcacacgtgtaatctcagctgtgagaggaaggctttgggaggctgagaaga

SEQ ID NO: 114505 - DNA, 702 bp, Homo sapiens
gggtttgaacacgttggccaggctggtctcaaatacctgacctcaggtgatccgcccgcctctgcctcccaaagtgctgggattacaggcatgaaccaccacgcccggccagaagaaatctttattttggtgtgcgggctcggatgagggccaaatgtcatctatcttggatctgaatctggaaggatcaaggcactgaagggatttttttgtttcagagagtctccctctgttgccaggctggagtgcagtggcatgatctcggctcctgcaacttctgcctcccaggctcaagcgattctcctgcctcaacctcccgagtagctgggactacagccacgcgtcaccacgcccagctaatttttgtattttttagtagagacagggtttcaccatgttggccaggagtgtctcaatctcttgacctcatgatccatctgccttggcctcccaaagggctgggattacaggcgtgagccaccatgcccggcctcactgaagggattttttttaatgtcacgtggctctcacaggtgcagtgtgttcaggtgcaagtgaagattaggactgatgcttaaaaccaaacgtaaaattccaggtggtgttactatggggaagagcattaggacaatctgaatggtttcagttgcaagagtgtgcgtatacgtgcaagaactacagtcaagattcaacttctggctt

SEQ ID NO: 114506 - DNA, 466 bp, Homo sapiens
tctgtggcatgctgccagccccacccccccaggcttttggtctctgctggtcctttcatctccacaaagggccagagtctgttttcctaatttctgggtgagtgtttcatatgcatctttagagttcattcaacagatatttatcaagcacttactattaccaccactttaagcagattacgattactctaacacatactttccagtgcctctggaaagctccacaataaactgctatatggcagttcctaatgaagaagatctgctgtaaaacaaaggtttagaagcagcagataagttaggatggagaggaactggatttttgaaagataagagccttatcaggtaaaaacaggttggactgcgccttgtaagcaaaaaggaattctatgaaggcacagagacagaaaaaggctggtgtgtttagagaggtataaggagtctggtattggtaacgctgaaaatg

SEQ ID NO: 114507 - DNA, 472 bp, Homo sapiens
ctacaggtgctgctgtccaggcatgaggcctggacatagagctgggccctgctctatgtgacctgaggacagaagcccttgtgagtggcagagttgtggtggtgaccacgcagactgctgtgtttcccgtgcacttgcttttttccctcacttccaacctcccatccaccttgtctgccctctggagcctgtcgcctttcttccttgtccacacctcttctacccagcagcccagccttcctgcagagcagctgggcagtgcccacccccaccccacgcccatttccactcctggcactatttttcctggaactgtctgttccacactgtcctatgcctgggcctccccgagcgtcctgtgagatgccagttggcgagagtctttgctcggggtcctgaagcccccccctcgccccccttcttgatgttctccaccaggattctcctgtgccagatcccatctgcagggcac

SEQ ID NO: 114508 - DNA, 438 bp, Homo sapiens
gtgtgtgtgtctgtgtgtgggtgtgtatctgtgtgtgtgtgggcacgtgtatgtttgggtgtgtgggtgtgtgtgtgggtgtgtgtatctgtgtctgtgggcacgtgtgtgtgcacacatgtgcactcaggtttaggagagcgacagggggcacagaggaagaaaataacaggaaaaagtcaagaagaaagagccaccttaaagcatctcaggaattcatctctcgagtcaaatcatcaagaagtgcccagtccctcaaggctcatcttgatgtggaagaggagttgacctctggggagaggctctgcccacgcggcgcagtgggaatccagaggccagcgcgccagtccagcagctgtgaccttggaccttgggcaagtccctgacttctctgagcctctgtgtccagccctataaaatgaggggtgggattcctta

SEQ ID NO: 114509 - DNA, 283 bp, Homo sapiens
acgaggtttcaccatgttggccaggctggtctcaaactcctgacctcaagtgatcagcctgccttggcctcccaaagagctgggattacaggcatgagccaccgtacctggcctaatttctgtcttctgttagcttccgggttatgtattcattatcctttaatggctaccttagagatggttatatttatttatttatttttttgagatggggtctcactctgttatccaagctggagtgcagtggcataatcatggctcactgcagacttgacctcccagg

SEQ ID NO: 114510 - DNA, 204 bp, Homo sapiens
tacagggggttgatagtggtggtagggggataggaaatatgggtttaagaaaagctagtttctttctaaaggtactgtaagactgactcactaaataaataatgactcactaaataggcaaatgacacttagattcagctaataacagataagttagaatctctttagaaaatgcttcctcaccctaggcattgaatctgttta

SEQ ID NO: 114511 - DNA, 682 bp, Homo sapiens
tgacaccatttccattattgtgataaagtaagaaaaattgaaaatgctgtttttccaaattctttccttctttctttctttctttctttctttctttctttctttctttctttctttctttctttctttctttctctttctttctttctctctctttcttctttctctctctctttctttcttttctttctctctttcttttgctaagaaaggtgatttggaagttctcgtgcaccaaatgtagtctttgttaggattagccaaacatggctaaatgttttccatgatcaagcactcacataggaggtcactggttatattagcaaggtgtataagttatctctggcagggaagttttgttttttaaaactgctacaatcatgtttgctagcaaaatgaccaaattcaccctcaaaagtgggtgagaaacatactcaacatattgagagagaatatacacaacttaaggagagctaggggtctgaattagcggtgagtacatacaatactaagcaaatgaattaaataagacaattattaattccaggaatgcaagttatccagtggaggaaatgtaactagagaatactacatgtcacagttctgaatagagcttacataatcatagcaataaaaacggtaatcattgagaaataaaaatatatattcaccagtacataca

SEQ ID NO: 114512 - DNA, 495 bp, Homo sapiens
ccccattcccacccagagggcagtgccccattcccatgccagagggcagtgccccattcccacccagagccgcggggggtccagagccagggagagggttctcaagttgagtcaagatgcccaagcgcaaaccaggcctggccattgcaaaccagcacctgtctcgtttccttccagctgtcaactgctcccttgcctgggcctccatgccctgcctgctcctctctgccaggacttggccagggtacagtgcgtgtgggggtatacctgggcctgagtggcagttagggggccccgcagtgaggaacagcaagcatgggtttggtcccggtgtcccctcccccttgcccagcactctcttgaggctgatgatttggggagacgccagtctgaccacagcgactcaggtgcctgctccctgcctgctccctgtcctcctcaatgcgttgcttggaattcgactcaagaaaacccctggggttgagtattctgttc

SEQ ID NO: 114513 - DNA, 333 bp, Homo sapiens
ctttgtctctggcccttctccactctggaatgctgcattccagtgcaagagtcaagctcagagcttgaccagtctttccagtctgtcaaagtggtggatggcagatcaatacaacacaatgtctcctgggccatctcaagctcactggtaacccatttgcttggcactgtcttccccatccctccatcacctcctgcaaattttgtgctttcataatggctgctcctcagctacagcatccatatagtgctcctttgcctggcttacttctacttagcctacacaatgcagcttggatgtcatcgacttcaggaggacttctgtgacagtatg

SEQ ID NO: 114514 - DNA, 287 bp, Homo sapiens
tttatggccaaataatactatactgtatggacatacagcacattttgtttatccatttgtcaagtgatggacatttgagctgtttctgctttttggctattagaaataatgctgccataaacatttgtgtacaagtttttgtgtggacataaatatttccatttgtcttagagagtagaattgctggatcatacagtaacggtttcatcaaattattctaaagtggctgcaaaaatcttctgcctggggcgctaaataaagaatgttgaggtttcatcataatgttt

SEQ ID NO: 114515 - DNA, 690 bp, Homo sapiens
caggtcacaagggcaccggcctcggggtctctccaggcccagcagagctcttcaggggtcctgacactggaagaagagaccacttgagccatgtctttttcacggccaactcctgcctctaaggatgtctgagctcccctctggccagtactgcccacctctaccttgtccaggcccccttccccgccctgtcgacggaccgccaggcagggcactctgccttctacctcccggggtctcccatgcgctcctcaagccaggtgtgcacgtggccctggccctggcctgcaggacagctggggggcacccagcccccagaagacccctgtcctacatccctttctggaagtgagtgtccctacagtggattgcaacacatgtcgtccacttcgaccctagctggagtgcctcaccagggggccccactaggaacaaagccaggacaggccccgcgtcaggcacacactaacaaaaccagaagcatggggcagggcagggcggagtgagggcatcacaggggaccaagaagggctgtccttgggggaggcccaggaccacctgtcggggagggggaccgcagtcatttctcattcctcagtgtccaccttgcgacggggatagccacgagtcagcagcttcccggaaagagcaacgtattttaaaaaggaaagtaaagcccacagagggaaa

SEQ ID NO: 114516 - DNA, 148 bp, Homo sapiens
gctcaatcttcaaaggaatgactctcagagttgtgtcccctgccttttcttcaccatggaacttttcccagctccactctggtgggcttggggacaggacctgccctctgcaaagtgatgaccaaggataagtcggattttcaaggag

SEQ ID NO: 114517 - DNA, 457 bp, Homo sapiens
cacgagccactgtacctggcctcagcctgcttttcttgtatagactctaaatccttcctgctacaagttatacccaacaggcggggccaactggaatggggtgactaatacatccacacctggcttcaacaaaaatctcccatgtcacggtcttgagtttgctattgccagcctgctctggccagggaaatctatgatagttgtattcatcatcatcatcatcatcatcaacatgccttggctgttattgtataggcccttgccctgtggctctcaagagtcctggataatgtacaaaggacatagcttagtctggcttgcagaattgtagtattctattgactcctcagtacctccactgcatcatgggcacaaacaatgctctctaccagggcctggcaacagagtccgatctggcccacagcttgttattgtaaataaagttttattggaacac

SEQ ID NO: 114518 - DNA, 306 bp, Homo sapiens
cacgagccactgtacctggcctcagcctgcttttcttgtatagactctaaatccttcctgctacaagttatacccaacaggcggggccaactggaatggggtgactaatacatccacacctggcttcaacaaaaatctcccatgtcacggtcttgagtttgctattgccagcctgctctggccagggaaatctatgatagttgtattcatcatcatcatcatcatcatcaacatcatctccaaggttctttttctaccagcccagcaggtcctgcacatgccaagcccaacccacaggccatggat

SEQ ID NO: 114519 - DNA, 240 bp, Homo sapiens
cagtgagtgcccatcttctcagtacatcagctgcagggctctgatgggaggctagagtggcaaggcaaggacacaggcaccatccaaggcagctgctgagggcactggctcactcaccaagtcagccagttccggctctttcctttcctttttaaatttcttttcctttcttgcctatctataccatatatctcccaagagcagctagggctcaatcttttgataccactgactctgctt

SEQ ID NO: 114520 - DNA, 139 bp, Homo sapiens
gagctggggctaaatgcagtattggtttttgccttattgttttttaaataacattgttgcatgtgcccaattatagataaatagaatcagaatttttgcagatgaggtccctctcagtatttttaataagatgtttagg

SEQ ID NO: 114521 - DNA, 322 bp, Homo sapiens
gaaataaggaggttttaagaccagaactgtgatttggattctagctccagctcgccctcctactcattagctgtacgaccttggtcaagttacttaaactttctaaacctcaatttttttcactaaaaaagagattaccggctaggcatggtggctcacgcctgtaatcccaacattttgggaggctgaggtgggaggatcgcttaaacccagtagtttgagaccagcctgggcagcatagtgagacctcatctctacaaaaaataaaattagccagacaagtggcacatgcctgtagtcccagctactcgagaggctgtgc

SEQ ID NO: 114522 - DNA, 320 bp, Homo sapiens
ctgtggtcagtgaacagaaaaggcagcctctgatgaggcttgggggctggggagggaagattccaaacagcaaaggagtttgagcctctgtagggcctggcggtcctagtgggggaacggcctttcctggggccccccgcacagccaggagcagctgtcgtcaaggtggactgtgtcccagcccctccagctcagccttttcatctgttcaagctggtgctcgggagtgcacaggatgcctttcagaagaattctaaatcccgggggcctgtgatgccacagtcacatgtctgagcccaaaacaagagaaccacttgtgt

SEQ ID NO: 114523 - DNA, 344 bp, Homo sapiens
agagagagctggccaaacagtgggaagacattgtctttaagcgttaagagtactttcagggttagccctttcattatttccttgtgaggcaagtttgtagaagcagctgtctaaaggagggaaagtggcttggtgatgttaaagatgtttttggccgggcatggtggctcacgcctgtaatcccagtactttgggaggtcgaggagggtggattatgaggtcaggagatcgagaccatcctggctaacacggtgaaactctgtctctactaaaaatgcaaaaattagccgggcgtggtggtgggtacctctggtcccagctactcgggaggctgaggcaggagg

SEQ ID NO: 114524 - DNA, 195 bp, Homo sapiens
tgctctgcccctctctgctagaaccctaacttgccacgcactccacaggtgccatgcacttcctgcttggtgcctctgctagggtcctctctctgaaacaatctttccttcttctccaccagccaactcctcttgacccttctagacccctcttctaggccctgcttctctaccctcagtgcccccagagagggg

SEQ ID NO: 114525 - DNA, 401 bp, Homo sapiens
gctgcaggaacacagagagggcaggctgcaggaacacagagagggcaggctgcaggaacacagagagggcaggctgcaggaacacagagggggcaggctgcaggaacagagagggcaggctgcaggaatgcacagagggcaggctgcaggaacacagagagggcaggctgcaggaacgcacagagggcaggctgcaggaacgcacggagggtaggctgcaggaatgcacggagggcaggctgcagcacctacggaataggcatggggaagaaattcccaagagggaggctgacaaaccagtcatggcctccactggaggcttcgcttccctgagctggtggaggggactgccctttgctgggagagtagggggtgaggaggacccttcgacatgccttttc

SEQ ID NO: 114526 - DNA, 297 bp, Homo sapiens
aaggaaaatccacttatttgaatatccacacacaatccagatttggccccaccattgccaaccacttctaggttttaaaaatctcatgctctttccactaaagggctctgctctctctactcacaagactgttgggaatgattaaagtgactttgtagggagtgcctagcccatggtctgcataaccaatcttagctctgcttcccttgacttcagggaatgggacacatccttcatctatgcaagtttctctatcattttatttgcctacaaggtcctagtaaatgcaccagggta

SEQ ID NO: 114527 - DNA, 440 bp, Homo sapiens
gcaaaacataagaaataaggcaggggaggcaggtgcagccttgacaacataagaatatccaaacaatgttgtcaatatcaaaagaaaaaatcaaaacatcttttataatataaaataaatccatataattaagtactaattaggtgaaataacattatagggtatataacgtttattttctctatttaaatttgcatatcttaaatttatttgtttttattttattttttcctgagatggagtctcactctgtcacccaggctagagtgtagtggcacaatctcagctcactgcaacctctgcctcctgggttcaagaaattctcctgcctcagcctcctgaatagctgggattacaggcgtgcactaccatgcccagctaatttttacatttttagtagagatggggtttcatcatgttggccaggctggtctccaact

SEQ ID NO: 114528 - DNA, 190 bp, Homo sapiens
aaagtcctctcagcgtcattttttgtcctgtccagatggatattcttgatgagcattttttacatcattccctcaggcagtttgataaattgttgcttttatgcctgctatggccccgttctgaaaaatgaagttaaaatgatatttataattattcccataattggagcaaggccagagctctgtgtat

SEQ ID NO: 114529 - DNA, 768 bp, Homo sapiens
caaacccactccagcctgggcgacagagcgagactccgtctcaaaaaaaaagctgctaccctatatacagaagaagccctctggggaaaaaaataaaacactgcagggaaaacttataattgtgctttttaagttttacaatatgatttttaacagtatgattcttgttaggagtatcatcctgacagtttttaatacagatatttctgtagtttgttttaccaggacaaacctagtacttaatggaagaatgcatgtgagagtctatttaggtcactcttgaagacagaatttgtaccctttgtctacctccaggtaggaaagtccatttaaaactcaattttcttaatagtaatattctgatttacgtaagaaaagttataaagcttttagtgttaaagcattaaaaaaatcaagtcctgatacattccacaaaattgtaagtcagtggagtgtttacagatcatttcactctggtgactaactcttcacttcctatcagtaatgtaaaatatgaaaaagttcaactgatttggtttaatcatagtatatggttcctatacccaaaacaaacaaagaaacagactaaatactataagagtgtattatagctcagctaaatcatggtttgaactaaagtagatattatgctaagaatgacaaccagacaaggcataaaggttggtttatttttccaattctacttacaagaaaatagttatgcagttcacaattagaaaataaagctacaaatattttagaagagaa

SEQ ID NO: 114530 - DNA, 758 bp, Homo sapiens
acagactttacttcgtgtttcattcttcagcagtcagagttctttgccttccaaaactatcctcctctgaaaggttaaaattatattaaaattgtgctgggcattataacttgtattctagtgttaaatgcttactacttgagcatattcagagttagtaggaagagactgcctggtgatacacatcaagtttatgtttggggttgataactgtaccctatcttaatgaaaaagaggaaattaggagttaccattgtttggataacgtggtgcttcccagaatgcttatagtggttcattcttcccatgaatacacgcaatcctctgaaatcctgatgtgaccttggcatgatttaccaatagcctcttttacatttattttccaagatccagatgctgttctctagtgtgtttgctgagtgtgcaataatatggatcatttattttgaagcagtacttcattacaacactttcttcacagggctttccaaaggaagaaagggctaattatagaaaagaatcttgtctaccatttgtgagggaatatttttgtctgtagatggttggattattttcacattagggaggttcaaataagaagaaagtgctgacgttttctctcctctccaagtatgtggtggtggtcctgcactgtttttccaagcttagcttctacagaacataaatacatgtaccagtgtcaattcttgtagatatgcatatcagtgtaatatgcatttgtattctttagtagatga

SEQ ID NO: 114531 - DNA, 167 bp, Homo sapiens
tggctaccttcaggccatatcacaccagattctatttagatctgtctccctgccatgaacccctcaagggcacagactgtgtttccagcttcagatttcctattgcctattaaagtgtctgtcacttcatacatatctggtgaataaatgaatgaatgaatgagtga

SEQ ID NO: 114532 - DNA, 231 bp, Homo sapiens
ccacctgtctgcattctgatattttacctgataggacaaatttgccttaggtaaacctttataaacaggcatgatcttttagaaactactcaaacgttttaaaaggaagagcaagagcaagtgtcagttatgacacttgaagagtcataactggttacctttgttacagtttaaaaaaggtagcactttctgtgtttcacagggtgaatgccttcatccattggaacctga

SEQ ID NO: 114533 - DNA, 214 bp, Homo sapiens
ctggcaatccacgcatgggggtgcagaaacagcatgctagcgggcaacgcgcagaggggaggggaaatgacacggatgccaggtggtcagggcgcagggcctgaggcagggagacccgctgctgctgagacaggcaggctggggacagaacctacatgctgcccaatgctgctgactttatcctgtgccatgcgtggatacatggtccgactta

SEQ ID NO: 114534 - DNA, 365 bp, Homo sapiens
atccactctcactgtggctctatttccaccgtttccctggatttccattcacagagctccctgacataggacactagaagggcaaacgcagtgtcacctgccactattactcaattacttgatgaccacggtgataatctggcactaaactggctgtggccaaaggctagagagccagaacctacttccagcaagctcctccttgccctgtgtccccacttgaagagactgctagtgaccacaccttggacttcaatccacaagccaatccattctttccaggagacaaggacgcgactgacagtactctcaactggagagaagcgcggtcttccaccctccctggaggacacggtgctacccta

SEQ ID NO: 114535 - DNA, 437 bp, Homo sapiens
aagtcattctccatctggataatcagcttgttctgtcattaaatgtctaaaatccagctgcttctcaccactactactgcaactgttacactcctttaaaccaccatgatcactgcttagtgtaatagattgaaaaacatgactataataatttgcaccatctgggtgcagtggctcacgcctgtaatcccagcattttgggaggccgaggtgggcagatcacctgaggtcaggagttcgagaccagcttcatcaacgtggcaaaaccccatctctactaaaaatacaaaaattagcacacacctgtaatcccaggtactcaggaggctgaggcaggagaatcgcttgaaccctggaggcagaggttgcagtgagctgagatcatgtcactgctctccagcctgggccacagagtgagactctgtctccaaaaaaaa

SEQ ID NO: 114536 - DNA, 1775 bp, Homo sapiens
tgcttcctgaactagctcacagtagcccgggggcccagggcaatccgaccacatttcactctcaccgctgtaggaatccagatgcaggccaagtacagcagcacgagggacatgctggatgatgatggggacaccaccatgagcctgcattctcaagcctctgccacaactcggcatccagagccccggcgcacagagcacagggctccctcttcaacgtggcgaccagtggccctgaccctgctgactttgtgcttggtgctgctgatagggctggcagcctgggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatccttaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtga

SEQ ID NO: 114537 - DNA, 1838 bp, Homo sapiens
tgcttcctgaactagctcacagtagcccgggggcccagggcaatccgaccacatttcactctcaccgctgtaggaatccagatgcaggccaagtacagcagcacgagggacatgctggatgatgatggggacaccaccatgagcctgcattctcaagcctctgccacaactcggcatccagagccccggcgcacagagcacagggctccctcttcaacgtggcgaccagtggccctgaccctgctgactttgtgcttggtgctgctgatagggctggcagcctgggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatccttaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtgaagtgtgtgtgattttacaatggacttatggttggtgggaaaattcagcatggaaatgcttttc

SEQ ID NO: 114538 - DNA, 1609 bp, Homo sapiens
caaccatgtcaggcgtgcttccacctcaagagcacagggctccctcttcaacgtggcgaccagtggccctgaccctgctgactttgtgcttggtgctgctgatagggctggcagcctgggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatccttaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtga

SEQ ID NO: 114539 - DNA, 709 bp, Homo sapiens
atcacacactggggccttttgcggggtggagggcaaggggagggagagcattaggacaaatacctaatgcatgcagggcttaaaactgagatgatgggacgaaaggtacagtagatcaccatggcacatgtatacctatgtaacctgcacgttctgcacgtgtatgctagaacttaaagtaaaatttaaaaaaacaataattctcattaaaaacacatcttatttttgggggtatactttgtgtacagaattatatatgttagaattgttaaggttacttttagtaacctcaatttctagtaaaaacctaggaagcaagaaattttgtcacatgtcagttttttatagatatgagcaattttgtaattttataaatatgtttataacctaacttttatgtgtagtgatagtcccaaatatagtcttttcttagactttaagaagccaagaacaaacttatgtttagtaatttatatttcagtattttttcttatttggaagtgattcagacatttaatgagtattatttaattcaactatttgtaaatgtttatgccacctacattcatctaatttatttatttttaacaagtataagtagatttcttacgaaaactgaggcattaggcaaggctagtcattagttcaagctatttccatgttaatcatttttatagcctatgaatatcaggtgttcacctaagtgaga

SEQ ID NO: 114540 - DNA, 356 bp, Homo sapiens
cttgcatcttcccttcagactctctgaatgtctcctccctgctccatggctttgcagcttcctgtctctaaggggtagaatgactcatcaaccctaaaggacagtcagtcttccaagagccatgaactgaatgctttatatcctaatttagatttagagtttccagaaggtgagcatgcagttttgttttgtttttttttctgtctcccaaatctgtgttttttccagatatggctggaagcagaagcttcatgtaacatccatgaatgtcctcctggtagtttgcataatggatgcacatgtgccgcatccataacattaaggggagaataatgcatggtttacagcctttgcca

SEQ ID NO: 114541 - DNA, 754 bp, Homo sapiens
tcagcatatttattcattaggaaaatgcaaatctagccttcaacacggtattatttaacactcacaattatggctataatttttttaaaacagaaaataaaatatgttggtaaggatgtggacatattagaactgtcatatattgctgatgggaatgtaaagtagtgcagcttctgtggacaacagttttgctgtccctcaaatagttccaaacatagtatttagtagtgttactatatgactcagaatgtccaatcctaagtattcacccaggataattggaagcatgttcccatgaaaacttggaccccaatactcatagcaccattgttaataatagccagaagatggaaacaacacaatgtccgtaaactgatgaataggtaaataatatatggtttatctatgcaatggaattttattcaaccataaaaagaaataaagtcccaatacatgctacataatggataaaccttgaaaatattatgctaagtgaaagaaaccagacacaaagggccacatactatgtgattctgtttatatgaaatgcccacaataggcaaatttagagacagaaagcagattagtggctgcaaagggttaggcatagaaaagaatgcagagtgactggtaatgggtaagtagtttctttcgggggttatgaatataactggacttagtggtgatgcttgcacatctctgtgaatatctgaaattctgctgaaatgtaccctttaaaatggtgaattctata

SEQ ID NO: 114542 - DNA, 509 bp, Homo sapiens
gaccagttaaaataaataggctgaggaaaatcttgatagtaggagagattttggagcattcattaaaagtaaaaatagggctgggcgtggtggctcactctcccctgtattcctagcactttgggaggccgaggcaggcagattgcttgaggccaggagtttgagaccagcctgggtcttaaaaggtagatattattctcattttacagatgacgaaactggagcttgtttgaaaagtttgcccaaaattgtagcagttagcgtgaggggcctgcctctagagaccatgcaaattcaacactaagctatactggactggtctcacatagtgagaccctgtctctacaaaaaatagaaaaagtagccgggcatagtggcccacacctgtagttccagctacttgggaagctgaggcatgaggattacttgagccaaggagatcaaggatgcagtaagccatgaccatgccactgcactcgtgcctggacaacagtgcaagaccctgtctc

SEQ ID NO: 114543 - DNA, 583 bp, Homo sapiens
aaatttacatgcattgaaatgcacagacattcagtgtactcctgttcccagaccccagttaagagagagaacgtttctatcaccaggtttcctcttgccccattcagtcattcgccaccctcactggcaaaaactttctgctttctatcattgcagtcttgttcttgagcttcctctaaatggaatcatgcagtatatactcttttgcgtctggtgcatctttcctaggaaagacgccccataccagtgtttctaagtaatgcttttagcttaatattctccacattgggaaagtcacaaacaagacaaggaggacttcttcctccacacctcctcgtcccacacccagctaaaaggctggtggactatccactcactacatgagtctccttggaggccttggccacagcatccccacgttctgagaagtacctgccagaagcaagggaataccacaggaatgagtgttcagggagatgtactccctcagaccctttccaaagtctcccatcatcctgatagggctgcccagctctgggggtcccaaagaaatgctcctactgcccccaatgctggtcctcca

SEQ ID NO: 114544 - DNA, 1051 bp, Homo sapiens
gacacttgtctctcagccttctgatgccatctgcaaacctcacaggtccccttctgcagcctttcctggaggtttgcttaagaaggtcgagagagggaattagccagagacaacacgtttctcttcgcagtggttggaagtcagtagaagctggatggggaagggctggaatgggaacccgacttcaggtacgtgcgttcctcattcatgctgagccctgggctctggacggcaccacacaggcctgcatgctggcgaggctggtgcagagaggtgagtcatccattcttcatggcacagctgtcgccttcctgaaactcacattagacacgcgctcatagaatcaaatgtaccacatgcagccattacagacgggcacaccaaccccagactgctgttgccaggtatgtgcgtggttcctctcactcgctggtcctgcagagcctggggatgtctgcaaggatgaaatgaggtacagataaggttcactgaggccacttttctctatttttgtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagtagtctgtcaaattgtatcataaagtttatttttcttttatacgtaaatcattaaaaataatcacatattttttc

SEQ ID NO: 114545 - DNA, 932 bp, Homo sapiens
agcaatattttgttttaactagttttccttgtagagatctttcacctccttggttagatgtatttctaggtattttattacttttgtgactattataaatgcaattgcattctcgatttgactctcagcttgaatgttatggtgtatagaaatgtttagtcataaaaagaataaagtactgatatatgctgaaaaaaaagagtgatcactagttatggtgcttcaggaacattcgataaattaacttctcatgactacgttgcagtcaagaagcaaaatatttctattttgccttgaaattatagtgtgtgttatacttttcagcttactgcaataaatagcctccaagcaaatggcacttgggttcttttgatttcagtttttttgtagcaaaactaagttttcatttattttatctcctatgacctctttacccaaagtaggctgatcttggattctctggtctatttatgccgctgccgttccgtctttacatctcccgttggagcatggctgttgcattgacatgatgtttttggtgtgggtgttcagtagtgatgaagagtagccacatgccatgattggaatcaatagacattgcctgggatctttactgtacctcattgtcaattagacagtagcaggaaatctttgatatcaggggcagccccctcaatcatgtttcatggcattcaggcagcagtgccatgtgtcacatatatttgatgcttgtgtgattgggcagaactcattagtatgtggttgtgcacagactctgggccctccaccctctgaagaaagaaagtacagcactcaatggatgaattcttcagagaaaagctatcaaattggaatataaactaactcctttgaagcgccactggaggggaacttgatgtactgggaatatgaaggatgggcatggaaaatat

SEQ ID NO: 114546 - DNA, 363 bp, Homo sapiens
cagtttttactcatttcttaattatagaagtaatacctgtttgctatttttatttttatgttttctatgtgtttttgtttttgtttttaagactgagtctcattctgttgaccaggctggagtgcagtggcgcgatctcagctcactgcaacctccaccttccgggttcaagtgattctcatgcctcagcctccccgagtagctgggattacaggtgcccaccaccatggctggctaatttttgtatttttagtagaaaacatttcaccatattggccaggctggtcttgaactcctgacctcaagtgatctgccctcctctgcctcccaaggtgttgggattacaggtgtgagccactgcac

SEQ ID NO: 114547 - DNA, 307 bp, Homo sapiens
gccggaatacccggatacgagccagtgctggtgattatagacatgagccactgtgccctgtccaggggtggatttaccaggctttgtaggagcctagtaaatctttaactgaaaccactggtcctcagctcataggtttaagttcatttccccaagaatttagcctaactttccactcgctgatgctttaaagcaaaaacctgtggttctgtttactcttcagaagaaaaacctccactcatagctgctaataacagcaaatgctcctgaagcatgcatgctatgccagccacgtttctcagcactg

SEQ ID NO: 114548 - DNA, 549 bp, Homo sapiens
cacgccactgcactccagcttggtgacagagcaagactctgtctcaaaaaaataaaaaataaaaggaaaaaaaaaactattccagaccaactgaattaaaaactctaagagcacaaataaacacatgagaagatgcttggcatctctagtcatcagcaaatcaacaaatcaaaaccacattgagatactacttcataggcactaaggtagccagaatcaaaaagtcagatgataacaagtatcagcaaggatgtggagaaatcagaatcctcatgcactgctagtgggattgtaaaatggtatagctgctttggaaaacagtctggcagttcttcaaacagagtgaatatatgatccagcatttccattcctaggtagctacccaagagaaaggaaaacatgtgtccatacagaaactggaacacacatgttcatagcagcactattcataacagcccaaaggtagaaacaacccaaatgtccatcaactgataacagataaattatggcatatccataaaatgaaatactattcagccataaaaaaga

SEQ ID NO: 114549 - DNA, 745 bp, Homo sapiens
cagggaattattttgaagatccaatcaattcaatcatattcataaaaggcaaaaaaattttggagtatgaagtcctttattatatatttagtatcatcattacttgttcaaaattaaatctatacaacacatctgccagtgaaataattatgacactgactgctacagtacaggttctgttgagttcttcagagttgaaagaccatgtgctatttggtgacaatttcccccctactatgccttatgtaaatggctgtaaaagctttatttgtacagcttgccatgatgtaatttgtcctttacttggggccaatgcaaatgcaaactccaggacttcagtaaagcagtgggacatgggtataaattggtcatacaaacaatctttggtatgctcatatatatgggtgtaagattatcaaaataaatgtagaaaattcaaaattctcttaaaactaagaagtcaatctccagaaatcgtaagagtgataattctttcttttatatacactccttggcactttttcatgttctagttcaattaagagaaaaacaaaaaagttgtaaaatgctaagtcattcaggatttctccagattccaatattatttatggctcaaggtagatccaaataaaaatgagagtgttactgttttacacaggaaatatcaacttaggtcatttcccaacagttacacaatccaaagtaaattgaatggatcttaaatatttaaaaaatatattcattt

SEQ ID NO: 114550 - DNA, 557 bp, Homo sapiens
ctttcaacagttgtggttggtgcataaaaattcaccaagaaatacccacctctgctgtgctgttgacgaagatcttataaggaagtgctcatttgcccaggttttgcaagtccctcactattgctcctctgttcatcagggcttgtatcatacttttcaaagcagcagtagtctctggctgcggcatggctgtcaagattaaagccagcttatagccaggcattcccaagggcttggtgggcggctcagaactgggatggttcccgggaagcaaaggagcaggatggcagggacctggaagtggctgggctgaatggctgccggatggcaaaagctacaaaaaatttttaaaaattagccaggcatggtggtccctcctgtagtcccagctactcaggaagctgaagtgggagaatcactcactggagcccaaaaggtcaaggctgcagtaagccatgatctcacagttacactccagtctgggtgacagcaagacattgtctcaaaaaaaaaaaggaaaaagatcagtagttctgtgccccagcacaaccccacaa

SEQ ID NO: 114551 - DNA, 580 bp, Homo sapiens
cctttttttccccccaaagaagctatgtgctctacttaagctgagctgagagtccaaagagagtcctgctaatggtttgccaggtttctgcagaggtttccatttccatctgccaagtgtgcagcactgccttgcaaattcaggtgggagggtggggatgaggagcctttctcagacattagctccctaggtccaaaacatttctggcaggttaagatggaatagctgcctctctccctgaactccacaggccatcatattactgagttctatattttctgcacaacaatcaacaccacttgaacttacctggttgactaatttacttctgtgcatcttgtctcccctcaccctcatccccatgagagctccaagaggggagacaaggtagagccgagctcggctctaccttgtctctctcactggattggattgaatcacttgcaggccagagaatgtgatgctgtgattggccaagttgagtcatatgctctatgtctggagcttatgggggtggtggcagcttctggacagacagtggcggaggtgggagcatggactgtcttcctggcagtaaggt

SEQ ID NO: 114552 - DNA, 375 bp, Homo sapiens
ggtttccgcgatcggggagcgacctctgcctcccgtggcgcgcggggcccccggccgcccagctccctgctcccggggctgcctgctggaggagcctgcggtggcttcaggaagggcggcctcatatcttggggtcacacttggaacagggttggggaattccgatggaatcgttcaagaatgggggtaaacggaccgtggaaaggggcagaggtgggcggatgtggagcgagagacaagtgggaaggaaacggactcagtgatctaccttggggagcaacgcccagaagggatggcttgcggagttcagcctttaaggcaatcaaagccaccattcttttacacagtaggaaactctgtgttggctcttagtat

SEQ ID NO: 114553 - DNA, 352 bp, Homo sapiens
tagagatgagataaaagaaatagctacataattgtgaggagttgtgttgcccatctcaaatttacaaattttcagtctacttatgaatgaatgcacaatgaaaagatatttgtaagtcagatgatacaaatttaaaagttattgaatatttgtagtaagaaaatctatcaggctgggcgcagtggctcacgcctgtaatcccagcactttgggagactgaggcaggagaattgcttgacttcatcttagattataaggttcttgaagatctattgtctgtttttttctttttttttttttttaaatgtttactatggaacactgtttccaatagcctttcaggatttgaacc

SEQ ID NO: 114554 - DNA, 341 bp, Homo sapiens
ctgtctctatgcgttatgactattctgcgcatttcatataaatgcagtcatattacatttggcttttatgttcattttccatagtgtttctatatagcatgtatcggtgcttcattctttttaatgggtagataatattccattgtatgaatatatcacttttgtttcttccattcaactgatggatgtttgggttgcttccactttggggctattgtgaatgctgctataaatagtcatgaacaagtttttgtgtagacatgtattttcaattctcttgggtgtatacctagtagtaaaattgctgggtcacatgtaaactctatgtttaactttttggg

SEQ ID NO: 114555 - DNA, 286 bp, Homo sapiens
gtgagctgatctcaaaaaaaaaaagtattttagaatcttttggcaaaggaaattatttctgacaagttttgcacttaagacattcaggtgtgaggaaaacatgaaaaccactatgctagggaaagcaaatgctgttgagaatgtctcacaaacacaaactgcacgtcagcaggtaggtttgaccctcaggttgggcacattttactttaagtgtactgttggtggaacttaagatgaatctaggacattcacgatttatgtatgtgtgtgtgtgtgtgtgtgtatg

SEQ ID NO: 114556 - DNA, 352 bp, Homo sapiens
ttcaacacgagatttgggcagggacaaatatgaaaactatatcaaagacagaatagaggagaagaactggagacagtgaatttagacagtgctttctaggaatcttaatgtaaatgggaacaaataaatggggtagtaaggtggtagatggcagatgaagaaggtcaagagttgttatatggaaactactaagcttagtgttttccttttcataatatttattgtactcctactgtgtacgtaatactcccagctcctcaggaggctgaggcaggaggatcacttgagcccaggggtttgaggccagcctgatcaacgtagccagaacccatctcaaaattaaaaaaaaaaa

SEQ ID NO: 114557 - DNA, 447 bp, Homo sapiens
gtattttaaatgtttctatcaataattgcaattaattgaacaacttctagttctgattattatggaaaagcttttactgtaattacaacactgtggggaaagacaaggtttatctcaagagcttctgcttatgtaggcatgattttgaaagtggagcagattccaggggtggctcacgcctgtaatcccagcactttgggaggctgaggcaggtggatcatgaggtcagaagttcaagaccatcctggctaacacggtgaaaccctgtctctactaaaaatacaaaaaattagccgggcgtggtggccggcgcctgtagtcccagctacgtgggaggctgaggccggagaatgatgtgatcccaggaggcggagcttgcagtgagcctagatcatgccactgcactccagcctgggtgacagagcagtctccgtctcaaaaaaaaaa

SEQ ID NO: 114558 - DNA, 639 bp, Homo sapiens
ctatccattgtgtagatcatttagttttgttagccttgtttgcacttatttgaattcaggtagtagagaaataagaactgcataggcacagtgtgtgattatacactgtgcttctatacaaataaaatattttcagtttcaaatgtcttccacacaatgcaaaaatgactactagctatggaattgttagtttaattcagtacttagccactccttttagatcatgttaaagtctttcctggaagatacggaaagaagatacggccaattccgcccaaactctggagcatgcaactccaagtcatgacagcaaatgagatcttaccataggacaatgttgatttttttctaaaacatgtaattcccatatagtttttaaaaatctgcttccatctaatcgactattggagatctacaagaaaagtagtgagcaatcaatggattgttttctctgtaatggtgagaactgaaactaacacatacaccgtcccaagttgggttttccggaaagcggacctaaagacaaagatcagcgtgtaggaggcttatttgagtgctcttggaatcaatacctgtggtttcaagggaataaagtaacattggacagacagaaaagttgaaccctgataacagtcccaa

SEQ ID NO: 114559 - DNA, 403 bp, Homo sapiens
ggtcctgctctgctctccatttcaccttgtgtgcaatcagccttagggaagggtacaacgtgtcttttctgggtttgggtccaaggaagcccctaagtcctgtatctctaacaaggcctagcattgtgcacggagcacaagttaaattgtttctcagaaattataacagtccgtcaggcgcggtggctcatgcttagtaatcccagcacttttggaggctgaggcaggtggatcacctgagattaggagttcgagaccagcctggccaaaatggcaaaacctcgtctctactaaaaatacaaaaatgagcttggtatgatggcacatgcctgtaatctcagctactcaggaggctgaggcaggagaatcacttgaacccaggaggcggaggttgcagtgagcc

SEQ ID NO: 114560 - DNA, 1335 bp, Homo sapiens
gtttttttttttttttttttaccacaatagaaaagattctggccgggtgcgatggctcacgcctgtaatcccagcactttgggagactgaggcaggcagacgacgaggtcaggagttggaaaccagcctgaccaacatggtgaaactccatctctactaaaaatacaaacaacaacaaaaaaaatagccaggtatggtggcacgcgcctgtaattccagctacttgggaggctgaggcaggagaattgcttgaacccaggaggcggaggttgcagtgagccgagatcacgccattgcactccagactaggaaataagagcgaaactctgccccccaccaaaaaaattttatctttctgcccgtggataccaccaaagaagcatcatgaaagcctcttttctccctgccttcatgtctaagtcagagtctcctaaagagcctgaacagctgaggaagctcctctttggagggttgagctttgaaacaaccgatgagagcctgaggagccattctgagcaatgaggaacgctcctggactgtgaggtaatgagagatccaaacaccaagcacgccaggggctttgggtttgtcatctatgccactgtggaggaggtggacgcagccacgaatgcaaggccacacaaggtggatggaagagttgtggaaccaaagagagctgtctcaagagaagattctcaaagaccagagaacttctccacatctgcttctaccatgaattaaccaacacaaatcatatgttccattggtcgtaatggctggtcacaaaaatcataacagttttacatgaggtacacttgcagatgtgtttccatcaacctctgtattgaaggcccagttatctctacttaccttgttgctcgtgtaaacacctcttaagtaccactccaaatctttggacaccgttggacgcttactccaccctgctgccactgcagaaaccagctgtctgtggacactgccagctccatgtggcatcccaaatggcacccacctcacaggacccctggcccctatgcttgagaaacccacaataagtcagagaaaaaatgtgctgagatccaggcccctccagaaacagtcccagaagcccaaacaatcagttgtcagatgcccaatggtgaccagctcctcagcccaaaactctagcactccctggggagaaggtaaacagaaatggagaatgaggagtctcagctcctggcctccggcctgctcaagcgaaggggaaataccattgtatcataagcagtggtaattcccgtctgccaggtgtctaccgggtgaaggggtcttgctctgtgctgggtgctcaga

SEQ ID NO: 114561 - DNA, 720 bp, Homo sapiens
gtgtctcaccccgggccggaagggctcctgcgcaggcgtttgtagccacttttaagttttatcagctagttcatgcttgcgttgaaagagtggtcgtttgcgctgggtcatcactgtgtagtattggggatacttaggtgagaaaaaaacttaacgctagagacgttcacgcactagtggagaagccaggattgttgccctagagttacagtagataaaagtacctcagagaactgcgggggctcccaacctggacgcttgcaccggagtattaaatccagctagagaatggcatgtgcaaagatacagagcttttagaagttgcctgcattccttggccccttcctcacatcattccaaccaacttccatccttacaatcgattactttcctgtaatagctacagtcaaatgggcagctgaagatgatgatgatgatgatcttgacaccgagaagcagaagaccaatgaagatgaccagacagcaaaaaaggataagttaaaagaaggtaaaagaaggccactcgtacttgctgtctcagtatctaaaggtggtcaccttccagtagagaggcccacccactgcagactgtgccaccgaaggtgacatgcactttctgccacccatccaaaactgtaacgtgaatctgcaacaggagaggaaagaagaaccaaaacttccaaggccttgcattttttcttaaaagcatttttttttttt

SEQ ID NO: 114562 - DNA, 631 bp, Homo sapiens
gtgtctcaccccgggccggaagggctcctgcgcaggcgtttgtagccacttttaagttttatcagctagttcatgcttgcgttgaaagagtggtcgtttgcgctgggtcatcactgtgtagtattggggatacttaggtgagaaaaaaacttaacgctagagacgttcacgcactagtggagaagccaggattgttgccctagagttacagtagataaaagtacctcagagaactgcgggggctcccaacctggacgcttgcaccggagtattaaatccagctagagaatggcatgtgcaaagatacagagctacagtcaaatgggcagctgaagatgatgatgatgatgatcttgacaccgagaagcagaagaccaatgaagatgaccagacagcaaaaaaggataagttaaaagaaggtaaaagaaggccactcgtacttgctgtctcagtatctaaaggtggtcaccttccagtagagaggcccacccactgcagactgtgccaccgaaggtgacatgcactttctgccacccatccaaaactgtaacgtgaatctgcaacaggagaggaaagaagaaccaaaacttccaaggccttgcattttttcttaaaagcatttttttttttt

SEQ ID NO: 114563 - DNA, 586 bp, Homo sapiens
cagtggcgcgatctcggctcactgcaagctctgcctcctgggttcatgccattctccttcctcagcctccccagtagctgggagtacggtgcctgccaccacacctggctagatctttttgtattttcagtagagatggggtttatccatgttagctaggatggtctcaatctcctgaccttgtgatccacccgcctcggcctcccaaagtgctgggattacaggtgtgagccactgtgccctgcaaaataatatattttaaactggtaaaaacgagttgcatttgaaaaattcttcctcagccaggcgcggtgactcacgtgtgtaatcccagcaatttgggaggctgaggcaggcggattacgtaaagagatcgagaccatcctggtcaacatgttgaaaccccatcttcaccagaaatgcaaaaatttgctgggcgtggtggtgcgcctgtagtcccagctacttgggaggctgaggcaggagaattgcttgaacccaggaggggaggttgcagtgagccaagattgtgctgctgcactccagcctggcaacagagtgagactctgtctaaaaagaaaaaaaa

SEQ ID NO: 114564 - DNA, 343 bp, Homo sapiens
  misc_feature (284)..(284): n is a, c, g, or t
  misc_feature (289)..(289): n is a, c, g, or t
atttacatacatacatagctcctgtcccattaaagcatcagggatgcagaattctgtaggaacgtccataacgaactaaagtctttgatacaaggggcttgcagttacattgaggcagggctgggacgagtctgaggcaaaagaggtgcctgaggtgaaaaatgtaaggaggtgaccaagcgtcccgtagaacagccttaaaaaaagagtctccgtacacttctcgccctagacagctctcgccttgccctagtcccggccctgtgatccagcctgggtgacanaacgncattccatttcaaaaaaaagaaaggaaaaaaaccttaattagggaaccctgaaa

SEQ ID NO: 114565 - DNA, 240 bp, Homo sapiens
ttttaaagtgaattttttttttttttgagacggagtctcgctctgtcacccaggctggagtgcagtggcgcgatattcgctcactgcaagctccgcctcctgggttgacgccattctcctgcctcagcctcccgagtagctgggactgcaggcgcccgccaccataaagtgtatttttaatctgagcaggggaagctatacgttatagactgaagagacatcaacagatagcaatgggta

SEQ ID NO: 114566 - DNA, 345 bp, Homo sapiens
tggcaatccatatctttttaatatgtggtagctaccgtgtgctatggtctacagattcaaagacaaataagccagagttctcagtgagttgtactatcaggtgagaaagtgagacagcagccagcaatgaccatttatatccaagtctcctgggtacttgactatgtcttaaaaatgcattcctggccaggcacagtggcttactcctataatcccagcacctgggaggctgaggtgggtggaccacttgagcccaggagttcgaaaccagcttaggcaacataagaaaaccctgtctctacaacaaatacaaaaattagccaggcgtggcagtgtgcagctgta

SEQ ID NO: 114567 - DNA, 470 bp, Homo sapiens
aaatttagtgtatagtatgatctttctacgttctgcagtgttacataggaattcctgggaataagaaaaattttatccagttgctattttatagttatatccttgactgtattctcatcaatttaggagacaaataagttacttatttattccataaatagtgccaattattttataatctcaatttaagaagtcaatatttattatgttcaataatgtataatcaggccaggcacagtggctcatgcctataatcctagcactttgggaggctgaggcgggtggatcatttgaggtgaggagtttgagaccggcctgaccaacatggtgaaaccccgtctctactaaaaatacaaaaattagctggcatggtggcacttgcctgtagtcccagctactcaggaggctgagccgagatcgtgccactacactcaagtctgggcaacagagcaagattccatctcaaaaat

SEQ ID NO: 114568 - DNA, 606 bp, Homo sapiens
cacgcgtccgcggacgcgtggggaaaaaatgttactccttctctgacttataactctttgaagttcttgaagtcaccttcattctcttaattcttttatgtctttatcttctctttggttctgtagcaggttgtgacctagcacacaatacaaacataaagattacccttacggttatgggtgcctgttgcctagatgacaaaaaactttaatgtgataactgtttcttttcctcattctttctctttccttcttttggaactgttaacctagacatctgaagagaatgtagaaatagatgatggattaggaaaacttggtattgatactccagtaatattcattatctcttatggattatttgtatcatacccttttccatccagcttgaccttaggttatgtaacttaaacctgaaaatggtggatctcttggtgtgtttcccaatatttgaatatatgaatgtttctgaccttgcccaaatctagtgatttgaagttggtgtatctgacttgttgagtattaattaattttcttttttatatcacttttgaatttaattaaagtgttttgaaatggttctttagccctgtttcttaagcagta

SEQ ID NO: 114569 - DNA, 485 bp, Homo sapiens
tgatgtcagagaatatgggctcctcacactcagtgggatatgtgccactgtagttatagtgaaagcaaatacaagcctaagggtaggcttatgcaatcaagtggtttattatttttgtgggctaaagaaaataaggagctaaaacccacaggataaacaggcaaaagagaaagggaagcagcagatgaagagaatccaagactctaaatacaaagagaagcagcattatctccatgacccaaatatttctcgacatcttttcccagtccatctgatctctagccaccaccatcccacaacccaggcaaaattacatacagtaatattgctatcaacatctgctatagcacagtggtgtcttacagggaaagggacagcctttttgtgagcacagtattaccttgcccctgccccaaacaattaaccacgtaaaaaaaataaagatgtagttgaggaaaaatgttcaccctgtcttccaactcagg

SEQ ID NO: 114570 - DNA, 184 bp, Homo sapiens
tgcccatttaatatatgcaaaatgggtgatagtctctaaaacctgttaaatatcactgcttcctcccatggtgggaatacgagttccaatcttccaacattgacccagtagggtgactgtggcaagtcgcttaatgcctctaagcctgcttccacatccccaaagtaggaataacattattatc

SEQ ID NO: 114571 - DNA, 325 bp, Homo sapiens
gttggacacttgagcagcctgcggttatggcctgttataacacccactgccatgtccatgcttggagctcccttttgttggtaacactttcctagggaaaattctattgggtagtggatgtgaatgatattgtggctcttgatttcccctgtcctctagcccagttgttttaaaaaatagaagtgagtgcctccccaggaaggcaaaagatacccactgcagtacgagatgaaaacattagaagttctattcaaactgatttatggccgggcacagtggctcacccctgtaatcccaacactttggaaggctgaggccggttggt

SEQ ID NO: 114572 - DNA, 652 bp, Homo sapiens
cttgaattgaaattacagatttaaaatttttaaagcccataaactagttagtagtttgtatagctggacaaagtcataaaatgtaccatatgtaaagctacaattactcatagttttacaatttgaaaatatgcataaggatctgtgtgtgtatatgcatatttacatatatatatatttgaattgatggagtagctatataagatgtctttctgtagaaaaagacataggcagagaatctgaaatactttaattcaaatatctgcatggcattgttccaagcttgaatgactctgtgtctggactaacctctccaacctttatatatgcttatttgtaaaccaagtggtatagttgtgagaatcaaatgagataaattttgtgaattgtataatgcctggtacctaataaacgctcaataaaactttgagcatttatacattaattcaaggaatattgctgacattgaatttttaaatttttttgtcgtatatttaaaaaattaatttggtactggtttggaacaagagaaacagattatgataactttatctttccttggagtactatacctatggttaatatttttaaaaatttgagcacatgacattttgtcatccttgttttttagtgattttgaattgacattgca

SEQ ID NO: 114573 - DNA, 780 bp, Homo sapiens
gaactcacagaagtagagagtagaatggtggttactacggaatagaaattgggttggggatttattggccaaaggatacaagatttcagtcagatggaataaattcaaaagccgtattgtataacatggtaactgtaattaataacaatgtcttgtattcttgaaaattgctaaacgagtagattttagaattttgaccatgaaaatgataaatatctgagggtaatacatatgttaactagattgatatagccattctacaatgtgtatgtatttcaaagcatcatattttacatgataaatatgtataatttttccctgtcaattaaaatctatcaataaatatgaaaaaataaaccttgagaggaagtgctctgaaaaaaagaacaccttctataagagatgtcacaaaggatcttggccctggctgggactgttggccaaaatggtgacaaaggatgtacaggccagtggactgaaaaatatggggctccgggcatcttgttgacaagagttttcaactcttctcattgagcagctttcagtcactgttgattttatcaactaaccacagcattaggtcccatccacaccacacagcttatactgaacaagcttaaaatacatttgtgaaacgatcatactaattgtgcctttcatctcatatatactaactctttgtttaagcttaagtgtaagtaagctttttgctgagagagacaatattctctttgaattccccatagcacctaacaaggcattgtataaatacttaataat

SEQ ID NO: 114574 - DNA, 755 bp, Homo sapiens
gaaaaatgcattaggttgtcatggcctaaaaacaccagccatttacacattctgacgaattcccctgattctgaacccagactaacttggtaaccagttcattgattatgattctccttcccatatacctggatttatatctatatctatacctttagagaaaaatacagcaatcagtcagtatagttcattagcttgatggacatatttttattgtaaattagtatattggcatgctgctataaggaagcattttaattaatgtggttgttatcaatgaggtcattttaagatcatacagctctcagccacacatacagaggtagaagttccatttctggaacaagagatgagtcatttcttattcacatttgcttataaaaaatacagtcatccccatacatgccatcacgatgccttctctaccccacagaaaagagaactaatgtttgtaagaaattacagtcagtttaccactatcctcagagaaataaagtctcttctgcaggttcctgcaaccagtaagtaattagaggtgacattaaaactcagttctgacagacgtcctttcaactaaacttgtgtctctgtctagaatcaactgctagcaacatgccctgactaggagaaacagatgagatttctttggctgctagagaataaacactgatcatattggttacttcctctaaacaagtctaaactcaaatcccatgcccaagaaatgggtgttctgtactgaccccccaatctcg

SEQ ID NO: 114575 - DNA, 485 bp, Homo sapiens
cagcatgggcaaagctgtccaaccatggagacgtggtgttcagctacaggttgtggccagaatgggggtgggcaaagggtgtagggaaagtggaagagaaggctgggaggaaggtagtcagggacagagctgggaggaaggtagtcagggagagagctgggggaaaggtaattagggacagagctggggagcattgtaggccacactaaggcatattcagggaggactggaaagccgctaaagagttttaagcacattaatgagacttaggttttagagatgcgtggggggcagtttgggtgtttgaatctagggaggcaaagcctgaagccagggaaatcaagggagaagcacccacacttgtgcctgaagagcaatgagggcctaaaacctgcagtgggcattttcttttaaggatgtttgtgtttctctccttgtttgtcacatgcagatccttgcgctcctcactatttgttctcctgcag

SEQ ID NO: 114576 - DNA, 358 bp, Homo sapiens
gtcccaccttctataaatcaggatttagaacaggacttttaaagtgactcggaactacaaacattcctttaggaaacagcagtctgaactctgaccccacagaaccatgactctcaaaagctaaggaataacggataaacagaggttctccaatggcttgcggctggggcaggccttccaggatgccagcaaggactctagctagttccactaaatactctgggaaccagagctaacatggggtcccatcaatccaacagctacatattaacaactctttagaaaggaacttaaggtcttcaatgttttaaaatgctgcttctttgaaacagtctccatagtaatgaactcatggcat

SEQ ID NO: 114577 - DNA, 399 bp, Homo sapiens
gatatatcctgaaagctaagtgaaagaagccagtcacaaaaggccgctgattatatgatttcatttatataagatgtccagcatatatatagacagaacgtagatcagtgattccccaggggtgagggaggggaatggagattgactgttaatggttatgggatctattttggggatgatgaaaatgttctggaattgattatgatggttgtacaactctgcaaaatactaaaaaccaatgcattttttactttaaataggtaaattttctggtgtgtgagctatatagctatagctcaataaggctattatatacttattttattttattattattttttagagacagagtctcgctttgtcacccagcctggagtgcagttgtgcaatcttagctca

SEQ ID NO: 114578 - DNA, 398 bp, Homo sapiens
caagaagcaccaaacccactgaccccatttcagtcccgctggaggccctggccacctgactccccatccctgctctgtgcccagctctcaggagactccagagctgagtctgaccttggccccttcccagagcccatgaaaaggagttccctgggcaactccacccacctgaccacttcagctgccaccgatgccagtaagtccaaacctcgtctccagccagaccctctctgacccccacccatcagccttcagacatttctactcgatgtcccccaactccttagacaagtcccaaacagccttcccccatctccaccccgcactgttcctccctgtgttctccatccccacctatgccagaggctggtgcgcaggaagcactcaatgcacatctc

SEQ ID NO: 114579 - DNA, 391 bp, Homo sapiens
gattgccctcatcagtgtgagtgggcatcatcctacccattgagggcctgaatagaccaaaaatgcagaggaagggcaaatttgctctctctttctttgagctgggacatccatcttatcgagcccttggagattggtaatcatggttcttcagccttcagactcagacagactaggacttataccaactgcccccacccacaaccctacccccggattttcaggcctttgaactgggaccaggatttatacgattagctccctggttttgcagcttgtgaacagtacattgtagcacttcacagcttccataatcacagtgaggctaatgccgtaatatgtctacacacacacacacacacacacacacacacacacgcatgtacacaca

SEQ ID NO: 114580 - DNA, 877 bp, Homo sapiens
gtgagggggaagccctggttgggtatcaaaacctagcacctggttcggcaggagggagaccagcaccggctcccaggaccaggcccagctcaccacttcattgtaaagctccctctttgtttctggaacttgggtgtttccatttctttcttacaaaattatctatgcatttacagcaattgttgatatatctttaggcagcatctaggtacttgtagtgggttctcttttttcttttttcttttttttaatcaccctctcttttttttgagacagagtctcactctgtcgctcaggctggagtgcaatagcgcgatcttggctcactgcaacctctgcctcccaggttcaagtaattctcatgcctcagcctcccaagtagctgagattacaggcactggccaccagacccggctaatttttttttctttttcttttttttgagacggagtttcgctctttgttgcccaggctggagtacagtggtgtgatctcggctcactgcaacctccgcctcccgggttcaagtgattctcctgtctcagcctcccgagtagctgggattacaggcgcgcgccaccatgcctggctaattttgtatttttttttttttgagacagagtctcactctgtcacccagactggagtgcggtggcgcgatctcggctcactgcaagctctgcttcccgggttcatgccattctcctgcctcagcctccggagtagctgggactacaagcacccaccaccgtgcccggctaattttttgtatttttagtagagacggggtttcaccgtggtctcgacctccagacctcgtgatccactagcctcagcctcccaaagtgctgggattacaggcgtgagccacctcacc

SEQ ID NO: 114581 - DNA, 446 bp, Homo sapiens
agttcctcttttgtgacttggggtggggaaggaaaagaattattataattgaaatccatttaggtttgcataataaaaccttcagaaatagatcaggggaggcactaagcttgtgggatgggttggaaagaaatgatttgcccttgggtgcactagcatgattggctgcctccttggttttaaaagaatagcacagtatatattgtctccttggtattaactgcttcagaataggagggaagaagaaaagaggtgggatccagaaatggcatccgacctttacttcttgtctcttttaaaaattctcattaatataggtccagttttcctcgtattgcttcattaggtatgtgagttattgagtttgtagcagttctagttaattgcgctgttttaacacagttcccctggaggctgttaagagctttaagagggtgagccaccga

SEQ ID NO: 114582 - DNA, 563 bp, Homo sapiens
ggggatgtaagttagtacaaccattatgggaaactgtatggaggttcctgaaaaagttaaaaatagaaataccatatgatctggcaatcccgcttgtgagtatatatccagaggagttgaagtcagtatgttgaaaaggtacctgcactcccatgttcattgcagcattttcacagtagccaagttatggaatccacctaagtgtccatcaatcagtgtaaatgataaagaagatgttgtatatagaatacacaatgcagtaatagccttaagaaagaaggaaattctctcatttgcaacagcattgatgaagctggagaacattacactaaaccaaataagccagacacagacaaataactcatatgtggaatccaaaacaattgaactcatggaagcagaagaatggtggctgtcagaagggtgaggggatgttatacgcacacacacacaggtacacacatacacatatacatatatacatacatataaggaactcagctcaattgcaagaagacaaataacccaatttaaaaggggagatgggccggagaagttggtca

SEQ ID NO: 114583 - DNA, 791 bp, Homo sapiens
gctgagtctgctacaacaacattgttttcaacttttccttctgcttaatattactggcttcactccctcacacgtatcactcctgagcattctctaataaacgttctccaaaacaggggttgcaggcttagaatctaatcaccaaagcatttggtgtcaggagtggttggagaacgcagacaatgaatgtgattttggagctgcattacttgctggccagctggcaatatggaaactattgctggtgtcaggtgaaacatggaagatccctggcattctatagcactgaaactattattacttgatcagtggtgaacagggatgggatagcagtagaaggaatgcacttaaatatctcagggtttgttagattctgagaggactggtacttatgaggatgatggaattgaatggctgttgtggactgcaatctcatgccctggagaaagacagtgaatgactttgagtcagtaatcagtaatttgagagatactgtgaatgtcagaggagctctttaggaacatataaagagattcttatctctgtgatcaaggacagaaaaacctgagggtcagttctaggccataattttcaggatggcaaagctccatagaaggttgaagtctcagatgcagaaagtctatcatgtcaaggccatgccctggttgagagtcttagaaaggggatacctgggtgggtgcactaaaaaaaacccttaaaacccgttttgcctggaactctctgagctggtaaatgttcaaggctagcatgcccaccccctaaagccccca

SEQ ID NO: 114584 - DNA, 191 bp, Homo sapiens
acagattctgatttttacaataagtatcttatattcacgtggttcaaaattcaaggcaatgtaagatctgtaaacattattctctaccttttttcactttatgtgatcttgttatctcttggggactgtttggactctgggcactgtttggactctgggcactgtttggactctggcactgtttggactct

SEQ ID NO: 114585 - DNA, 348 bp, Homo sapiens
gaaggcatggagaagacgccctgggatctcccgatatcccttaaagagaaggacaaaagcagggagcaggaagccatctccagaattctggacactctgggtcttagatggtttgttaacaaagaaaaatgtttcctgaaattagctgactgcattttccatttgggctatgatgaccttgtttcctcaaggagaaaacgatgactctgtttctttcaggaaattcagggtaatctataaaaacatgggctgtgtaaaagcatcaatacttcttcagaatagcatgtctttgtggagcaaaactttcttaaattttgtcacatcattaaagtccagtaatacccttta

SEQ ID NO: 114586 - DNA, 326 bp, Homo sapiens
gatggagtcttgctctgtcacccaggctggagggcagaggcacgatctcagctcactgcaacctccgcctcctgggttcaagtgattctcctgcctcggcctcctgagtagctgggattacaggcgcatgttgccacacctggctaattttttgtatttaagtagagatggggtttcactgtgttgcccaggctggtctagaactcctgagctcaagcaatccacctgcctcggcctcccaaagtgcactagtagaatttttataaggcttttgcctgagggtacttatcagcccatgtggcaatggtcacttagactgaagcagg

SEQ ID NO: 114587 - DNA, 667 bp, Homo sapiens
catttgaccagtgtcttttcatttttagtaaaagtaaaattttttctagacataatcctgctattgatgttgaatactatttcatcttaccctgcataccacacaataccactgatacattgtatataccactgataacattcttggccactgggaaaattatttttttacattgttattggtctcctgtgttgtaggtaggactatgcaggaatggatcttttctttgagacagagtcttgctctgtcacccaggctggagtgcagtggcgcaatctcagctcactgcaggctctactctcgggttcaagcgattcttctgcctcagcctcctgagtagctggggctacaggcatacgccatcatgtccgggtaatttctatagttttagtagagactgggtttcgctgtgttggccagtctggtctcaaactcttgacttcaagtgatccatctgcctgggcctcccaaagtgctgggattataggcgtgagccaccgcgtctggccaggaatggttcttgaaccatttcttcccatcttagaaaatactgacttctcacttgccttattgaaatggtttggagaggtatagcatctaacaatactgcacttccatagagcggacttgggataacagttaactcctaagacatcagctgaagatg

SEQ ID NO: 114588 - DNA, 530 bp, Homo sapiens
aactcaacctgtacttcatatgtaccttaacattaattaggctgtcaaaaaaaaataattcactcttccatgtggttattgcaaaaataaatcatttatggcaagcttgtgaggcagtctaacttcatttgattaaaaacaaaagagctaaaaggggaatcatttatgtagattagataaatgaattctacctaatatttacatacgggctgaaattttctgttgagactgtaattgctagtcctacccatgtttacagtttcagtactattggttttggtatcagtagctcactagagaggaaataatactgagatgaaaaacattttatctctttctcaaaacttgatgaggaatgttaaaagaacaaaaaagaaaactttgcaaatatatatggcaccaaagaactggagccacatgtttgacaatgtatttgctttctacttctgatgctttgttatccttgtactttacttaagtgtatttgtttgatttttgatttgtttgatttttgagatgcagagtctttt

SEQ ID NO: 114589 - DNA, 1200 bp, Homo sapiens
aggcgtgagccactatgcccagcctaaattttcaattttgtataatagtttaagtgaaataatttaaatgaaaaataagagtcaaaacaaaatgggaacaagggatctttttggagtgatgaaaatgttctaaaattggattgtggtataaattcattaaaaataattgaattgtgcatttaaaataggtgaattttatagtatataaattataactgaataaagctaataacagctatataaaacataatttaaaagaaaaaaaaaaaaaaaaaaaaaaaaaaaaaaaaaaaaaaaaaaaaaaaaaaaaaaaagaaaacacaaagcgaacgagaaaaagaccagagcggacgaaaaagcaaagacgaagacagaaaagaaaacggggtgggcggggcgacaaaggggagaaagagaggacaagcagagacagaagagggggggggcgcggggcggaggcacggagcagggaggacggagagcggaggagcgagcaggcacggggacaaagacgaaccgcagtagaaaaacaaacgaccaaaggtggagcgaaggagaaaacgccgccaacacaaaaaaaacaaacagcgaggcagcgcggagaaacacaaagagcagaagatagaggaaaagcaaacaaaacggaaagcgcgagaagaacgctagaagagagccgaccagagagggaacgacagaacgagagaaggcgagagcggaggcagaaagagaaaccagcacccatcacaaagcagaacagacgcgcgacacggcggtgaaaaaaaaaaaaaaagcagaaccggagaaagaacacgaaaccaagaaaagaaagaaagaaaagagaggagaaggggaaaaaggacaaaaaaaagaacaagaaagaagacaagacagcaaagagaaaacgggaaaagacaaacagaaaaacagaaggagaggacgaagaggagacagggcagagacaagaagagggaagagaagaggggcgaaggcaaacacacagagagaacaaggccaaagcaaaagaagacaggagaacaaaggagaagcaggaagcaagagagaggaaggaaggaaagagagaaaagaaagcagacaagagagaagggacgaaagagagaggagcaaaacgacaaaagacaacagcagacgccagtacaaagagagcaagcagaggaagacgcagcgaacggcaaaagaacg

SEQ ID NO: 114590 - DNA, 615 bp, Homo sapiens
cctcccccatagttcgtttgggaccctatgattgtgctctcaccaatgggattgtgagtataagtgatagatagctcctggcttgaggccattaaaagcaggcatgcattcttccaggacttccctctctcctcctcacccatggaattggataatcctggaatggatgagttcattgagggaagcagctgagttccctgagtcaccactggaaaagacctaccaaggagagcttcttggctcacaccagactctgatgttagtgataagtactaggttgagcccctgagatttcaggatttattttttaaggcagcaaagtataacagtgcctaagtaaaagagaacccagagcccaaagatgagggaaaacttcatgagaagcgactttatactacatgaggcttggtaagaattccacatgaagaaatgaagtgatgaggaagaacagtttaggccttagtgcagagccaggcctggctctgaacttagggacaattttttctttttttttcttttttctttttctttttcttttttttttgggccctactagtttccttttctactataggttccagtatctttgtgtttgtgattacacactcactcact

SEQ ID NO: 114591 - DNA, 386 bp, Homo sapiens
tcactgcaacctccgcctcccaggttcaagtgattctcctgtcttggcctcccaaggaactgggattacaagcacacaccaccatacctggctaattttgtatttttagtagaggcagggttttgtcatgttggccaggctggtcttgaactcctggcctcaagtgatccacccgcctagacctcccaaagtgctgggattacaggcataagccacagcgcctggccctgatttttttttaaaaaaagcaacagttgtgtgattttgcttccagacttccagatatcaatttctagtcatctgattaattcccttctagttttcagatattgctatatctagttttcagatattgctacagacaaagattttggaattccctttcc

SEQ ID NO: 114592 - DNA, 241 bp, Homo sapiens
gagagagttgagcgtgtctggaaggctgatccactctctcctactcctgctcgcatctgctcatttctttttttcctgtctaaaggcaaaacaaggtaaaatacaatagccagttgcctcatataaaccacctgcttagtaggaaatgaagtaaaactctgcagtccctattgctacttgaagaatttgtggtttcctttcctgtcagtaaacaaaagccgtcagttaaaagagtggaaca

SEQ ID NO: 114593 - DNA, 1172 bp, Homo sapiens
atctgcttgcccaatcgacgcctccatgcccctcttgcttacaccaccaaaaaaaccaaacgctatttaaagaggagtggcccatgaggattgagcagcagacagcacgtacggaagtgctggtgggaggagttctctgaaggatggaaaggaaacatttctttatcttctctatttttaaccccaatcagtaggcattaggttaggctcagggtttatagttaggaaaaacctgctatctgctcctccttccagtagaggcaaacactttgataagaaaacagccaggctaagggtttatccaggataagcaaggctcctccagcttaaacacagtatggttggatctggttgttccataacctggtcaatatctgagtgttggctctttcatttgttttgaatatgggactccatttttcagaattttgtttaaagcaataagaaaaaaaaagtaataaaagtggtagtgagaaaatatatatacccacttccctcatgaaaaaataatgtgactcagcattcaggtcactgaattagaaagcccaatttttattccctgttaaactgctttctgttttaccctgtctagttatctggcatatatttccatttatgcttgggtttgaaatttgttctgatgtggacaccaagatgctgtcattactttaataaacaattttagacaatcaattttattcattaaaatcataaggccacaatataattttgaaaagaaatttgccaaatgcaggaaatatattccaggaagttgatgctcttcccagagtgcacatcttgtgacctttaaccccagtatcttggtaacctggtctacataagtttgtaggacatctattatttaaaaagtacaaggacgagcatattacacacagatcctcctcctcccaacacacacattcataacagtattttaatctgtctcgaatcgacttcaaacccattttgctcttaatgggagttattcattttcacttgaaaggtaatacatgacggctggatgtttaatgtgatggaatggctgccgattaactaggtgctgcaacattctagaccagttcccccatggcctacttcccatctcctggccccgctcagacctgatcctatggaacgtcgcgttgcaggtttgagaccttgcagtgtgatgg

SEQ ID NO: 114594 - DNA, 156 bp, Homo sapiens
tgcatctgctcagcccgcacctcctgagatcgacccatcaaaaagatcccctccttcccttttccctgccatcttttctccactgacgcctgctaacagctcccgtcgcaccaggtatctgtttagggaatctcattctgccaaaccaggtgcagg

SEQ ID NO: 114595 - DNA, 1017 bp, Homo sapiens
gtcactgtacacaccgccttggaggcaatcactccaggagagctgctttcatgcactatgcatctattttttttttttgtctttcctaatttcaagttcaagatggtgtccctagctttaattgtatacaaggaccaggcaaacaccatgctcttaacttcaactcaatctgttgagcaggagttccttaatacaagatgtgggaattatatgttaaagagaaaacattgtttgccactacccagtatggaaagaacgagttactaaaatttggccaaatataataagtaatatttagtataagtttaacataaggtccgtgtcttccatgtcaaaaacgggatctttgtactttctaagtaaaaagaaggtcctgtagtagaattccaaaactagaggacagatacctccagggaatccttaacaaaggggaggagaccaaagacttggtaatgatctaagaattcctacaggtttttatcagctttgtctaagtaatcagcataatcacttcggttctgtgcaagtgtacctcaactttggggtcttctatgaggggcctgagactgatcacaaacagaaggaaagaaaacaactgaatgatactctggatgcaattgaggacggcacacaaaaggtgcagaacaatatctttcacatgtggcgatactacaactttgcccggatgaggaaaatggctgactttttccttatccaatcaaactataactacgtgaactggtggtcgacagcccagagccttgttattattctttctgggatcctgcaactgtatttcttgaagcgtctcttcaatgttccaacaactacagatacaaagaagccaagatgctaagctaaggtgactatagcaccctggctgttttcttctggggcttagtcgaatcagctttgtaatgttatgggacaaaaatcaattatctcattaatgttttagtctgctgcacacatctaaaaaagcaaaatggcaataaaatcataacagtgaaaaagttc

SEQ ID NO: 114596 - DNA, 519 bp, Homo sapiens
atcaactccaaaccccagcagggggttgggcagtcccaccccagacagagaccgctgtgctgatgaccgtgggacgtcaatcttaccactcagctggcttcctcgtgatgtagcaggggttctgctacctatttaatgtgtcttggcaggttcagcggacagtggggatgtcacatgaccggcatgttgctgccacggcacataacccacagggatttctcatagacacctcccagggtgttcggggccagattaacttctctacccaagagacaggtctgttttcattaccatggctattataataatcatagggtcctatgaaattacagaaataatgaggaagtatacagagatgttttaacagtaggaaaaaaattcagcctttaacaccaaaaaccagtgttcctggaggctgctgacctccaaggatgccaagtggcagtctactgacgatttgggggcaacactccaggtgagcattctaagtctagggttcagccgctcaattttatctca

SEQ ID NO: 114597 - DNA, 945 bp, Homo sapiens
aacgacttgatttccctgggctgcgagcagttcacctgcagaggaggctccagaaagcggcatgtcccctttgctctttggggctgggctggtcgttctgaatctagtgacgtctgccaggagccagaagacagaacctctaagtggctctggggaccagccactcttccgtggagctgatcgatatgactttgccatcatgatacctccaggaggcacggaatgcttttggcaatttgcccaccagactggatacttctatttcagttacgaggttcagcggacagtggggatgtcacatgaccggcatgttgctgccacggcacataacccacagggatttctcatagacacctcccagggtgttcggggccagattaacttctctacccaagagacaggtttttatcagctttgtctaagtaatcagcataatcacttcggttctgtgcaagtgtacctcaactttggggtcttctatgaggggcctgagactgatcacaaacagaaggaaagaaaacaactgaatgatactctggatgcaattgaggacggcacacaaaaggtgcagaacaatatctttcacatgtggcgatactacaactttgcccggatgaggaaaatggctgactttttccttatccaatcaaactataactacgtgaactggtggtcgacagcccagagccttgttattattctttctgggatcctgcaactgtatttcttgaagcgtctcttcaatgttccaacaactacagatacaaagaagccaagatgctaagctaaggtgactatagcaccctggctgttttcttctggggcttagtcgaatcagctttgtaatgttatgggacaaaaatcaattatctcattaatgttttagtctgctgcacacatctaaaaaagcaaaatggcaataaaatcataacagtgaaaaagttc

SEQ ID NO: 114598 - DNA, 660 bp, Homo sapiens
agggcaagctctaactggctgcttccccatatttgtaatagttcaaagtcttgaaatatcagcgcttaagagtctttgggagcataaactgagcttcgtattaacagcttcttcatttgctttaaaatagcgagacctcttaccttttcaatcccaaaactaaccacttataattcagtgtggtcatttaaacgtgtgtgtgtgtgtgtgtgtgtgtgtgtgtgtgtgtgtgtgtgtgtgttttaaccataacatgagtgtcacatattctctaggagacattttggcccttttagttgtttaggttattatacttcaaggatttataaatgtgcaacaattcatggagtggcagaaaaggatatagagagaccaagttgttgaggacaatagctggagtttagtcttccagaagtatttttcttgccagaattgatcaaaggaagagccaacggcactggataggagattctagcatttggctgcttctccaagacaagcgaggttagaagggagttgagaagttatgtcatcttccactgcagcagataccccttttttagtacttggagatcccccgaatcacagcatttctaaatcagccctggattccacaagtgaagcagcggaggaaccaggaggtcagcggtgtcactcaaa

SEQ ID NO: 114599 - DNA, 256 bp, Homo sapiens
  misc_feature (202)..(202): n is a, c, g, or t
agcttcttaaaaaacagaacgtatgcctgtttcctcatcaagtaccccattcccagcaaggtagcccttggtaaatgtttgtttagtagactgacaaagcagccttagttattcaattcacttttaatccaactattaagagttagattctactcaggaggctgaggcaggagaatggcgtgaacctgggaggcggacttgncagtgagccgagatcacgccactgcactccggcctgggcaacagagcaagactc

SEQ ID NO: 114600 - DNA, 551 bp, Homo sapiens
gaaacataatggaagccacaatgtgagccacatgtgtgatttaacattttctagtagcccattaagaaaagtaaaaagaaataggcaaaattaattttagtgctatattttacttaactcatgtccaaaatatcatttcaacatgtaaaaaatgttcatgagtattttacattctgttttttgcactaagttttcgaagtccaatgtgtatttcacacgtacaggttgagcatctcttattcgaaatgcttgggaccacaagtatttcggatttcagattttggaatatctgcatatacataaatgagatatctcgggaataagacccaagtctaaattcaaaaatcatgtgtgtttcatatacatattatacacatggcctgaaggtaattttatataatactgttaataattttgtgcatgaaacaaagtttttatcaatcgaatgatcagaaaccaaaggtgtcactatctcaaccacccatgggacaatctgtgcttgtttggcaacatcattcctgacgctcatttatgtgctactgataagcaat

SEQ ID NO: 114601 - DNA, 209 bp, Homo sapiens
ctccaagtaatggcagcatgcctccagctagtaccagtggtgcaaggagataccagctagaaagatccagacatctggtcaccaacttagaccttctcccatcatgttattttatacccacctgcaaagcacagaatcctcacccctcttcccaccctccagccactccagcaagcatcatcccagactctgctggcaaaataaattgt

SEQ ID NO: 114602 - DNA, 424 bp, Homo sapiens
ccgtctttgtatctctgtctctcagtacaaatttaatgaaggaatgaatcaatgaatgaatgaagcaagcattcccccagagaattcttaaatcatcttagccggtcatggaatttcccagcaagtcagcttttagaatcctgaaaatattttcagtattcatctctttaaggaatatatcaaaagcagtcagcaccaaccacggtttttcagctgattcccaaatgtgtgataagaaacacctaattccttgggggagaaaacttgttcaggttaaattcttgcggtaatccttacggccctgtggtgttcgctaagatgtagcaagaatgtaaatagctaggtactttgatctacctcaaatacttactagtttaaacattctgccattctgccgtcataccaaaaaaaaaaaaaaagcacc

SEQ ID NO: 114603 - DNA, 169 bp, Homo sapiens
ctaggccacctgcctggctcagtccttgcctgtcccttctccctcctttcccttaggcctctctctgttgttaacactaattaatgataattaaggccagcctattacccacccccgcctgcaccctgcactgtagccacatctgggcagggctgggtaagcctggctt

SEQ ID NO: 114604 - DNA, 544 bp, Homo sapiens
gtttgctttattataggtttggcattttcctacttcaccagctacaactcttgtgatattcccctgtctctatgttttcagacatacacagaaccatttaggttttttggtttgccataatcttgtgcacatggagatttagctatccttctaaccatattactaatttatttcatgttttctcagttaattaacatcatatctcttttttatatcttacttcctcaagaaaaattcacatttcctctgactaggataaattttgtataaaatgttaccaatgcaagattcttgcactcctatttcttacagggttataattttacttttgtgggggcttccctttgggtatcctatctgtatatctgcattagtgttcaccacattttatgcatctttgtctttgtgatcttccattaaaccaaaaaccaagaatagggaggtaagaatattataagatttttgcttatttgttttgcttttgttcatcatcataaagctgactatcaatgtactattaaatacttactgaagagaagtccct

SEQ ID NO: 114605 - DNA, 270 bp, Homo sapiens
attttaagcaggcaaacctctgtagctttacagtttctgaaaattggatcccagttctaatgggcaggcagtgataatggtaatgtttcttttcctaaggttttctttaaagggaagggatcaaatagttcatttaagacaaagaggttattataaagtctaataaatactgtggtagctctgttaatgcttttcaagggcatttaagtgaaagaagccctttccaacaggcagttttggaaagctaaacactcttgttaattcatgaaa

SEQ ID NO: 114606 - DNA, 735 bp, Homo sapiens
caaaaaataagcttctagttagctttagcccttttagcttcagtctttttccttgagggatttaataattaaatgctgtatctgttcagtttgactatatgaaattgctgtttttgtaggtcagaagaagttgagtgtgagcaatgccaaatgggtctgcctaatactgtttacagttacattattacttcctggctgacttatgaatagtatttgttcaaatcagtatctacttactgcaccaagccctgtgagaagcagtagtgataaatagatgagaggtgagagtttgtgtcattaagaaacttggtctaatagtgaaacatatggaaagaaatgtattactattgttggctgggcacagtggctcacacctgtaatcccagcactttgggaggccaaggctggcagatcacttgaggtcaggagttagagaccaccctggccaacatggtgaaactcccatctctcctaaaacaatatacaaaaattagccaggcatggtggcgcgtgcctgtagtcccagctactcaggagactaaggcaggagaatcgcttgaacctgggaggtggaggttgcagtgagccaagattgtgccaagtgtaattggaacccctaagatgggggcaaggtgagggaagggcagtcaggattccgaaaagaagtgggcattagtctgtttattgtgcctggagagtaagattactttaggtggaggaaataatagtgtttga

SEQ ID NO: 114607 - DNA, 132 bp, Homo sapiens
ttagagccctgaacgagggagcgtagtcattgggtctgtggtcagttaagtggggacctgactgagactgcaatgaccgaagcatgttttaagaagcaacagtatgaaggggatgcagagcaaatcaggggt

SEQ ID NO: 114608 - DNA, 331 bp, Homo sapiens
tggaagattcaatactgtaaagaggtcaatattccataaagtgatctgtagattcaataaaatcaaatcagaatccccacagggtttttttattcagtgggaactgacaagttgattctgaaatttatatggaaaaacaacatcgcaagaataaccaaagcaatctttgaaagacttaacactactcgatatcaagactcctaacatcataataattaagacagtatggtaatggcacaaggacaaatgggcaaacagaacagagattacagagaaacagaccctcacatatacaacctcttgatttatgatgaaggtgattgtacactgg

SEQ ID NO: 114609 - DNA, 359 bp, Homo sapiens
gtttttaaagcaggactgtgaggagaattttaatagagtctagattggtgaataaaaaagaatagaatatcccaaaaagtatatattaatgctcaaaccagtaaagaaatatgagttaccattttgtggaaaaatgacatgggtagattcatatcccctactgcgtgtaagattattttcaaagagattaaagcattaaatgtagaaaataaaaccacaaaggctctaggagtaaacataggacatgacatttcctttataacctttaagtggttaaggtataagtaattataactaaaagtccagaagctaaaagattaaaaaatgggtgtatgtgaatacagtaacaataacttcat

SEQ ID NO: 114610 - DNA, 389 bp, Homo sapiens
catgcccgaagtgtaactccaacaagtgtgggcccgagtgccgctgcaaccgacggtgggtttacgatgccatcgtcactgagtcaggagaggtcatcagcacgctgccgtttaatgttcctgactaggtgctcttgtatatggactgatttgtttcttcttcttacacatttaagttgacctctttcttttgggtgaattttagggcttgggggaaatatcgaaaaaacatactgaagactcatgttctgtcaagccccagaacaatgtagaatgggcaataattctgtaaccttcttaactgtgtcaacaattttcaagtcccttaacttgcaaccaaagaatgtaacaatggagggatcagcatttctcatcagcaccctcatctc

SEQ ID NO: 114611 - DNA, 272 bp, Homo sapiens
ggtggcaggtgtctgtaatcctagctacttgggaagctgaggcaggagaattgcttgaacccaggaggcggaggttgcagtgagccgagatcgcgccattgcactccagcctaggcaacagagctagactcagtctcaaaaataaaaaagaaaaaaaaaggaaaaagaaacactaatctaaactgtgtgtcaagtgaactggattctgagctgtgactacttaggattcagtgtcctcatccatgtaaatagattcctgccattcttttggg

SEQ ID NO: 114612 - DNA, 345 bp, Homo sapiens
gacaacaccaggtatggaacaacaaaaagagatgcagctatagagaaaatcttccctgtcccgtagagccaccctttaacagcatcaccatttctcaaggtgtattaataggttccctttaaaaataaatgccacggggtgtccagagagatcaaacaagaaggcttagaaattcacaatgccatactagtgtattaaagactataacaggttctgaagtaaagagactacattcccctaaattgtttgaacatgaaatgcattttctgtggaatacctacgaacattttgtggaacaagtgtttactataacagtttgggaaataccactcttaggccctcaaa

SEQ ID NO: 114613 - DNA, 597 bp, Homo sapiens
gagggtgaggggtccttggcacaggagggcctcaagggcagtgtgaagggtggggtatagcagagtggctgagaggagactcccaggttaggggtcatcccagtgggaagcagcacgctccctatgatggttggtagtgagatgcagtgacccactggggatggagctgagagaggggggaaagagagaaagaaggaagaatgaggctgttcctgatattcccctagggggagcatcagcctggtttctccacaggctgtgaggttgagaataacttctgaagggatggtcttttttctaacagtgagatgtcactctatagcaaaaatagcagagtgtaccaccttctctcgagatttctcctgcaccttcgcacttctcacgggcctcatttccatgcaccaagagtggagggcagctcctaccccagggaaccagcctttcacacagaagaggaccttctgcaaggcactgaatgaacagcattctaccagcctttattttaatacccacaatggtaaaaaagtaaatatttcctgaggcctaactccacagttaggtggttccatttttacaacagaggtttgaaactccagt

SEQ ID NO: 114614 - DNA, 292 bp, Homo sapiens
gttatgaacaatgtctttataaaatgttttattgttgattatgataatctttaaacacaaatgttgtgaaaagttttatatatttatgaatactataaaacttccaatgcgaccttgatttcctccacggagactgaattgggataagaaaaacacttatttgctatgcaccatttattagtcaaccaacataccataactattggttaatttcttcaagcatcccattttattagtaaaataataatcagtatgccttttatttacttcatgtccctgaaaatatataatg

SEQ ID NO: 114615 - DNA, 325 bp, Homo sapiens
ctattagacatccaccaagagctgatttaggcaaaatctccagaaaaacataaagcttcaataatgaataaaagagaccagaggatgcaaaattccacaggaatgtcagattttatacaacctcatagagtaaatgggagcaaagttagcaagaggtagattgattaagagtaattatgaagagatgaaataccctctgactctgaagacactaatgtattaatctgtggaataagaaagaacataccagaggcctcatctgatgcaacacagtgcttaccctcctcggaatcgatctctacttctactttatataggtaaataa

SEQ ID NO: 114616 - DNA, 228 bp, Homo sapiens
tgttattgcatggatgctgcacacttacctcatggaaccagtcctcttctgaaggacatttagataatgtccaatctttctctcttgacagtagaaaaaggctgcacctgacacatacttcattacccacacatgcaaggggcatcgctcagatgaagtctctattttttttccccgagatgaggtctctctctatcacccaggctggagtgcagtggcacaatcaca

SEQ ID NO: 114617 - DNA, 286 bp, Homo sapiens
aagatatggttccagttttattcttttgcatgtggatattctaccatttgttgaaaagactgttctttccacatggtatcttcttggttgctttgtcaaaagtcagttgaatgtgtatgtctgggcttatttctggactttacactctgttccattgatacatgtctgtttttgtgcaaataccatatggttttgattactgtagttttgtaatataacttaaaatccaagaattgtgatgcccccaactgtgtttttctttctcaagatttccttggctatttgt

SEQ ID NO: 114618 - DNA, 503 bp, Homo sapiens
gccccacgggactgagggtaacatgagggtaacagacaggtgatgttaaattccatttgggctcatgttcacccccaggccccttattttctttcaaacacatggaatgggcatttagaactaggaagatcatgaatctggtggctgtgtagatgccataccaggtatggaccacaggcttggagcgcagcagcatacaggggtcagaggtcaaggccagtggtctatcagaacccagttcctgcaggagccagtgccggtactaggtagactcagatgactgaatggtcctcgggatctgaaggccagtgggggagatgaggcctggcctcccggaagtgctcagtaaacatttgttaatcatttcctgcctagggaagctctgtggtatgctcaggagaatcttgcttctcatgggggaatgggtggttgtcatttgggtgcctgagctccagcctgcttgctggctctctgggagttggggtggtggcatcaacctgcag

SEQ ID NO: 114619 - DNA, 492 bp, Homo sapiens
gccccacgggactgagggtaacatgagggtaacagacaggtgatgttaaattccatttgggctcatgttcacccccaggccccttattttctttcaaacacatggaatgggcatttagaactaggaagatcatgaatctggtggctgtgtagatgccataccaggtatggaccacaggcttggagcgcagcagcatacaggggtcagaggtcaaggccagtggtctatcagaacccagttcctgcaggagccagtgccggtactaggtagactcagatgactgaatggtcctcgggatctgaaggccagtgggggagatgaggcctggcctcccggaagtgctcagtaaacatttgttaatcatttcctgcctagggaagctctgtggtatgctcaggagaatcccttgaacctggtggaggtcggaggttgcagtgagccaagatcatgccactgcactccagcctgggcaacagagtgagactctgtctc

SEQ ID NO: 114620 - DNA, 418 bp, Homo sapiens
gactcatcagggaagtatagcactgggcttagcagagaatctgcctagagaaggcactggtatttttgcatgaatgattgaagtttgatctgtcaaggcagagctcgctggagaagagtgagaagacagtgtcagtaacgtaacaaggaatagaagtggtctatggagtgttaaggagggcctgggtgggaaagatatggaaccctaggtaaagattacttgtttgaagaatcattcagagagatgttgaagacgaggtcaacagagttggacaaaagtgtaaatgtgaatggtcctttctctaggaccctacaatcacaagtgtggctgggaccatccatgccagcatcacttgggaatttgttagcaatgcccactctcaggcccaccccagacccactacctgtcttttatccac

SEQ ID NO: 114621 - DNA, 413 bp, Homo sapiens
cttgataggaccaccccatccaggctgcagggctgacggggccacccaagggtcagacagtgaaggccccttctccacagtgtctaggctgtccctgggctccttggacctcgatggacatgtgaaccttgtgcctgcaggcacgcgagccccacgtctgccccctttccacagtcctggctttgacgtggggaaggggccccaggggcagggaccaagaggactttgcacagactgggtgtggcagctcacgcctgtcatcttagcacttggaaggctgagatgggagggtcacttgaggctaggagttcaagaccaggctggtcagcatagcaagatcccacttctgtttatttatttaaatttattttcaaatttaaaaaatgcaataaaaagaatgtgtatcgtctgga

SEQ ID NO: 114622 - DNA, 250 bp, Homo sapiens
ctgggctcaagcaatctgcctgcctcaacctcccaaaatgctgtgattacaggcatgagccaccgtgcctggcctatagtatatgctttactttataaaacactgccaaactgttttccatcatggatgtcccactttatagtcttactagctatatatgagagttcttattattctgtatgtgtgagggcattttgtattgtcaagttttttttaaattttcgtcattctaacagataagtagtggtaa

SEQ ID NO: 114623 - DNA, 512 bp, Homo sapiens
ttcttttgggaagtctttcttgacattggattccccatattaataataacagcagcagcagcagcagcaaaaacttacatagaatgtattaggcaccattataagtcccttgcttatgttaactcacaacaattcaatgaagtagactattattactcccattttactgatgaagaaatagtagcacagatatacttaagtaaatccaccatgaacatagagcaaggccagacatggtgggtcacgcctataatcccagcactttgggaggccaaagcaggtagatcacttgaggtcagcagttcgagactggcctgcacaaagtggtgaaaacctgtctctgctaaaaatacaaaaattagctgggcgggatggcgcacgtctgtagtcccagctactcgggaggctgaggcaggagaatggcttgaacctgggaggtggaggttgcaatgagccaagattgtgcctctgcactccagcctgggtgacagaatgagatgagactctgtctc

SEQ ID NO: 114624 - DNA, 651 bp, Homo sapiens
caagggcatccctgattcgggaggaagctggcgtgccgaaggtcaccagcaggcactgtggacccagcctttgagcttggaccccgcctggcccacaaagccccgtgctgcttcccagggcccacgcgcaggttcccggacctccagctgcaccctggagggggtgaggggggctcactgtgtggcgtgtgccaggtggaggggctggcgtgggacagagggatggagctcgggggaagaccagcagatccctggacacacggggtgaggctgggctgtctcagataggcaggactaaaagcaagacaagcaagacagaagggctcaagactggagcagccaggaaattctgtccaagccgagtccctgggtttgcgagacttcacgccacctcacaggggtcgtctggggttgtggtctctggccaggagggtgcgggagcctctttcttccagctcagctcgtgctacaccagaaagggaagggcaagagcaccccctcaacccagaggacccccagatcaagagaccacccaggctacaatcaactctgatggcgcttttaatcaccccagcaggagtggcgactgtaaacagacattcaacaattcccagtgacacacatacctcccgggaaaaaccgcgtttccat

SEQ ID NO: 114625 - DNA, 478 bp, Homo sapiens
tcaaattcctcctgctgtcacttgaactgctggtcattcaaggtcagtagatccacccgggtgacaaaagggaggtatatttgatctttttcatgtatttgtttcctaagacagagtttaattcttgtttcttaccattctcaaatttgctctttattctcttgtcccaatgctattgccctatgataagcatttttcagctcattccaaaagttgttctcactctgttccatgggaattttcagatacataaaccaaattgagcctaaatatgcctccttcctttctctgacttgtaattgatgcccaatatagcaatgtccttcccgaagaccttgccatcatcacaaaatcctttacatacccatactcgccctgcatgtgtgtccccaggctctccgattcctctttcatctctcagttggaaaaaaatagcgctatttcaagaaatgcaatccaccagtagggagtaggaaaa

SEQ ID NO: 114626 - DNA, 662 bp, Homo sapiens
gttttaaattgccatttggcagtgaaggtgctattgccggaagatggaaaagcagatattgtgagagccgctcaggacttttgccagtgagtagcccagaagcaaaggagacccacagatgtggatgtagatatgttagtttactcagttcaaatggttgtcctgatcctgatttagtactgaagttcggtcctgtggacagcacacgaggctttcttctctggcacatcagattgactgagattgtctctttgccttcccatgtaaacatcagttatggggactttttctctgcccttcgtcattatgcagcctgtgaacagcgtctgggaaagtggtggtcattggttgcataatttgatctgaggcttatggaggaaaggacccaagtgactctgatgtttagaaagcacctatgaaaccctgtacacacctagttcataatcctcataatttatcaacaaacacaaagaagtgtcttacttgagagtgagtgtgtgcgtgtgtgcgtgcacacatgtgcacgtttgtatgtgtggaaataaacataaatggggacgtgttggagaaggaaatacatagacctacaactttgagcatatagcagtgatgttttaggaactgaaatgtcacacttaataaagtcttcagcccagctactt

SEQ ID NO: 114627 - DNA, 472 bp, Homo sapiens
tcattgtgtcagtctagaggattatgcatttatataggactttgtatttgttaagaggtaggtgggttgtattcatagtagtagaaaagtttttctagctgggcatggtggctcatgcctgcaatcctagcactttgggatgcttaggagagaggattgcttgaccccaggagctcaataccaggctaggcagcatggtgagaccatctctacaaaaataaaaaatacaaaaattagctgagtgtggtagtgcatgcctgtggtcccagctactctggagactgaggtaggtggattgcctgagcctaagagttcaagaccagcctggacaacatggtgagaccctgtctctacaaaatttttttttaaattagccaagcttgatggtacgtgcctgtggtcccagctactgggcaggctgaggcggaaggatcacttgaatccaggaggtcaagagccaaggagatcaagg

SEQ ID NO: 114628 - DNA, 278 bp, Homo sapiens
tggtctggctgcaccttcctacgaatatcctttgtgtatacacatttgatacacgtgtccctttagtatgtttttctcttgagtgtacacacatacacctaacacatctggaagatacttgtctctatcccattgtttcaacttaatacatttgagcttttgttgtccacgtgtatacagcctcgtgtataatcctggacaatcctgaattcccccagggtctcagaaagtggggatgtaacccatttctggcatttagaggctcaggtttccagagt

SEQ ID NO: 114629 - DNA, 948 bp, Homo sapiens
atccacaagcatttttcccatttggatttctgaaaatatcagaaatagattttattttcattagttatgcaaacctaccatttaaaatatgatagttcctttttaaaatcttattatatttattgatttattatttattccaagacatcttgttatagcaaattcctttcccttggtgttgattatggaattagactgaaggtagagaacaaacattttagcttctttacctaggcatatagcaaaagcagaagcttttgtgtttgcctgggcaatttttgagcggtagaaataatgggctgggtgctgtggctcgtgctgtaatgccagccacttgggagactgaggcaggagaatcgcttggacctgggaggcagaggttccagtgagctgaggttgcgccactgcactccagcctgggcgacagagcgagactctgtatcatttacaaaaacaccagcacagcggactttaggccttttatcattcacatcaggcagtggtcacggggctcctcttgtttgtgacccttttgtgtccttaggcctcgagctactgtccttgttggttgggtggttacctttaagtccctttgcacacgatttcggaagccttcctctgggttagtgggtggcggaatgtcagtcctttcctttcacttgccgtcacctggaactttctacccaggttagctcttttccccaaatttgaccccattttggttggtcacagtttaggcaaacccactgtcccacggcaatgtgcacgaaatgggcgctcttcgagccaacacaagaagaattttctttggaaactctttcccaaagttacctgctgggcctccaattgggccccacaaaaggttcctagacacaagcaagtgtgttataccccttatttctcatatggacacatctggctcgggagcgcatttaacctatacgggag

SEQ ID NO: 114630 - DNA, 507 bp, Homo sapiens
agcagcaagaagtcagggtccactgaaaagtggttaagtgttactaatatggacaatgttgactgggcactttctaggtacccagcactgtgctagagttccacatagattgtctcactgactcctcactgatgcggtaagaaccctctgttcccattttacagagtaagaaactgaggctcacacaggttaagtcacttgcccaaggtcacatggctagcaagtggctgaaccaggatttgaacccaggaccatctgagctccagagtgtatctgaccccatagactactgtctcccacacctcagtttcccttctcaagaaggaggaatggggtggatgctctgcgatgtctcttctgctgtgactctggttctgtgatgctgagtgtctgcaaggtgcctggacccatgttcaccacccacttcctcctgcttcaggcttttccatgttgtgaccaagcctcagtggctctgacgcctctggatggcacctgtggtcagagctc

SEQ ID NO: 114631 - DNA, 421 bp, Homo sapiens
ctaagttaattattactagaggaacaggcctaagactcatgcatataggaatggaggtaaggtgctggtagcactagacagatgatgcataatacgtacaagtcattagatgaagaagaagtacctgtgccctagtaaatgaaaaacatgcaggtgaaactagcagcaaaaacttgtggaaatgtctgttccccaaagaaagaaagaatttggatagaacagaactaagagcaatgaaaagatttaagtaaactccagaattcacaaagaaaatgttctcaagatatgtatacgaactgagctttagcagaataagtgtcagactttattgaggcaatacaaagataaaggcattttggcaatacctaaatgtaaagagaaaccacatttgactgatgtaggtaacaggaacacggatatt

SEQ ID NO: 114632 - DNA, 643 bp, Homo sapiens
tgttacccaggtgggtcttgaactcctggctcaagcagtcctcccacttttgcctcctcaagtgctgagattacaggtggaagccaccgtgcctggcctacaagtcactttagccaggtgattgtttagttgaagtttcatattgccttgaaagttgaaaagaggggtgaaaaaattgagcttagaaagggtaaacttgttttcaatattttttgaaaagctgatggaaggagttctatgttcaactctgtaatttgtgggcccaaagttcctttatttcaaggctctagaccattaactaattttttgggagattgagaaagtatgttagagagagtgcaaattaaggaacctcattggggccaggtgtggtggctcacgcctgtaatcccaacactttgggaggctgaggcgagcggatcacttgaggtcagcggttctggaccagcctgaccaatatggggaaaccccatctctactaaaaatacaaaaagtagctgggcatgatggcgtgctcctgtaattacgcttcctcgggaggctaaggcaggaaagtcgcttgaacccaggaggcggaggttgcagtgagccgagattgcactgctgcactccagcctgggccacagagcaagactccgtctca

SEQ ID NO: 114633 - DNA, 190 bp, Homo sapiens
agggaatacagaatttcaatgttgctgaaaagtaagatgattggggaaacatttctgaactttgctgtaaaaagaaaaacaaacaatactagtggaaatttaaagggcagacaaagaaggggaaaatcatttaaagtgagataaccttgcaaagatctgtatttgttttctattgctgtgtaacaagtta

SEQ ID NO: 114634 - DNA, 269 bp, Homo sapiens
tatgccatctgtggccaaggaaacaagcaaagccaagccaattattcaaattggaatactcttccacagccacaggcaatggagttgatcctatcctggagaatcaagctcattattacatggctctggacctatcagagggcattcacatgacctggaatagacacaaggggagtcttaaaacatcacgacaaattagccggcgtggtggtgggcgcctgtaattccagttacttgggaggctgaaacaggagaattgcttgaacctg

SEQ ID NO: 114635 - DNA, 926 bp, Homo sapiens
ggtgtctactaaagcctgggggtggatgggatctcagaagggggactagagaaataggaaactggggacagaacccgggggtgagaaagaagacagcaggtgttgtgggaagtcagggaccccaaacggagggactggctgaagccatgacagaagaacgtggattgtgatgatttcatggacatttattagttcccccaaattaatacttttgtaatttcttatgcctgtctttactacagtctctaaacataagttgtgaatatttcatggacacttatcacttccccagtcaatacccttgtgatttcctatgcctgtctttactttaatctcttaatcctgtcagctgagggggatgtatgttgcctcaggaccctgtaataattgcattaactgcacaaattgtacagcatgtgtgtttgcgcaatatgaaatctgagcaccttgaaaaaagaacagggtaacagcaattgttcagggaataagagagataaccttaaactctgaccactggtgagtcgggcggaacagagccatatttctcttctttcaaaagcaaatgggagaaatatcgctgaattctttttctcagcatggaacatcccctgagaaagagaatgcacacctgggggtgggtctctgaactggcccccctcccccgggggcgtggtcgtctcttatggtcgaggctgcagagatgaaataaactccagtctcccatagcgctcccaggcttattaggaggaggaaattcccgcctaataaattttggtcagaccggttgctctcaaaccctgtctcctgataagatgttatcaatgacaatggtgcccaaaacttcattagcaattttaattttgccttggtcctgtggtcctgtgatctcgccctgcctccacttgccttgtgatattctattaccc

SEQ ID NO: 114636 - DNA, 642 bp, Homo sapiens
ctggagtgcagtgacgcgatattggctcgctgcaagctccaccttctgggttcacgccattctcctgcctcagtctcccgagtagctgggactacaggtgtccgccaccacgcccggctaactttttgtatttttagtagaggtggggtttcaccgtgttagccaggatggtctccatctcctgacctcatgatccgcccaccttggcctcccaaagtgctgggattacaagcatgagcctccttttgactttcatacttgtaaactgtcagatattatgttttgctactatcagtatgctttgtctatagcagcttctgctaatagttgcttttcatctcgtggatttggaaaaccaggtttgttataattatgtataagcaaataaataggcccagagtgaagacttgagagcaaaatgcctgaacacatgcaccttatttttgggggctgtttaaataactttgtgatgtactttcagggtttgggttgttttttgtttgttttaataaaaggtatgtaaaagagctgaactgtaaataggtattactgtatctcagggaggtgtctgcagtattattagtatttaaggaaatcatacttgctgttgacagtacctgtatcattaaaggctcacaaaga

SEQ ID NO: 114637 - DNA, 304 bp, Homo sapiens
cccctctcgctgttgggctgtgttatctacacagcttgtcgacagggctggaaagtccccaaggttggactctgccagctccccagctccgaacccatcacccaccctttcagcatggccacagggctctcatgtggctcttgtcttctgactaaaaaccatgataaggcgctggcctggggcagaggaggctggaggctgtgagttcacgatggagagtggggcagggacggactctgagtttggcatggctccaggagtcctctgacgtttcctgcccaggtggccatgcgtggattgccag

SEQ ID NO: 114638 - DNA, 438 bp, Homo sapiens
ataaacatatgtgtgcatgtgtctttatagcagcatgatttataatcctttgggtatatgcccagtaatgggatggctgggtcaaatggtatttctagttctacatccttgaggaatcaccacactgtcttacacagtggttgaactagtttatagtcccaccaacagtgtaaaagcaaatgaattcattatcaacaaaggtgccaagaacatatattggggaaagaatagtctcttcaataaatgggatgggaaaactggatgtccatatgcaaaagaatgaatctagacccctatctcttgccatatacaataataaaatcaaaatggatgaaagacttaaacctaagacctaaaactacgaaactactaaaagaaaacattggggaggccggcagccatgagtcagggttggcgtggtctgtgcagtagccggtc

SEQ ID NO: 114639 - DNA, 627 bp, Homo sapiens
gatttgggtggggacagaaagcctaatcacatgaaatagtatcaaactatatatgctttgacaagacagaagtaacaaaacaaaaaagaagggagagaggaagaggaaaatacaaagaactccttgttgcttaggcaatatgtagaagtcaaatagtattatttaaagttgacaaaccaagtatatgaagtgtaagtaaggaaaaagggagatttagagcattaaaggtgtactatactattaatagtatagaatacatagtataattactagaataaaaatgtaaatcatcaatgctcaaagaagcaataataaagattacagtgaaaaacatgcagtaaatgtaccatcatacagtaaatatattaagtccaagcatataagttaaatcagtacatgtgaaaggacttacctattaaaaggaatatcagattggcttacaaaccaatgtcttattgtctgttatttataagagacacatctaaagtaagtgattcaggagaggctaaaaaaaaagagatgggcaaaaatagaccagacaagtaggaccacaaaaggcaaagattacagtatccatatctgaaaaggtagaattcaggaaaaaatagacaagacaatgaaggatac

SEQ ID NO: 114640 - DNA, 275 bp, Homo sapiens
ccagattggagagatccaaacaacacagggagacttgcttactgtggagcgtttgtgttctttcgagtaaatccaatagcctgtttacctccttggaccattaagataatttttattatggacttagcaatgacactgaatccatttgtatttaaaactgtttaaaatgtagctgttatgacttggtcaactatggaagtgaagaaggttcagaattcttaagtcatagcttaaaaatatttactgtactttatctcactacaacagcaccacaa

SEQ ID NO: 114641 - DNA, 403 bp, Homo sapiens
agcattcacagactaagctaataaattgccccaaagtgtcctctagggaaccgaaatggacaaatggccaagaaccatggcgtgtttttggatgagtgagcagttttcagtacattgatcatggcggattcttttaagaatccttggccttttccttggccgttttcagaatcgacacagattctgaatcaaggagggcccagttgagggagatctgcggtattttctggctgtggtgagtacaagcctgaagtgcgggattgaaaagaggaacccggctgcagttatcatgattggacctccaggcacagctgagctttgtgaatgtgaggcttgatgcttcccaaggacagatcccagtagaaaaggaatctgctcgctctgccttggatcattagaacct

SEQ ID NO: 114642 - DNA, 931 bp, Homo sapiens
aaaccttgaggacattatcctaagtgaaacaaaccagtcaggaaaagacaaatgtcatatggttccacttatatgagatacttagaggagtcaaattcataggaacagaaagtagaatcgtgtttgccaggggtttgagggaggggttacggggaggagtatagagttccagatttgcaagatgaaaaatttctggagatacatggcacaacaatgagaagatacttaacactgctggattgtatgctcaaaaatggttaagacagtacattctgtgtgtgtgtgtgtgtgtgtttaaccacagttgggagaaaaaaagatactctttttaccttctctggccagcccagcaagcaaagagctctccctttccagagcctctgaagtgcttacactctttactgctgggcccctaaactaacccactacctcttcatgtattcacatgtggtcttcctttggggcaagttgtttgaaatcagcaataaaatttttgccttttattttccccatggcacctaacacggtgatttacataaattcagccaattcagtctatcagctcaattaatatttgctgattgactgaattcatacttcccttgataaactttggatggtgggctggagggtaatggatgatgaagcagcaaatacagagaaaggtaggaggtgtcagtccaaactgtaccattttgtaagctccctgctattttgcagaccttggtcaaagtgaaacatttcacaggggttcggaccgggagaaacatcctgcctgaccacttgaccacaaggcagacaaaggcccaactaaagaaacatccctatcatatctggctgggtaaaggtccaaggaacaccacgatgacatctccccagaacaagggctagaactgcctcatcatgggaacatcttaccaatatcctacag

SEQ ID NO: 114643 - DNA, 440 bp, Homo sapiens
gatggagggcatttctgcagggggggcagtgggatctcagacacagcagaggctgcaggggaggatggagggcatttctgcaggaggggcagtgggatctcagacacagcagaggctgcaggggaggatggagggcatttctgaccccttgcagcactcactggtaaacatggaataaggtgactctcatttaggattttttttaactttaaaaggctaacatataaatagtagtttgcaaatttagggattttgggagaggtggttaagactaaaagattataaaatgaggactaataacttaaaagccattatgtaatggtaatcaaacaagaaaaaaaatattttaccatcatgaaccagctataatttggggagtataacatggtctttgggttttatgctggatgtagacctaaattccacatttcttaaaatcc

SEQ ID NO: 114644 - DNA, 245 bp, Homo sapiens
agattttgcaatggtgactcgggcacagcgtgtctccaagaagtaactgactgaccacttgaccacttcacccttagggctagctcaaggacaaatttatgggacctattcccatcctctcccagtggacaaacaacattcaagatagtacacaagcagatagatagggcattaggccagcagatgttagttactagaaaacattttcaccaaagaacaatagaattctgatcaaaaaaccaaat

SEQ ID NO: 114645 - DNA, 304 bp, Homo sapiens
ggatagcacccattccttcatttaatcattcactcattcattcttctctacagtctgtctaggtgctgagtagtaaacacaacagtggaaaatatatgctccaggaatattacattccctagaggaagaggacaataaataagcaatatcagggataagtgctaaggagagaaggtaaaacagggaaggaagataagaatatgtatgtgggaatgggatgctgcgttcaattttaaataaggtggtcaagaagactgcactgcaaagatgagatttgaggaaagacctgtaggaggtgagggag

SEQ ID NO: 114646 - DNA, 173 bp, Homo sapiens
agcatgagttttcccttgatttgattcagttctgttgggtacttcaagctctttgggcttaaaaggtatgtggagaatttaaagagagtttggaggagaataatgaagatgaattaaggattggaaattgggacctattagaaaaggtcaaaggcacaaggattatttagttt

SEQ ID NO: 114647 - DNA, 484 bp, Homo sapiens
cctctgcctcagtctcctcttctggaaagtgggattggaaaccacatctgcttctctcccaggactgctaggaagacaagattagatggcaggaaggaaaatacatgtacagccaacttccttgaggattcgttcttttgcatcagggtgtctcaaactcctgcccttaaaacacctgcaagagaatcatccaggtggcttgctcactctgcatgcagaccctttagaatcagagtcagaatccctggggctggagccacaaaatgaaatgacatttcaacaagtttgtcatcacgtaagagagaatagcttgtcttcttctctcccagtagattcttcatgaagaggccatgtgctatattccatgagatatttcacactcaaagaagacttcttttatactcttttgataatttgtctgggaatcactgtcttgatttataagggagtttgtaataaatacagtaaaagagaaacacacaac

SEQ ID NO: 114648 - DNA, 444 bp, Homo sapiens
ctgtcagagagctactctactgtgaagcattctaagtgagaaacaagccgtgggcaggaacctctccatgttccgttgatagctgtcaggagggagagggtttacagcaaaatcacttccgctacttttacttggggtttgtgccaaagcgtgctgatccttcaggactctgctcagatccagacttcagaatagcgaggtgtggggagctgagggtggaagggcccctggaggaagtgctagctccatgagtctgcggtgccatgcaggtcaaggtagtgacctgtgtggccctacgtgccaggtgatggactaggggaattgcttgcacaagccctggaatagagtagatggtaaataagtgttaaattatgtgtaggaatgtgacagcagaaaagaggtgccagataatgtttccatattggttgcaattcaaattagctt

SEQ ID NO: 114649 - DNA, 364 bp, Homo sapiens
gatgaaggccttggatatttctccttgtagggggaatcagttgttctgaagaactttggtgtttgccttaagatgatgagtagaagcttctctgtgacaactgcatttcacactcatgaaaacattccagtaatattaaccacgtggctcttgtaatcttaaaaagtcccatattgcttcagcaattttgtcaagggggttgctaggaaaaaaagggaggggtggcagaatgtcaattttctttagggtggcaataagctcagctaagattgtacatttctcagattccttgtagtcaggggagacctttggcaattctggctaatgagaagtaagcagatgttacagggtggggcttccagga

SEQ ID NO: 114650 - DNA, 952 bp, Homo sapiens
ccacgaaggagttcccgtgccctgggagcgggttcaggaccgctgatcggaagtgagaatcccagctgtgtgtcagggctggaaagggctcgggagtgcgcggggcaagtgaccgtgtgtgtaaagagtgaggcgtatgaggctgtgtcggggcagaggcccaagctctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttcaaaaacagactgtacgccaagggtcatatcttttcttgtattggtttgtgtcttggttggcgtcttaggtgttaatcctacagtagacggttggggaataggaagtaacatgtggcctgcacgccataggagaaaaagcgagcatcagccgtatcggctttgtaacacaaattagctatcgtgaagtccgctcagctcttccctttctaccctggctgctttttgcagggattggtccgtggtctccagtctcttgggttctcaccctgtgtgaaaatcttcctgtttttccctaccccccaagtcacctcttacacagcctctgcttccaaacgcagcccccacaggagtttgtaggatttctgtgctagcggggaatgtgttctcacctcatagagccaggtagaaattatgcagatgggcgctgttctctgggaagaaagcagggcctttggggctctcagtgtccccgttgggttgtagacataacacgcttactttgcgtaggggaacggctctgccggcccccaggtgccctagcgcatatgcacggaggcccgcaggtcagaaccgcagtctcacctgtcttggcggaaatgccct

SEQ ID NO: 114651 - DNA, 324 bp, Homo sapiens
ggaatacctaagtagaatggcaatagtctataaatctatgccagttttccaaatggaaaattattaaattttttttaattttagaactcctcaacaatccattattgaaccgtattgaaaatctggccaaataataaaagcacaaagagtagaatttctagaatattcatatctacttcttactaccttctttttcatcaccaaagcaacttaaccatgtgtaagcaacaattttattccttaaagaaataatgaagccaacagccataattagggataatgtgtaattttttcctaaatcaatttaatttcagatagaattcc

SEQ ID NO: 114652 - DNA, 391 bp, Homo sapiens
ggggttgtcagtccaggtaaaaaatgagttcagtcctgaacatatttgctcagtttgagatcaaagcaagacagccaaggggaggcgtcgcgtggaaatgtgaagacgttgaactggagttcaagaaggagttctggagtccccttcagggagtaatggtgcatcatggagcagacccccagtggaagttagagagtgcaaagaacaaagagaaccacgcagagctgcccctgcagctcacccacactgaggggcatgggaagaggaagaagacagaagcagagacacggaaagagcgctaggagggacccatgtcccagagttaggaccaggagaacaatggagggaaacgaggctggaaccagctcactgtgtaccagactatcaaagt

SEQ ID NO: 114653 - DNA, 796 bp, Homo sapiens
ctctgttcctgtatactgcccatatctcttcaagaaatgatgactggtttcctgagctaccccgctttctatacacacacacacccctccacccgagaatgcagattacattttcccttctgtgcacacctctctcagtttacagcatccatacttagattcctcagaactttagtacgatgataaggcatgaagcagagacttctgttgatagatggaaactgaaatgtattctttagggtatgacatcaaaaatgcatttattttttcctcttactgtattaagagttggtaatctgaaaactctgatttccaaatttgtgaatggttgaactacagatactactgtatcagtgttcttaccaattgcaacagttaattcagtgcaggggttttgatgtatgtacagtcctattttaaacatgacacttccctcccttgccccaatcatttaaaatctacattgcttaccaatgttcatttctgatttttgttacagtctttcattggtttttaacttgacatgctagtttccaagatgtaatcttacacatttgactgttttgtcactggtccaacatacctggtgaaggaataaatccattaggtagaaatagttgggttttttgttttgtgtttttttttttaatagaaagctttggttaaaaaaaaaaaaaagaacagggtattttaaaattttgtgtttgaaattaaataacagttttccaggcatatgtttaaattactgagatgagtacttttgaggagactactatcttaactgaaaattttaatt

SEQ ID NO: 114654 - DNA, 938 bp, Homo sapiens
ctcccggagggggctgggaagtaagcgagtggaggcggagtcggctgtgcccctgacaggttagtttgtgtttgtaggcatgatcggagcctcccccatagtccagtttgtgtgtgtttaattaagggataagagtggtcgaggacacgatcttgagaggggattttacctgtgtgacaaggtctgtggtgtccctgccgcgttgaacggtatgtgggaacgacaggatgatctcagtgttgtaagtttaataaatgtcactggttagtttgtacatggaaagagatgtttttggtctagaagacagatggtctgttggtgtgtagcggctgtgttggtgtgtgtatgtgaggatggcaagtgtttccgtaagagtttgcctttatttgtgtaagtgtaatggagttccccttataagttagcttatttcttgaataaatgttgggaggttccttgcaggttgatatgtgtgtgtattttagggattgggagcccctagttacttgttgggaaagagcggcaatggtagtgttctgtacagcatgtgtctgtgaggtcagggaggggagaaacttggcatagccagttgtggtcttaagaatagtttgtgcctttggttagagtgagttgtgtaaatgtgaagggccaaaatatctttaacagaatcattgctacaaagctgtaaagaatgggtggccttatttgttgtcgcgggtttatagtaatagtttacaatacaataagaaagctctttcagtttctttgtgatactgaatctctgtgaaaatggtaggatgctttcttccattttacaaaataggaaatttaggcataaggagagaacttctccaaggccgcatgttaaattggtgacaaagttggaactgtaactcccatattttcactactactgcagcagtatattcagcataccatgg

SEQ ID NO: 114655 - DNA, 249 bp, Homo sapiens
gtagaactaagagaccaagagccatggattattattctcaggccttgcttcaagggctttcctctaaagctagagaccgagaactgaagcccaggtcgcctctgctctggatccccaaatccatgtgagggatctgtcttttcccaaccccaccctccccgtctggcatggcctcaagggcagaacctagcatcttagctcttccttctcctctccaaatctcccagcccagaaagaatgtgctgctgt

SEQ ID NO: 114656 - DNA, 299 bp, Homo sapiens
tctagaggatctccgtctagcctcgccagggtacacacaatgacaaaagctgctgcaagttcccctgcgggcacggttgtaggcacttcatattcctgtgttgatttgctcttcatttcaactctgtgtgtgtgtgtgttgggggggttatgatcaccacccccatttacactgaggaaacagaggcttgaggagtacatgacccatccaagaccacacagtgaggaactgtcaaggaagatctgaaccctcgtctgcgattctccagcttgcagccttaagcagccacctgccctgcc

SEQ ID NO: 114657 - DNA, 186 bp, Homo sapiens
tcttcttcctcagtgtgtatgtgtgtgcgtgtatagcatgactgtaaatacttataagttaatagttttctcctgtttatatacgcatgtacacgaggaaataacataggctggaaagggatatcgttcaggctggcagagtctgagcactaactatgtgccatgtactttatttacacacattat

SEQ ID NO: 114658 - DNA, 567 bp, Homo sapiens
  misc_feature (3)..(3): n is a, c, g, or t
  misc_feature (57)..(58): n is a, c, g, or t
  misc_feature (67)..(67): n is a, c, g, or t
  misc_feature (73)..(73): n is a, c, g, or t
  misc_feature (106)..(106): n is a, c, g, or t
  misc_feature (564)..(564): n is a, c, g, or t
ccnttaaaaaatatttattttccccctgaatgcttttccttaaaaggctcctgccanncaagcttcnaaggtnagaatgtttggtttccaacacaggacctccctntgagacctcacgggaaaagactatgcaagagtcttgctgtgtcacccaggctggaatgccgtggcacaatctcggctcaacctccacctcctgggttcaagtgattcttctgtctcagcctcctgagtagctgggactacaggaagagtgcacaggagcctggcactcctggacctgaggaaaccctgaaactgttggtatttgcagatcctctccaaaaagagttcaccgatctcctaagactgcaaacctgaccccagcatgctgggagccaagagggtctgcggatctccctgcttagcaaattgtgtgtatatatatacacacacacacaatgaaatactattcagcctgaaaagaagaaaatcctgccacttatggcaacagggatgaatttgaaggacattatgttaagtaaaataaacccatggcctcgtggcctcagcggggagctctcngcc

SEQ ID NO: 114659 - DNA, 326 bp, Homo sapiens
gttacatgcagctaagccaacaatagatcagtggttgcttatttaatatacataatactacctatacttttatctttacctaatacatatgccatacacaacgattttaaagttgtgattgagttgagtgaaaaatcttttagaatacccacgaacagacataaaattttcattgatttctgtgaatagtaacaacaatagcagtaaacaattgaatgaccctcttctcaactgggattctgagaatgggtttcaggaagttttcgtttttatgtgtgttctgaaactatgcaattcagaaaggaatgaagggccagacctgccat

SEQ ID NO: 114660 - DNA, 397 bp, Homo sapiens
ttgctgttgggccataggaaggagccactgaggataatccacagacagcattatagacattttagaaagagaaataaaatatttcccaagtcttcattcaatccagttgaaatacagtggctagtaaaatattcttaattcagacctaaagtaagactgtcattgttgattttgattagtatttccaagtggaggtattaatccatgttgcagaaatttgaagtgtttgctatgaagagtattttctttgtgggtttgtactagttatttctttaaagattttggaatgttagactaatacaagtagaagattgggaacactagtcacacgtgtaagaagtgaagaaaacttttccttatttctctgaaggtaaaaaactgttaggatggaggaaga

SEQ ID NO: 114661 - DNA, 677 bp, Homo sapiens
actcaccatcacgagaactgcatgagggaaatccacccccatgatccaatcacctcctaccagtccctgcctcaacagttgggattacaattcaaggtgagatttaggtggacacagccaaaccatgtaactgcatagcaaaatctctgtcgtttaaatataaatcttaatgactttgctgttttttaaaaaattaaagtatacaaagcaaatgtgtaacaaaaaagaaaaaaacaacaacaatgacctaaaaagacaggaagaaataatacatataaaaggaaaaataataagaaaagaaaccactcctaggagacttgtgccatggatactatggcccctcacccagtcccccttcaggttcaaggctgttgctgggagtaattattggctgttgatggctcacagctgaatccattttctggaattgaccttggttaaaggaagttgcctcaatacatttatgtctcttcttcaagggtagcccacaatccaatgactgaattcaatgcagcgattcaaagacccagccctggtgccttggattggtacatctctgaatgctctttcagcctcaatgctccccctggagccagctgaggctactgatgcagctgcatttcagtttggctttttcctctgctcagtactattttctccctggcttcctcaaagga

SEQ ID NO: 114662 - DNA, 666 bp, Homo sapiens
caaatgttatattgaattttacaagagaaccaaatttactttcaggtaaattttggtgaggaaaattgtctttagcattggattttctgtcatctatttgttcttcatactttgtcagtatttcattaatatgtaggccgggcacggtggctcacacctataatcccagcactttgggaggccaagtcaggtggatcacctgaggtgaggagtttgagaccagcctgaccaacatggtgagaccccgtctctactacaaaaaactagttgagcatggtggtgggtgcctgtagtctcagctacttgggaggctaaagcaggggactcacttgaacccaggaggcagaggttgcagtgaaccgagatagtgccactgcactccagcctggtgacagagcaagactccatctgaaaaaaataaataaaataaaaattagctgggaatggtggtgcacacctgtaacccagctacttgggaggccaaggcaggagaatcacttgaacccgggaggtggaggttgcagtgagccgagagcacaccattgcactccagcctagacaacaagagtgaaactccatctcaaataaataaaataaataaatacataatacatatttctctttatgttcaaaacaaaaaacacacccacacacacaaacaaacag

SEQ ID NO: 114663 - DNA, 138 bp, Homo sapiens
gttttactctatgttccttctgcatagcctggcaactctctctagacagtattgctgggacagtcataggactcagttttaaatattttaggcattgtagccctgtctgcctgttttcccatgcgtggatgccagtgt

SEQ ID NO: 114664 - DNA, 205 bp, Homo sapiens
tctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctc

SEQ ID NO: 114665 - DNA, 805 bp, Homo sapiens
catgattccagtgccactgaggggaaaatatgtttggcaaccctagtagatcgtattcctttatttacataggcatccacttttatacatatatatgtactgagaacttgccaaattcagggcttggaactagggtgttagaaatgtaaaaataagctagtaatataaaaatataaaaataagtggagtagttaagctcaattgacaaaaacctgtagtttaggtagaaggtgattataagagtacaaataaagtattccaagggttcagaatagaaaatgatttcttccagcttggggacatttgggaaattgggatatcctttggggaaatgtagtaatcagtatattctgggaaaacatagtagagaatgaataaataaattccattgaatttggaatatgttgtccattctccctgtaactaatgctatcaagataaagtagaaataccacatttcagaaacagctggagtagacaggtcttcataggctagcttggaaacctaatagctattaataatgaaattttaattatactctggattctaaacaatgaacacacagtgatctttttgacttgctgcttgtttataagttggggatggtctgaattcattgttgattcaaaagaaaacgaatagtgttttaaaccttttatttacagagactataatttgtcaccttcctaccaacatatcttaaatacaccaagaccttttacagaagcttaaacaagggtgtacagctcttgttttactcctctcccaccaatctgctttagcttatctggactttggtatgta

SEQ ID NO: 114666 - DNA, 229 bp, Homo sapiens
tacctcaacctctggttgctccgtgattttgtttgtataatgaagtcacaacccatcagagtaataagggccttccgtaaaaatctccctggttttcaacaatgcccttagacagggagttccctgagctccaaagaagacttgtccccttaggcagagctttagatgtctttattcttatggtccacaatccccctgggcagaaatcttgtcccactgcacaggaact

SEQ ID NO: 114667 - DNA, 330 bp, Homo sapiens
gatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaagg

SEQ ID NO: 114668 - DNA, 245 bp, Homo sapiens
cacagcctacctgtgtctaggggtgacctggacaaagctgacccaaggatccatccaatacagtcagcctggattgaaggacattaaatcctcaatcacagagtatagctaacgaatgaaacaaaggcaaataacttggagtagataaatccagagagttatccagtaacacaattcaattttattctcaactacagcaaattccaataagcattttgctcttccctggctataactgcacacat

SEQ ID NO: 114669 - DNA, 594 bp, Homo sapiens
agagatcatggccaaaatgagctaaaatcttcagctagaaggggaaaagcttatgggccagtgccagtgcctaccctgtagttcctgagaaagctgagagcaggtgacccacttctggcctagcagaatgagctgctatgcacagcatgcagctgcaggggtcacttcctgagctggccaccagacctcggaaaagctaacctctcaggtggtcttgaagttaggttagggcatccctaaaactctgggtgcttgtggcttctgctgaatttagccatgccagggctgtggcagacactctgtaggccacactgccatgggacagggaataatttgggtgatacaccactgcaatttacacggggtctcttctcagcttggatgctccctgggaggcccagtgcttctgtcctgtgaattctgcatgtgattacccatgatttctgtcataggcatttcccactcttctgcttgcttgagaaggacttggactgatgggacactcagggtctagcccagggagcatatgcttggctaacctaatctccccttgatgtgtatacagaactgtggaaaagcagttggtggatccca

SEQ ID NO: 114670 - DNA, 370 bp, Homo sapiens
catagatacccaaagacagtccctaaattagaatctctttgctgactcttaattttcaaaatatgaaggcacctgattctgcttctccatctccccactgccatctgaaaagcttaatgtggaaataaatagttattctctaaacattaagcgatacaaaagaaacacacttgataattatattattcatcagacactcaaattgtgaggtgaattttctataagataatagaagcagggctgggaaggagagagacttagaaggcatgaagctactcttaattttgttagctttaatcccaattagccgcctgtaacattatcatgctgcttgtcccttggagaaaattcatggtacaaggtgaaataa

SEQ ID NO: 114671 - DNA, 425 bp, Homo sapiens
atcctagagcttggcatttctagtagctttttccagtgcaaacattctcaaatctgtactagtttccattgctgtactgaggtgtttggttgccacaattaagcaagacagctttttcccaatttgcttgaaaaaaatactgtaattagtctctccctttcataaaattttcttaagaaattgctacttctgataatactgacagaaggtaacataataaatactaaactaatactaatggaaaaacttagaactaaccatgtttaacttgagggctttaaaaatggttacttgtgcttaaactctgatttttatattgtacatttatatatgctatttgtgtatatttgaatatatgtatgtacacataggcatttttttggttagtaaaattattctggctgggcgcagttgctcatgactat

SEQ ID NO: 114672 - DNA, 602 bp, Homo sapiens
caggctgcaaggtcagcagtgacagcagctgctctttattggcccaactatgtggcagacggtttgcctgatttttttttttctagttatcctgacagcctagtggtaggagcagtatttttattcccgttttacagatgggaaaatgaaggcccagagaggttacctcaccagaatcccgtagcagaggcagaaagaggctggcaggtgcacagggtcgtctggctgtggggttcagaacctttctgcatcgcagggcccctccatgcatggctcttccaggacagaggagagcaaagaggtggtggcaggggggtggcagaaggctatgactgtggctgggttctgccgtcaccctcagtagctatgggactaggcagggtctgaggagctgagggccagacatggcccatctgccttggtgtgggggacagactctcaggtatccttggaagccccaccccccggtgctcatgccttcgtgcagtcctcacctttggtgtggatggcattcgtgaccagctcctagccagcagactgtgcaaaagcattgggccatcactcccaggattacactgtgctctgtaagattccatctgcta

SEQ ID NO: 114673 - DNA, 309 bp, Homo sapiens
gggaaagagagaggtggagggagctgccgggcctcagtggaggacggacttggggatgggtgtggggtgttcaggcaatggatgactggtcctgggctgaagccactgtaaaaatcccagtgaaccgtgccaagctctctctagtcaccctcaccgctgatgacagcaccagatcacgactccgtgactccgtctctagaggaaaggatagcccagccgaggcagtggctctgccacgtccacctggccagcactcagtagaggtggaagccaagcctatggtttcacccctgccagccactccctgcc

SEQ ID NO: 114674 - DNA, 277 bp, Homo sapiens
ctttaaagcaatcaaagtggtggaggagattgctggagatattgatggacagaggttagctgtgtgttggtaattttgaagttaggtgatgtgggtacatggaggtttgcaaaaccattttatatggttttgaatttttccaaaattaaaagaaagagagaaacacataggagtagtaaaaatgaaaaccccaaagctggtggcagcactttggagggacttaaggacacgtcccgtgcacccatgcctctggctttacctcatgggggcaccgatt

SEQ ID NO: 114675 - DNA, 357 bp, Homo sapiens
cagcctaactggccctgggagtctgcagtgtgaatccaccaggcctgagcaggagcagctgggtcagcctcttctctgttgcaggttgtggggtactgcttattattcacagagcatagcagctttgtgtggcttttatctggctccgtacaaccttcttaaggcttaagcgctgggatttttttaacaaggctcgagcagaagggccctggcttcatctctctcccgtgagcagggcacacccggaactgctctttggagtaagtgtttctaaatctgttatatttgttcattgattgattgattgattgattgagaccgagttttgctcttgttgcccaggctggagtgcagtgg

SEQ ID NO: 114676 - DNA, 485 bp, Homo sapiens
gtatttccccttccctgaagacgttcaacccaaggaaagcagccttttggggattttgtcacccactctacctttccagcctcatttctcactactcaaatcatcccaactctctatcccatcagagttccaagaggggaacgtacaaaactcaaggctttgcacaccctatttctaatacccggaaaatcccttaactctctggttaaaaaacaaatcctgttcacctgcaaagcagagccgcaacaaacatccattgaatgcctactacttaaggcctactggattcgtgatcagagcacagagtctggagccagactacttgaattcaagtcccagttttgctactttctagccacatgatctccagaaggtaaattacctgtatgataaatcatgtctcaggttcctcaactataaaacagagataacagattttctgcaaagggttgttgtgaggattagatgagttagtttctggggca

SEQ ID NO: 114677 - DNA, 808 bp, Homo sapiens
atcaacagctcttttgaggtataacttacataccataatgtatactcattaaaactgtacagtttaatgacttttagtaaattgaccaattgtgcaagcatcaccaaaatccatttctagaacattcccaccatccctccccacccccacaggacaaccactaatttgctttatgtcactatacgtttgccttttcaggacatttgatataaatggaacttatatgttctcttgtgatcagcttttttcacttagcataatatttttgaggttcattcatgttgtagcatgtattagcatatcatttttattgttaaataatattctgtttatgatatatcacattttattcattcactgatagatccttgggttgtttctgattttgattattatcaataatgctgctaggaacattaatatacaaatcaagtctttctgtggatatggattttcatttcttttgggtaggtacctaggagtagaattatcgggttgtgtggtaattttgcatttaacattttaagaaactgccaactttttccaaagtggttgtaccattttatgttctcaccagtgatgaatgagggttctagtttctctatatccttgccaacatatagtattgttagtttttttcttataaccattgtagtgagttagtagtgctatctcaatttcttcatgagtaatgatattgggcatattttcatatgcatattagccattgtatatcttctttggctaaatgtgttttcatattttttgcctgtttcttagttgtgtcattttggttttattgaattat

SEQ ID NO: 114678 - DNA, 369 bp, Homo sapiens
cctggctcgacttagggagggggaaaatgtgcgagggcctttacggtgtggcagtgccagctatggccccccagcagacaacaaggcacagtggggcttggggactgggggaggccagccctgtccgcctgtccttgacatcaggaggcttgtgagtggagtcctgcaacccccacccaacccctgtacaacgggggttccatttctgagacccccaaagtatggggcatcttagaggcccgccccacagctgagcatcatctcaaggaccttcccccatgacgggatcctaagttcagagccatggctctccaactgaggctattttctttgtgctccacttgtgcccacctccacccttattgcaga

SEQ ID NO: 114679 - DNA, 607 bp, Homo sapiens
tcttcagacaggcttattacaaggatgatgacgaagatcaacatgatgctaatcatgcccttattatttataatcatggtactgactatgggccaggtattatagtcacagttttcataaatcatctcatttaattatcataataatgaaattaagtgggtgccttttcttattcccactaaatagaagaggaggccgaagctcagaaaggttaaggaacatgctccagatcccccaggaggaaacagtaaagccagattcaaacacaggactggtttctaagtatacactcttaactactgcagctgtcagtcaaccaaaacttccatgcagctgttgagctaagctttctgtatcctatacctgctcagttggttttatttaaagtaactaaaaggtttgccttccccttagattcactcatctttccctcctacccgtcaataaggcctttggcacctgtaacctaacagctagtctcccctttcaggtgaaccgcgttatccatgggtctgatcagtatactttgcactgattcctattactgataaaactgtggaactggacaagacccggagaaaagccaccagctacctccaccctggag

SEQ ID NO: 114680 - DNA, 198 bp, Homo sapiens
cctctttgactttctcgtccaatttccttcacttcactgagcttatttccatgttaggtgacatcctcagggtctgacaaggactgaataaacccctaactgatactgaatgattgaggggccaggtgacctttatacagatcgtgaggagattgggttgggtttggattgggtttttgagtttctgagctgagttgg

SEQ ID NO: 114681 - DNA, 752 bp, Homo sapiens
tacctgggggaaaaaatctcaagactcttttgggaaaaaggacttaatgttgcagaggagctctgatcacccaggtttggtgcagaagtttgcgtgacctttttctaggaagctgctgctcaccattattgcagcataccttttgcattgttttgctagtcttgcaaataggtttcaccaagccacccacacttcccagccatctttcctgaaactactgaatgcacctctgagatggattggggtgtagtctccaaggcacaaagctgagttaattggacgcggagactgaacctgtagcagtggcctcgttagcaccactgaactacccggacacagcctcaatgatgcaaggcacttttggtaagatgcttcctgcaggtgtccttctgtgcacatatgctcccttcttccagggctacttggacttgatgactaagaatgttgaaagaatgagaccctacagtggccaagtcatcctgaagggactggccatgactgaagcccaagttcttagcatgttcatgcttgagaagcaacacagcacagggcagagaaagagtacaaggtttggagtgagattggtctgtgtttaagtccatccctgctacttactagacaagagacatcagacgttacttaacctttgtgtaccttatttccttcccaggattgtgacgacaacacctgctgtacctggtggttgggtttgtgttaacctagccaaacccccagcacaggtgtggcacatg

SEQ ID NO: 114682 - DNA, 452 bp, Homo sapiens
cagaagcataaagtggccattattgtgaagtccactgagtgaccatttaagcttggtgttatgccacacactgtatagtgaatttcataatcctggtgccagatttctaaattattacagacaatagatgatggactgggcacagtggctcacacctgtaatcccaacatttggggaggccgaggcaggcagattgcttgagaccaggagtttgagaccagcctggccaacatggtgaaaccctgtctctaaaaatacaaaaattagctgggtgtggtggcgcgttcctgtaatcccagctactctggaggctgggatgggagaatcactggaacctgggaggctgaggctccagtgagccgagattgcatcactgcactgcactccagcctgggtgacagagggagaccctgtctccaaaaaaaaaaaaaaaaaaaaaaaaaaaaaaaaag

SEQ ID NO: 114683 - DNA, 142 bp, Homo sapiens
cccacctggcaggtagagcagtgacatatgttgagactttcacattttgtgccaagtgtcacgtcccagtgaacaatgatgtagcttcaccaaaggcaaaagtggcagattcttccctactctgtcattcataatgtgactc

SEQ ID NO: 114684 - DNA, 226 bp, Homo sapiens
gttccagaggatcccgccctgattagacatctatacacatatttaaggacctattatttaccctctatagtttatataagtatatattttatattgtattatatatttatacttttcatatttaatattgtttatgtaatatgtgaaaccatatgtaatatatacctttatattttatcttttattttaattttttttttgagaaggagatgtctatagttgccca

SEQ ID NO: 114685 - DNA, 215 bp, Homo sapiens
gtaacaaatataccactctggtatgggatgttgataatggggaaggttgtgggtctgtggggacaggggtatatgggaactttctactgttttactgtgaatcaattttactgtaaagtttattaatgttaaaaaatttaatgcacatgtaccctaaaacttaaagtataataataataaaataaatttaggcaatctgaaaaaatgttaataaa

SEQ ID NO: 114686 - DNA, 749 bp, Homo sapiens
cacgatttccctgataaagccataatttaaaacactgactcaaagccctaataaaggaggttaacttgctttctaaatctgctgcacagactgctcatctctccttccatcagcctcccttctcctaagccaattgtagaatttggaacaaagagaaaaagtgcaaggtttttttattgattcccttgttaaccagattctgctgttcagcaacatggtgagcatttgagttctggttctcagcatgcatgtgaaaaatcctcaagtcattttctaccttcagagatttgggggccaaacagggaataaattaccaaacaatgcttatcatgctcccaaacatttgctgaaatcatttagtttcaattattttaattactgaagattttataagcagagttcatggcaaaaacatctgccttcatgaattggcacgaaggaggatgagtatatatgtagaaataaaggaagatgagtatatatgtagagatgaaggaggatgagtatatatgtagggatgaaggaggatgagtatatatgtaaggatgaaagttaattagtatatatgtagaaatatatatatatatatgtatgtgtgtgtgtatatatatataaaataccagatgggtatgtatgtatgtagagatgaaggagtatgagtatatatgtagaatgaaggaggatgagtatatatgtagggataaaggaggatcggtatatataggagtgaagggtgatcagtatatatg

SEQ ID NO: 114687 - DNA, 856 bp, Homo sapiens
atcacagaacaggcagaggccgttcagggggtattctggttgccttacccagctctgaagtctgtcagcctcttcagatgtcacttgccctgtggtaaggaagtgtagttggcagctggtgcagtggcaagaagagaaaggaagttccccaagacagaaacatctcggcaggtaaagagaaattccctagagccccaatcatgggatcagctagttggaagcaggtggcattcctgggtagtttctttcccttccagtgagcagagcggttaagccttggtgtgcttgtgtgtctgattgccccattcatcggaaaccagaccgatggtttcaggaactctgagtgtgttgttcccctctatgtgtccatgtgttctcatcatttagctcccacttataagagaacatggagcatttggttttctattcctgtgttagcttgcgaagaaaaatggactgcagctccattcatgtccctgcaaagacatcacctggttcttctttacagctgtgttgtattccatggtgtatatgtgccacattttctttatacagtctatcgttgatggacaatttagattgattccatgtttttgctattgtgaatagtgctgcagtgaatatatgtgttcatgtgtctttataacagaatgacttatattcctttggatgtatacttagaaatgggattgttgggtcaaatggaagttctgtctttaggtcttttaggaatcaccacactgtcttccacaatggttaacctaatttacactgccaccaacagtgtatgtgttcctttttctccacaatcttgctagcctctgttgtttgtttgattatttgttatttgttattt

SEQ ID NO: 114688 - DNA, 345 bp, Homo sapiens
gcccgctcaccgacggggtgacagggctgtgccccattttcaggaagatgggaccccggaggaggcggcagcttgtggaggggcttactgaggctcaggtggctgcactgcatgtgtcaagccagggtagggcttcagggagcagcagagcagggaggagctcacacctcacacagcaggcagaggtgcccactgtacagcaggcagcctgggaggagagacctccgtgtgcagcctcctgaatgtccctggctattcagtgggctgtcttatctttttaaacctttctgagctcttaggccagtgccacaggcagaataaagctgcccaccccgtcgggtggag

SEQ ID NO: 114689 - DNA, 188 bp, Homo sapiens
tgatgtgacgtgtgcatgtgtggggtgtgtgtgtgtgcctgtgtacgtggtgtgagtggggtgtgtgattgatgctgatgtgacgtgtgcatgtgtggggtgtgtgtgtgtgtctgactgtgtacgtggtgtgtgtgagtggggtgtgtgatcgacgctgatgtgacgtgtgcatgtgtgtggggtgt

SEQ ID NO: 114690 - DNA, 758 bp, Homo sapiens
tccatgatatttatgtataatgttggttttgatatttttgtatatgtgaaaagtcgatacgactttagagcagctctaagaaatatgcaaagatacttccaccagccttattgatgagctcttgggtttatgatttgaagaatactattgtgtttcctaaacccttatggactttttgataaaataggaatggtgaagcctcaacctcctgccctctcacggtattttttctttctttctttctttttcttgatatgaggatttacttttaaggcggtgacatttacagaagataatttcttaaaaaaggtttttgtttagagactgggtctctctctgttacctagactggagtgcagtggtgcgattgtagctcactgtaaccttgaactcctggactcaagtgatcctcccatctcagcctcctgagtagctgggaccactggtgtgttccaccacacccagttaataattttaaactttttatagagatgagatcttgctttgctgcctaagctggtctggaattacaggcatgagtcaatgtgcccagctaagaacataatgtggttattagcagaaaaaagtattttgccaatgtagaacctaggttttatttttttgactacaaattagaattgttgattaagtataaaaatctgataacagaatattctcttcaaatatgcttcactaggaacaaccctccaatagtaaatgctatgttttcttattttcagtgtcttagaattatataa

SEQ ID NO: 114691 - DNA, 493 bp, Homo sapiens
attgttgtttttctgtgttcaaagaaataaaggacatttcactagaggcctatctgtactcgattgtgctacaaaataataatcttagatacctgaggaaaccattgctgtttagactgagactcttcatcattagcccaggcatctgcctgccttcctctcttcatgttattccagtgtctgaaacatattacagtaagtaatcaggggcttgtgctagcctactcaactggggacttcttgaggtcagggactcaagaatctatcttgtctttgtaaacctttgaagtgcctagaattgcattttgtacatggtagagaaaaagaaaagaattccaaggctgtacttgctaacttgctgcattttatgtagtcacataagcccctttaagtccatgctggaaccagtgtaggtagcatgttctcactttaaagctcttccagccaagaactttcctacgtttacttaattattagctatttagtaagccta

SEQ ID NO: 114692 - DNA, 247 bp, Homo sapiens
tggggagtagagaccagaaattctgctcaagaaggaggcgagggagacaacaaagatggtaggaaattttctgggaagaacaaaaggcagcaagaggcgtttcttcccttcagttcgggcctttcagacagctgctcctatgattgatggagatatttatttgctgcagttttcttggaatcaccaatctcttgtcagtgctcagcacccctcaggagaacactgctggcattataaggtgtgcatt

SEQ ID NO: 114693 - DNA, 381 bp, Homo sapiens
gccagcatggtgaaaccccgtctctactaaaaatacaaaaaaaattaaccaggcatggtggcatgtgcctgtaatcccagctactcaggaggctgaggcaggggaattgcttgaaccagggaggtggaggttgcagtgagctgagatcacgccactgtactccagcctgggtgacagagtgagactctgtctcaaaaaaagaaaaaagaaaagaaaaaagaaatacaaactctattctcaggaggtcaaaagccccttctgtgctccatgattatcttcaagcccacctttctgtcacttcttcccactttctcagcagggtgacttttcctcttcacaggcttgaggatatcaagttgaaatgtcctctgattataacct

SEQ ID NO: 114694 - DNA, 302 bp, Homo sapiens
ccctgagacccacccacacacaaaaacacgggctcccacagagagaaatacatacacagacacacacactgacatccaacaggtaatgcttaaaactaaggttttcatggagcgtgaatagtgttctccacagttattttgaggagaaggagcaagtgttctctcaaaggtacttttaactgagccagaaaatgaagcaaaaacagacgggctgccattgggtctgcagaacagtgaatgctacaaagccagtttgatttggattcctgtttctggaactgcttgttcctgggcattgtttt

SEQ ID NO: 114695 - DNA, 387 bp, Homo sapiens
tttaatccttaaatctaatacatttggagtttatcctggggagtgttatccaacttgattttttgttggttttttttgagacagagtctcactctgtcacccatgctgtagtcccagctactcggagaggctgaggcaggagaatggcgtgaacccgggaggcggagcttgcagtgagccgagactgcgccactgtactccagcctgggtgacagagcgagactccgtctcaaaaaaaaaaaaaaaaaaaaaaaaaaagaatgcctttcacatctcattaataaactcattccctgtaggcccgtgtctcacagatgtcagtggttagtatcccaactctagctgtgatcgtctccaaaattatgcagtctgcttttgtactggtct

SEQ ID NO: 114696 - DNA, 935 bp, Homo sapiens
ctgtggcaaaccatgaaagcaggcaagacagagcagctccattatttgctgaatccagtgattaattttcaaggcacactcaaggttttataaggattattcataaatttatacagctttattcctttaagatgtttatctctgtttctatatagaaatctggccttattttttcaaattcacctttggaaaaatcgaagaaactaagaaaatatcttcaaaattgcagaagcctcccaaacttaacaccaacaccctgtagtatctggagctgaattcagtggaggcataatttgtcccagccaattactaaaaaaagaaattgtttttagtgatctgtaacctcttaataggtttaatgactcaaatcctattttaattgcttaatcatgagcaggaaatacaaaacaatttatgcagacttgatgttttctgtctagtaattttctttaactctgcccccttctccaatccctgagctgtaataatagccaacatttgacagtgagtgggtgccaggcactgtgctaggaagaaagtgttttgctgcagcaatgtctcttttaatcttcacaacaaccatgtaagatagatatcatgagcctcatcctactaatgaggaaactgagacttagaaaggacaaagtaacagctagaaagtcaaggagatggaactcaaactcaggtgtgtctgcagctaaagtcaatatgcatccatctgttcatccatctatctgtccattcattagcagatatttattgccatctatcatatggctggcactgtgttaggcattaaaagtacagtagtaagaaaataaagatctcgttatggtatagatggtctagtgagaagagaacagcattaatgaatacaatagataaatataaattttaatttggaaagtactgcaaagatgacattttagtgctct

SEQ ID NO: 114697 - DNA, 393 bp, Homo sapiens
tgaaaatgatactgacaaggaatacatctagatcagaaatactgatatcctaagtgagatcttgttttttaaaacaaaaaaaagtttaagaaattgtcatataggctgggcgtggtggctcacacacataatcttagcactttgggaagttgaggcaggagggccacttgaggccaggagtttgaaaccagactgggcaacacagtgagaccccacctctacaaaatattttaaaattagccaggcgtggtggtgcatgcttgtagtcccagctactcaggaggctgaggtgggaggataggaggctgaggtgggaggatcacttgagcccaggaggttgaggctgcagtgagctgtgattgcaccagcctgggtgacaaagtgagaccttgt

SEQ ID NO: 114698 - DNA, 211 bp, Homo sapiens
ggatgggcctttgttgtgaggttgttccagacagtggggaggtctgatcaggctggataaataatacttgtgtcaaatacacttggtgaaaatacctacctgggaggtttacacacacatttaaacagcagatgaaaaaaagtcaaatgagtcattctatccacctagctccatgcctagaacatttatttatctcactttttctagtctg

SEQ ID NO: 114699 - DNA, 3017 bp, Homo sapiens
atgtcttggctgcgtattactgccatggcccctccttacgtggcaactattgtctttactagtcaaggagctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatccctccagtatttagatttatcctgcaataaaatacgatatattgaaagacatacatttgaatcactaccatttttgcagtatataaatctgggctgcaatttaattacagaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatcatttttaatggtaaaaaa

SEQ ID NO: 114700 - DNA, 274 bp, Homo sapiens
tgctcggaagcagaggagtgtgtgggacctctgctctaggaagggcagctaaagttactgctgaatgctgacttaagtataaaattgccagacagggatctgtgagtgagaggaaggagaaatataggaagaacctcctattcaagatgaacattttaaatgcattaactgaaatttcaaaacaaactgaagattaactcattatgggcaaatgaagacagctgaactttaaaaagacatttaaaaaaggtagttaggatgcacaattagataa

SEQ ID NO: 114701 - DNA, 152 bp, Homo sapiens
aagtgatctccagccacaggatcccgtgattctactcctgatgaggactggggctgtttttctttcctgtagcacctggaatgcagttctataccaattagacctccggtgaatgtgcttcacagagtttaatgaggctgttagcctttggc

SEQ ID NO: 114702 - DNA, 833 bp, Homo sapiens
gaaatataaatttcactttggaaactaatgagttaaaaccatttacagtttctgttaacgagttaaataatgtatagaatcatagttcgtaatggtagcaagttcatgctctgctgaacttactgtttgattatggtcaaattttctatgttattattatagtagaattaagagtgtgtcctggtaaattacattaccttcacagtttgagcattctgattttaacattttgtagtttcaaaacaaactgtactcatataatcagagcattaacagcagcatcatgtcagtggtaccaataattgtgaatcttctgcaacaaaatttctttaatgatgagtttaatgggctatattcaaacctaatttttattcaattcataagtgcccactaaatatgtattttatttctgctgttctgttcctttgattatctgcttttcagtgagcatctgcatagctaaaatagatatagcatgtgttgtaaatgctgttgaatttttttaaggctcaaaggtgctagtatataaataacagcacattgccaaataagcattttttctttcattttctgaagtactttcatatttactcatgtaattatcagcatttatggtgagttggaataatttttcctctttattttcttaaatgaccctagaaaacaatgtaaagtagctctgaagaaggctttgttgttgaatctgtctcataattacttgtggatcctttgacacagaattatttatagtttataattcaccctcatctagagaatgatgatttctattacataagtaatgtaaatagagctgagaccatagtgaagcagaa

SEQ ID NO: 114703 - DNA, 808 bp, Homo sapiens
ctcttgtgctttcctagaagtcagtgtcttgtcctgggctgttgcttttctgcttgactccctctgtggggccgtggactctgcggcagagtcctatctgcagggcttctgcatggttatccattgtcttctgaagaaatgatgatgttagtgatggagccactttggttagcgttttgttaagtatgaacttgtgaatccttcccacagctgtgcaatattattacctccagggcacagcatctggactttaattgatgatgagtgtatgtggccccaagggacatggggcctcgaaattaaggaaggagctggaagtagtggacaagcagcagcaccaccacgtggaaaggtgaaaagttggataaggactggctgagaaaatgccatcagaatagcaagagggggtcattgttgaagagcacagcttcaggcaagtctttgaaatcaaagccagatttcaaggaagtcggaaggagcagatggagaggaagtggagagatttccatatggtgcgtgtatttttttttttaattaaggattttggtgttaaatggaagtggtacttgatggcctagcaggatgaaacaaagtttgtttctaaagatagagggacatgggctcacttttaaagagaaagaaagtaggtggccattgagttatgagaggttgagaagccggagatggtgggcccagagacccacagagcaggctctttgagagcagcaggtcttcctgctcagggccttgctggtgctgtcacgagccatatcccctggcctcctgctttgcttctgggctgtcatca

SEQ ID NO: 114704 - DNA, 526 bp, Homo sapiens
cggctctgatctggagacaaatgaccgtgtgcatggcctgctgactttcccacctgtgctctctcgggcactgcttacgcagtcctcaggtatgaagtgatgggactctctcatgatgaccaggagggctctggccatgcaaggcccctggctggggagattgagcacagggaagggatgccagggccgtgcagacagagggacctcgggggcatgccagggctgtactcagctctggccccagggcgtgtccccaccacacagagagagctgtgacccctgggtaacctggccgcccactgcacagagggagccgtgacccctgggtgacctgccccacacagctgtgacccctgggtgacctgcccccaccgcacagccatgacccctgggtgacctgcccctgccacacagccgtgacccctggacgacctgccccgcacacctgtgacccctgggtgacctgcgcccaccacacagccatgacccttgggtgacctgcccccgcacacctgtgacccctgga

SEQ ID NO: 114705 - DNA, 840 bp, Homo sapiens
aagatatttaaatatacaacaataattgatgtcacagacccactacagtatactatatactttgaggtgttttatttcctcctcgtaatggtgaagattttgaactaacttacttataattcccttttattgtatgattgctgccatgtatttgccttgcatggctagaattatagtcctaagccttggaatgaagtaaataatagtaactatacaggatttcctagatcagtggtccccagcctttttggcatcagggactggtttcttgcaagacagtttttccatggatggggtaggagggaggtttcaggatgaagctgttccacctcagatcatcaggcattagattctcctaagggtcacgcacatgcagttcacaatagggctcgccctcctgtgagaatctaatgccgcagctgatctgacaggaggtggagctcaggcggtaatgctcactcacccaccactcacttcctgctgcatggccgggttcctaacagaccatggactggtaccagtccgtagcctggggcttgggacccctgccctagatctaatagacaaatcaaaatagaatagcactaactattctatttggtaaaacagttaactgaatatgaaacatggtcactgtgccagaggataagtagattgccagactagaaattacctggcaagctcctggaaattttattttattaagcttattcttgtggtagaaagggaggagggattttgcagagggaaattatttgtgattaacagatttctttgaacagactaattcatatgataaacattaagactttttttaggcttaaaaaattttttttccaa

SEQ ID NO: 114706 - DNA, 406 bp, Homo sapiens
gaaaaatagacacttattctttagcatcagagtatacagtataccatgtaatttatgtgttttttttttcagaaagtattggaaggtgcagatagactggtgttcatgagcttattttattttaaatttaatttatttgtataaatttaatgagtacaagtaccgttttgttacatggatatattatgtagtggtgaagtccaggcttctggtgtattcatcaccaaataatatacattgtacccattaaataatttctcattccccatccccctctgactctctcacccttccgagtcttcagtgtctattactccacactgtatgtccatgtgtacccattttttagctctcactgataaatgagaacatgcagtatttgactttctgtttctgtgttgtttca

SEQ ID NO: 114707 - DNA, 409 bp, Homo sapiens
tgcttgcctaagaggtttgcagggttcgagcttttgggagtcagaacttctcagactagattgtttcccctttggacagaacaacccaattctcagtgggcatttgatcaggactaacccaggccttcatgaactctttcccattgagcacttagccacctggctggcatttctcttctcccaggagcttccatgaggttcctacttatgtattatgtcgacttgaatgaatattttatgtctagagtgcagccaagcctcagactttgtggcccattatcgacaaatggggtagggggtgggcgccacctttggccccgtgatagcttctctgctaaatggactccccccagcagcactttgaagcccattaatggattggaatgaagtaacctcagcagatggaaag

SEQ ID NO: 114708 - DNA, 381 bp, Homo sapiens
cttaaagggtgaatgggaattccgtgggcaaaaaatagaccccagagagtatgtggttccaacccattcatttcagccatggaaaaacaagcccagagtggctttcacaccttccttaataacaaggtggttcttgtttctgggtgctgtggaaatgtcatgggtgctttttggaagatgtcttctttggagagctgggaatctgtggtcacatagactttgtgacctgctgttctcccacttgttgactctgccccaactgaatggccttcttttggttttcagtgtaccacctttatttccacattggagcctttgtgctggctgtttctcctgccttgaatatgtttccctaggtggtccttcttcatccttcacatc

SEQ ID NO: 114709 - DNA, 376 bp, Homo sapiens
agacaaacaaacaaacaaaaaacagaaaacaaaagagtagaaagactcccttcaacaacagcaggcaaataattaaacctcttcagtgtctttaagggctaaagccaaactggaaaagacacagtctggccactaaggctggcctgggaaggccacgctgcgggttcagtcctaacccagcaaacagctggcagcccgccccccacccagcgtgctgtctgggctagtctggggctgtcgggctagtcggggacttgtcgggctagtcgggggctgtcgggctagtcgggtgctgtcgggctagtcgggtgctgtcgggctagtcgggggctgtcgggctagtcgggggctgtcgcgctagtcgtgggggtaccga

SEQ ID NO: 114710 - DNA, 466 bp, Homo sapiens
ctgtcttaaccgacttcccctgctagctatcaccccatttctttgtttcctttggtaacaaaatttcctgaaagagctgtcttatatttgctgtctctaattcctctttccccattctttaatttttttatttacataaactctttattttaggacagttttgtatttatatttacaaaaaagttgcagagttcccatatactcctcacccagcttcccttattgttaacatcttacattactatggtacatttgccacaactatggaaccaacataaacgcattactactaattgaacgccatactttattcagatgtcactagtttttccttaacgttctttatctatttctggattccatctaagataccacattacatttagttgtcacgtcttcttagtctctgaaagtgaatgtctccttggaaattacataaattcaaaggagacaaggtagagccgag

SEQ ID NO: 114711 - DNA, 227 bp, Homo sapiens
ggcagaaattatcgctgggattgagagacagggattcaagcaccctgtaccaggagagaatgtggccaagggacattaccccagaaagcaatgtgggcctgacacaggtcggatgggaacccagatgaaagtccagaacgaggatgaccacatctgagggacagacaggtcttgtttcagctgatgccaacttgctcagatccctcagtagatcagactctcttcac

SEQ ID NO: 114712 - DNA, 1226 bp, Homo sapiens
tatgcaggtgtaatacaacaacttttcaacagctttctatttggaactaaaagcaaaggcaatagattagtcactagatcatggagtgattaatttggtttcccactctacctggcagagaaataaaaggtgaaatgacctcacacttacataccattgaaaaccttcaagtcagttactgtttttctttctcaaccctaacatcgtcactgatcattcaaaatataagtacctctagtcaaatctcttcttttaatacttgtcatagtcaacaccattatcagcaacaacagttgacacagcatttagctgtatattccaggcctgttctaagcaatttacataattagtccctttaagtactttttacccccatcattgaaaataaatattattcctattttacataagagaaaacagagtcctggggaagtgaagaatcatgctcaagaccacattgctaagtgtgagagcagatttgagcccaggctacctggtcccaagacccaaactctcactttacatagctctgctgcactgctcagggcctcctttcccaactcttgatggcaagttacacaaggccccctgaaaaacccagtcctacttacataaaatctcatcactaaccattctggtcatagaaagccattctctaaatcccaaatatcaatactcagagccttaattggaaaacttcccgaagaacattgagtttagaatatacctttgcaaaaagagaaaataaacactcgatatgtttaggtttttaattattgaattttttttttacttgcagatatagtcataaacgttttaagatccataagcaaactaaagcaattatgccaataatgactaaggccactgcttcctcaattgagtctttgatataaaagccttcacttttggttaattaccaaaaaaaaaaaaaaaaaaaaaaaaaaaaccgtgggagatatgtgacagtgagagtaggcctgctactgatgagaaggaccagcaacttagcaacaccataaaatgtctgctgcaattcaggtgtctaggtgtctccctgagaatcaacatttcatatacagctgttcccagaaaacaatcttgcacaatctgtacagtcaagttatgatctaaaaggagttaattgcaacattcatccaaagaatatgacagtatttttcatcaaggtctttttctataagtttttctataacttttcctataag

SEQ ID NO: 114713 - DNA, 182 bp, Homo sapiens
ccaaaaggtggaaacaactcatatgcctgtcaacagatgaatggataaacaatgtggtgtatacacataatggaatatcattcagctttaaaggaatgaaattaagaaatgaaattctgcccaggcatgggggctcatacctgtaatcccatctctttggtaggctgaggcaggcggattat

SEQ ID NO: 114714 - DNA, 423 bp, Homo sapiens
cttccttgctgacaaagtagatgcaataggtgggcccaagtagctaaggaagccgtgtgcagagcctgaaggggtgccagtgtgtgggccagccaatcagcatggagcccacgggaactgaaagatgtttaattctggggcttcatactagaaacttaatatttagaaagacaggttaaaacaagggaagagagaaaagcataagttaggtaattttggggataagttgagtgttgcctgcaaactatggtatagacagaaccaaagaaacagagacttaattaactctgtcaatcaacatttattgagcatttgttgagtcaggcactgggaacatgaagatgaataagacacagctcttgctttcctaggaactcacagtctggtggggaagacataaatggatacagctgattgtaaaat

SEQ ID NO: 114715 - DNA, 820 bp, Homo sapiens
tgccagagattaaccaaaagaatcatgtctgtttaaatggaagaaggaacatgcttaaggcaggctgacagttctttttgtgcacggtttgggaaggaagctaaacaatggtgtgtctgaaatgaatgaaggccttgataacattaaacctcttgcttttgtgacatgacttaaccatgtagtttttatctttccagtagtactcttttttcctctgcttctatatgttgtggctggtgaactcctcttgttcaaatcccttgttctgatctcttgcccttgaggaggaggggcatcatggccactgaccaaggaattgtggacattattccctctcaaacccacctgagtcacactaattgatgaaggaggttattcttgagcagtctcaaggtattacttcttgaaaagcaggctgtcgctacagatcttacagcttcttctgcttggtttggtagtaaaaataattgagcattagtttcttgtgggattattttcattgggccaggattattttcagtgggccaggaggttaatagctataattttgaaataaagtgattttgttgctgtagggcatatagatattccacttatattaaactaatattatgttgttgcataggctttttaagatgaacattcccagttgaactaaaatatgtgattctgttgaagataattgaaataatcataaagaccttaatccatatttatacatgaacaatttgagtacttaaaatgtctgatttttaaaagccttttgttatggatcagatgcactctaaaaaaggattattatgtttctccaactaattga

SEQ ID NO: 114716 - DNA, 639 bp, Homo sapiens
tggtaattaatttgctatgcagcaataataaaatataagcctagaacatcttgctgtgtcagaaagtaagaagggactcaaataactgtaagctatgacaaaaggaccctgaagtaaatttgaaggtgctctcactagccatatctgggacaatatgagattcaaaataaataatagtattaatataactcattgaataaaatgggaaataattagttcacatttatataaataaataaccaatcaatcaatggaaagaagagagagctcttccttgctactataaggacaactaattagtatagaagaaataatataattagaaaatatttattttgcaaccatcatagtaatagttaattcaggcagaaacatcaataattgctaaaactaggggtgaaagtgggatgataaatgaatatttacatagcttcaaagtatctttccacaaactaattaattacaaaggtaaaagaataaatttacaggggaaaatctggaaggtatcaccaagaaatcaaacttaacgttagcagcaattggacatattgacatttgtacttctgatatgatgtactgtgaagggtacaacatcactttcatagtattcctgccaaacatgcttaacctgcatctaat

SEQ ID NO: 114717 - DNA, 375 bp, Homo sapiens
gtttctagggtatcctacaaagaagaacgctgcttctaagtttttgggtttcttgaaccagagcttagaaagaacaaaaatatggcatggtattttcatggtttagtaaggctacttttagttaattattgtgatgtaggccattaagtagacttttctaaaacgaaaccccagaggagaggggttttgaagatacatatatactggtttctaagaactaatctttttggatcattggtattggtagaagggattcgctatgttttctgccaccattggatctctgtataaagtttggctccactatcaaaatgcttagatagatgcctttgcaatagttgccaccctaggatacagtagggagagggtaccgag

SEQ ID NO: 114718 - DNA, 260 bp, Homo sapiens
cacacctgtaatcctagctacgtgggaggctgaggcaggagaatcgctcgaacccaggaggtggaggttgcagtgagacgagatcatgccactgcactccagcttgggtgacaaagtgagactccatctcaaaaaataaagtcaaataaaataaaataaaaaagaaatccagggaggaaagcagggcctgcatgaggccatgccttggggaataaagtgagagtgacccatgcacgcaggcagacagaaggtctgggatc

SEQ ID NO: 114719 - DNA, 341 bp, Homo sapiens
agagctagcagcatgagcttcaacctgggaggcggaggttggggtgagttgagatggcaccactgtactccagcctgggccacagaggaagactccatctcaaaacaaaacaaaacaaaacaatggacctccaaaatatcagggagccatcagagatatctgatgttgccacatgtggaacagatcttagcatcctgtttagggatgttttctagctcacaggtggggcatttaccataattaaacataaagtggggttcctgcatgtttttttttttttttttttgtgaacacagctagtccctgtcctgagaacgggggtatactagaaatggagaatt

SEQ ID NO: 114720 - DNA, 617 bp, Homo sapiens
tattattttatgtatttatttttttgaaacagggtctcactcttgctctggctggagtgcagtggcatgatcacggctcaatgtagccttgacctcctgggctcaagtgatcctcctgccttagcctcctgagtagctgggactatagggatacacatgcctataatggtgcaatttaaaaaattttttgtagaagtgaggtcttgctatgctgcccaggttggtcttgaactcccggactcaagcagttacctctcctcagcctcccaaaagaggcatatcccaccatgcatgcctatagtggtataattttttaaattttttgtataaatggggtcttgctataattgtctaggctggtcttgaattcctgggctcaagcagtcatctctcctcagtgtcccaaagtcttagcactacaggcgtgagccactgcacccagccaagaacatttataattcatgggaggaggtcaaaataccaacattaaaaagagtttggaagaagtgagttttaaccctcttagatcactttcagagattaagacttcaagacttttgacacttctgaaactactaatagcctgttgttgaatggaggccatacggataacataa

SEQ ID NO: 114721 - DNA, 384 bp, Homo sapiens
atggctccctgatgggggaagaggatttaaggactgacagggagattgtaaaacctgagggaaagaggcaagagtgggagaggatcctggaatttatcaactaggcttgctgggaactcaccagaggaaattacagaggactacagcatgaaagactgaagtcagactggaaacagacttccaggcaatcaggcaacaacaggcctagtccttcctgatatctttggctgtacctgagtaaaaccccaggaagggacgcacagcctgactgtgctggaaggaaggcagaaggatggacagggagaccctgaagatgcttccgcaggaccagagaaggaggcagcggaggcacagcagtccctccccgaggctttctttgagatt

SEQ ID NO: 114722 - DNA, 439 bp, Homo sapiens
ctgagatgacagtcggctgttgatgagatatttggaggtggggatcaatagagggggaaatagaatgatcagaagggcgcctgggtgcatttgacagcatggaagccgtgaccatcccttagtatgatttccatctctctagggaaggtcacggcttccatgctgtcaaatgcactgacactttgctattctcatctttcttgacctgtcagcattagttgagacaatagtcccctcctttctggaaacggtcacctctcttggctttgtgagaccacctctctcctcatttttctcctaacactctgacatcctcttagtcttcctttgcaactcctcctccttcccaatttgacctttcaatagtcaaatggaactaaatatttaataggaccctccctctgccctctcagcctctcagttggtctctcatacatgc

SEQ ID NO: 114723 - DNA, 425 bp, Homo sapiens
tagagcagggttcccattaacccagttggtcagcatgggcagaggaaggagtccctggagaaagaggaaaaacaggagacatggtaccaaggaagcccaggaaacaaggggccttgagaaggaggccaaggccagcagagccaggagctggtggtcagagcccaaggaaggggaacccagagcagcctctgttaaaccacacaaaggtcatgggggaactcagccagagctgatcgcgcagcctggttggagtggaaatcaggtgaacggtgcctgctgtcggcagcccttctcactctccaacactggagtctttcctcagccagggaaatgttattctatctttctttgattatttcccctcttcctcccattcttggttcttttttttgagacggtgtctggttctgtcacccaggctgggg

SEQ ID NO: 114724 - DNA, 832 bp, Homo sapiens
cagaaaggagaaaaaaaaaatagaagagaggatatattcattgaaataattctggaaatgttaagaagtgaaggacatgagtttccacattaaaggtgtctacaatggataaaaccagacacaccgtctgaggcacattatagcgaaatttcaaaacaatggagacaaagagaaaatcgaatgagaaaaacatggtcatacacagaggattaggaatctgaatgccttttgagttctcaattactgcaaggaaagctgaaagacagcaggtccaacctcaaagggggaatagtttccagccaagaattctatatccaaatcaaatgcgtagggagaatgaaaacacgtttggacattaaaggtctcaaaaagttgtactttttacatgccagtttcttaggaatctcctagaagttgtgtttcctgtgaatgaaggagtaactttaggaaacacaggatcccagagacatttcactcaagacagagctggtgatcccaggataacagctgtgaactaggtggtagagagtgaactgtccaaggtaggtgggtaagtaagtgtcctgcagagacttcttcaaaaagatgaacctgatagcaaatccaatgcatctgaaagtctgcgaggcaatatatttgagatggcagagagtttgagagttgttagcgaaataacacagaaatctagatgaagaaaataataaaaattaaccaaaggtggcactggaaacaaatagcaattgcaggagatggcatggcttggccatgaacagtgttcacgtggttataataatgcaaaaaaaaatcatctaaataaaaatctggtatgtgt

SEQ ID NO: 114725 - DNA, 280 bp, Homo sapiens
agggagtgaaagaaggaagaggaggagggaatgaatgagtttgttgcttcttttgctttcgttcatcaccttactttcatctctcctgccaaatttataatccttccaagaacctcaaggattctttccacatcttctgtataccacagtggactttgccaggcagccttttgtgggcatgtgttttaggaactatttgacgtttgtaggagtgtggaagagagtttcttcttcttcttcttctttcttctttcttctttcttcttctttcttctttctt

SEQ ID NO: 114726 - DNA, 435 bp, Homo sapiens
cacctcagcctcccaaagtgctgggattacaggcgtgagccgctgtgcccggcccagccttatttttgactgcagattttaagagggagagtaatttataccaattatcctaccccaagaggttgtggaaactgcaccgccaaagagtcacaagactcttctggttttaacaccactgatcaggattctttaaactctatgtaagctctttttctgtagttttttaaagctatagtcagttctatttaaaataatttggaaaatggaaaatatgagaagggaattcattctctaagaaagtagtaattagcccgagcagaaggagaggaaatagcaagggagtggaggacagagtagttttttagattccattgagttggcagttaacagacaggtatttgccagagaaaaaccatttacagtatttgccagaga

SEQ ID NO: 114727 - DNA, 206 bp, Homo sapiens
tttgtaggtgtattcgtcagctagggctgctggaacaaaataacacaaagttagtggcttaaacaacagaagcctattctttcatagttctggaggttagaagtcaaggcgtaggctgggcgcggtggctcacgcctgtaatcccagcacatgatctggccgaggtgggagatcgagaccatcctggccaacatggtgaaaccccg

SEQ ID NO: 114728 - DNA, 849 bp, Homo sapiens
gaatctatttttacctacaaagaggtaagggcggaggtgcagcttgtggcaggatggagtgatctaggaaaaatctgtagaacagctggcattacaactgatctttcaaagacgggtgggaattgggcaggcacaaatggtattgggggaggttaagggcaggataggatgatgggaaggtgtcaggggcagatgtaaggatgtgaatttaaaccgtaattaaagttttgatacttaaccttcaggtgtttggagacttcaagtgtacagcaattcattttttcatgggctttggaaaggatcacattttatggaagtctgaaatggtccatgctcgtatttcaggaagtctcttattccttcctcttagccattgtgtatcctctgccacctgctgagaaaaacctgtattctttatatttgttcgtttctttgttttaaatagagatgaggtcttgctgtgttgcccacaatggtcttgaactcctgggctcaagcagtcctctcacctcagccttacaaagtgcccggattacaggcgtgagccactgtgcccagccaaaacctgtactcattagaaatgatcctctttcattgtggaaacatatgacagtagaataatccttaaaaaaaataataaaacccatccagtcacatgagtcagaaataaaaataaaagaaaacaataaaagggctccttgtccaacacacacctcacacaggcaggtgcccctctggggcgaagcttccagaggaaggatcaggcagcaatttttgctgttctgcagtctccactggtgatacccaggcaaacagggtctggaatggacctccagcaaacccccacag

SEQ ID NO: 114729 - DNA, 472 bp, Homo sapiens
cccaagctggggagggaggcccagggcactggggcctggcggggtctgggtgacaggttgaggatcctggcatgtggcagttcacaggctctgtagtcccccgtcctgcttgtctagcctaccctgttcccttagcagtgtcccctcccagctgacagggcaggcgggggctcctggcatttgtcccctggtggagaccttggggagcacttgctgtctgtaaatctctggggaagccccccatagctccatcatgtctatggcaacggggaaaaacctccagtccattcccaagaagacccagcactacttcctgctctgcttcctgctcaagttcagcctcaccatcagctcctgcctcatctgcagtttgaaactaagctgggcatgaactctcccttctgagccactggctgtgctgactgtagttgcccccgtcccgtgtcgggctagtcgggggggcaccgagctc

SEQ ID NO: 114730 - DNA, 304 bp, Homo sapiens
cacaggaaactggcctactgtgtctgcctcttggtgaagcatacaaccagccacatggaaaaacccagcctgcaataaaagacttgctttggtcaccacctgacattagctgtggtttaatctgtgtaatgtttttcttcccccccatctaagcctcaatttcctatccataaaatatgttggttttggccaggcgtggtggctcacgcctgtaatcccaacactttgggaggccaagatggcctgatcgcctgaggtcagaagttcaagaccagcctgggcaacatggcaagaccccccccct

SEQ ID NO: 114731 - DNA, 293 bp, Homo sapiens
gtggtagagggaaggtctgagcaaagataacagagtggctacaaacttaattattaatctgactcttctctcctgcttctctttagaagtgacattctctgtggagaggccaggagggggaagttgtagcattcaggttttatcagtttgagggcccactttcttcagtgggtctctgtgatggctgaaacgggttgcaaataaataaatgccatgtgggctcaggaagctaaagtgaaagagtgaggtgcagagccacagcgaggggctggactgtggagaactggacgcga

SEQ ID NO: 114732 - DNA, 1957 bp, Homo sapiens
tggtaggggagggcatagagcagggcggggggatgggactgttaggttgaattaacattacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcatgttgtaagtggaaatacttttttttgtttgtttgtttcatttgccttggagccaaagtttctgttcctggtggtcgggaaactgcctgccggccaactgacttgaaggaaaactgtggtatggagctctgcttgaatttttttttttttaatatttttatttttttctttgaatatcatcagcttacttgtctggcaagggcagaagcctggggttggcctgaactctgccaaacaaatatcaaagtgtatttaatagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttatactggccataaaagagggagctgccttcaatgtataaagtataagaagagtgccagggaatgccataatggaggcttttggatctgaatttggaccatttcactaaagagaacatgagtttgctcagccctttcctcacaagagggagggccccggttccccagacttctccacgcgctggctccataaaggccagctttggccaggctgccacaggggcctgaggagctcactctgggcctacctggtttcagttagagggtcctcctgttatttttccatttaaaaagtatgtcctcagaaaactgtactggaaggatgggtggcaggaacttgtatagttcagcttccaacactttggaacagattaaaaagggaatcttttaaataaaaacgtataaaaaatcaccaacaaacagaaccccaacaaaaaaaacaaaaaaagggggggggggccaaaaaatcccccggggggggccccaattatgggcgtaccccccgtttttgtgttacaagagggggcccccaaaataaggagaggcgattttaataacgggcaaggaccagcaggcccggcctgttatacaaacagccgtgcggcaggggggcaacaacccggcgacaccgcgggggaacccttgggggaaagagaagcccgttacacatctcggggggcggggcagcaaacactggggccgcaaacagtcccctcccgcaagaagattttacagccgccgaaggggggcaacacttaacacaacatctgcaacgcgcacaaaaggcggtccacaccacacacgcgcgaattagaggctgccggggcaagaaagactgactcggccacaccgggaacattaccttccggaagacactttcacccgagaaggagagagac

SEQ ID NO: 114733 - DNA, 191 bp, Homo sapiens
tatttatactcttgaggtaatgagactttgtctgttaaacatttggaggtttctcccttaacctaataccccgctgcgtcccaggtatgtttctcagcctgggcaggaattgcatgttttgagttccattgtgagcagccttacagctctgggctcccatcttaaggattattaaagagttttggcagttg

SEQ ID NO: 114734 - DNA, 478 bp, Homo sapiens
tgggccgtacctggcgcactctggatgtggtcaatgactgactcgtccctttggaccatagacgcagctctgatttctggtgttcctgggctctgcacacagcaggagccactctgggctctgagaggtgcatcttctggctcactttcttcttgttggctcttctccctgcgtcttctgccactgccctgttctgggtgggaggctgtcacactgtggtggagggtcccctctcctgcctcccctctttgatccttttctgtgagggtctgctggggtcctgtgtgtcgtgcattgttgatagattcctgtcgtgcttgctgtcctccccattctaagggacctctgattgcctgtgagcagtttacagggtcctctcctggccccttcacccgaggaattcccgcaacgcatgagtttgtgaggggcggatcctgggaggatgtgacgtcaggtgagaagggagggcccgtcctag

SEQ ID NO: 114735 - DNA, 319 bp, Homo sapiens
agtggggtcaagcttttatgacatttttaactcagtccaggtgatgccactgcagccggtctgccaggctggtggtgctaaccatcaggagggtaaagcgttttcccattgcgcatgcctgagctacatgactttcaattttggctctgcaccatagcggcagcttaagcagtggttaattggtttgagctggtcctgtggttacagctgtagacattcagaaggcacttgggacacggagacactaggcagaccacaaacgttagggcaggaaatgattttgcacatcactagagctggggttttgtgttactaagta

SEQ ID NO: 114736 - DNA, 330 bp, Homo sapiens
ctcgtgccccaaagtgcagcgtgagccaccacacctggcagaatgctagttgttttttaatgttctttggaaacctgaaaagttggcagcctctctctacttgcctccctcaaatttcttaaatatttttaaattgtaaaaataatttttaggccaggcatggtggctcatgccggtaatcccatctccattaaaaatgcaaaaaaattaggcgtggtggtgcacatctgtaatcccagctacttgggaggctgaggcaggagaattgcttgaacccagaaggtcacgccactgcactccagcctgagcgacagaacgagactccgtctc

SEQ ID NO: 114737 - DNA, 567 bp, Homo sapiens
aaaatgctcctgtcaccttagatctcagtgatgaacgacaggaggaggagtagacactaacgttgcaacagtagatgccttttcttctgcctctgtgacaggttttcagaagtggaaaggaccgcatttagacactagccaaaccatgaggtttgtcacctgtatttgccagtgattcccagagctcttacagttgtcccaggacgctttagcacatggccacacgactcccaaggttgacctgggagttattagaagatcagagggctctaatgtcttcccccaacctcgtttttgttttgttttgttttgttcgagacaaggtctcactctgtcacccaggctggagtgcagtggcacagtcacagctcgctggagccttgaactcctggcgtcaagcgatcttccccctcagtctcccaaaatgctgggattacaggcgtgagccaccgtgccaggtctaaggtcttcagaagtgtggttgcctctgcagaggaacagggtccttttttcaactgattctacatctttttatgtctgaaaatgaaacctcactgtcctagtttt

SEQ ID NO: 114738 - DNA, 326 bp, Homo sapiens
tttctgctgacagtgactgtcagcacctttcctgctatcaacagccatatgtgtgagcacttcagacacttcctgtcctttcatcctcctgacagcctgggaaggaatcgggtgcaccgtcctacagtccaggccttggccagagaggaaagggcttgtcctggcagctccgaggtggcattgctgggtttgcgctgtgtccagccaagctcagttcctgtctccagcctgtgctgcgcaggctgagctgagccttaaccaccctcagcagcagcagggcctggggaagcacctggaaaacgctctttgcgttcatgcatcaagag

SEQ ID NO: 114739 - DNA, 288 bp, Homo sapiens
ctgcctcttggacgtgccaggtctatgcctggttgggcctttgcactcgctgtcctctttgcctggaatctgctttcctcagggatccagaggggaaatctggttcctccttgtccctcagatgccaggttcactgtcattgccctagagaagctgtccctgactgccagcctctgtcttcccataacctatctcaatctctgtacagtacttatcttcctgttgggttgatgtgttgtttagagtttgtctccctctcttagaaggtaaactctgtccgggcgcgat

SEQ ID NO: 114740 - DNA, 332 bp, Homo sapiens
gaagctgcaagagaaagaggacaaaaacaggttgttcaaggcaccaaccactctgtcacctgacagcagactgccacgttgacaggctaggaaagtgagaatgtagactccccacagctagggccaacgtctgaattcatcttggtaagattagactcccgggcatggggcttaatggccattcaacattcaatgaaatggaataacactaaatagctatcctggaagaggaaagtctacctgctcagcacgtaatcattctaggccatttgtacaaggcagcttcatgacactcattccattggcagtacaatcacctcgactgcttggag

SEQ ID NO: 114741 - DNA, 277 bp, Homo sapiens
taccaaggaaattttttaaaaaccctttaacgaaagagagccaacattgcatgaaggctgagattttttttaaaaggcaaggattcagaaaagggctgatcagtattttctgatcctagttcagtgctagtcagggagactgtcagtaaagacctttttggtctgttgatttgtagaattaagcaaaagatgaccatgcccctgtggaagctgggttggtaccagctggtagctgatttcccaggagaaccctgaacgctttacagatgatctactg

SEQ ID NO: 114742 - DNA, 453 bp, Homo sapiens
tctgtcgtcagggaagagaacgaggaaggagacagccaacatttattaagcatttgctgtatgccagaccctgtgctaggtacacatgtctcatccctgtttggtagttgaagcaatgcaacagagtgggtgagatggctcattcttaagctacagccctaggttttgaatccagcttttccactttatgtctgggccaccctgggcaatgtacttaacttcctgcacctcagtttctttatataaagaatgagggtgataatactacctaccccatacagctgttcagagggttaaggtagttaataaagagagtgtaaagggcttagaataatgcctggcatgtagaaagcctcagtgcatgtttagctattcttatcacttatcgccatcatacagatgaaggaagaggggttcagagatcacacaactggagacaaggccaagtacaaa

SEQ ID NO: 114743 - DNA, 132 bp, Homo sapiens
accaggtcagaaaatgtcaggggagctttggattgccttcataattgtgtaaagaaaattattgtcctcaaaatccagagactatgacaggcgttcttaatagagtgatatgtttagagacacaaacagcat

SEQ ID NO: 114744 - DNA, 275 bp, Homo sapiens
ggtctaattataatctggcatacatgttgtaccagcaatatctatagttcactttatttatatttttgagtcctagaactcaggataaatgaaaactagtgaccctacacctcaaaaatcaaagaattgttgccaaaactcaatctccaactcgtaatcttcacctgtttggttctgaaagtatctcctcagtatgatgctggactagtccaaccctgtgtagtccctgctgtgattccaaactaaactcaatgttattctgcagaaacattacc

SEQ ID NO: 114745 - DNA, 164 bp, Homo sapiens
aaaaaaaacagagactcaagtttatactagtgagaaaggcaaagaatggataagtggttttccaatattgtccatcatttgttattgatgaagaaacaattaatgaaacaaatatcaatggaggtaatttgacatttgtgggatggaaaaatgtatatgtgaaa

SEQ ID NO: 114746 - DNA, 739 bp, Homo sapiens
ctcctacagagggtgttactgtatttctggttctatgaccatcactagctttagattgtaagctctgtaaggaaaaagattatctagttcatgccaaagccccagtaactagcatggggtccagcatatagtagtcagtgaccccccaaatatctgttggatgaataaaggaataaataaatttagaggagaaagacataggtgagaggaacaaaaggatctcaaggagggagaagaagtacttcttgctgatgctgatggtgtaactactaagaactgggagaaataaataaaaaaggcctcttgcctggcccatgatcctcactttagcttccaaggaggtggaactactaaatagagtccttccaggtcttctatggaaaagaagaagtatagactaacactaggacagacacttggcaattcagggagggcactggaggagagcagtccccaggcccagaagtagatctgaccccaactctgtgtacattccaacaaataccaggggctttaaaaaaaaaaaagagacagggtctcactatgttgctcaggctggtcttgaattcctgggcttaagtggtcttcctgctttgccctccccaaagcactgggattacaggcatgagccactgtgcctggttgaccagtggctttttcattgtgaattttgggaagctggattttctctttgttatctttatattccatatcttttccccactgataacaaaagtat

SEQ ID NO: 114747 - DNA, 324 bp, Homo sapiens
tattctccacttacatcaccacaggaaggagagaatttgcacttttctcctcagaagggcaaagcctaaaagcaatattttctattaccctctgcacccacatttccaccttctcatctgactggttggtttgcaaacaggaaactggcatgctctctgcaggcctgttgctgaagctcttttgaatattctggtatgttctctgacatgtggtgctaaaggggtaggttccacccctacaacagacccatagggtaggtctgtcaatatgtgaactacttggaagcttttcagaacacacatgtaggctacatcctttcctcc

SEQ ID NO: 114748 - DNA, 435 bp, Homo sapiens
aggaatatgcagtaggtgagccggggctgggccagtgctgtccacagtccgcagagtgacctgcaggccgccttcgtggcctgagtgggccccggcacagttcccagagggatgccagtgtggcttccgcatgactttggaggaccgcattagtcgagtctgttaaccacagctttaaggaggactccacggccacacgggctcgtcagcataggggccctggggaggcgaggctagtatccagcagcctcagggctgtgccttttcctggagcctggggcgggtgatgtacaggaggccaggcagcagaagggaggccgggacttcgccgggacttagcagggactgaagtcctctcagagcctgtcgctgggccagagcattgcccccgaccgctggtggcagtggcagaggtcatagcctggggcttctaaa

SEQ ID NO: 114749 - DNA, 903 bp, Homo sapiens
ccctcaggagggagaacatccgccgaacgaaatggagagcaaaagaccgcgactgctcgaggaagcagacaagcagaaaaagacagtcagagtgggactcaatgcaccttccatgctacgaaagaaccagctaggtttcctcagattcgccaactattgccgtatagctcgcgagctgcgtgtaagctgcatgcagaggaaaaaggtccagattcatagctgggatccctcctctttggcaagcgaccgatttaaccgcatactggcgaataccaacactgaccagctcttcacagtgaaccaagtcgaagctggaggctccaagtacggcatcatcaccatgcgaggcctgacgacccctgagctccgggtatacccgcacaaaaccctctacgtccctaatcggaaggtgaattctatgtgctgggcctcactgaatcacttggattcccaccttctgctgtgcttcgtgggacttgcagatactccaagctgtgccgtgctgctcccagcgtcgctgttcataggtagcttcccaggaatgcgtcggcctggcatgctttgcagtttccagatccctgatgcctggtcctgtgcctggtccctgagcatccacgcgtatcactctttcagtacaggcttgtctcagcaggtcctgttgaccaacgtggtgacgggacaccagcagtcatttgggactagcagtgatgtcttggcccagcagtttgcaatcatgactcctttgctgtttaatggctgtcgctctggggagatctttggcattgatctgcgctgtggaaatcaaggcagcgggtggaaggccatttgcctgtcccatgattcagcagtgacttctctgcaaatcctccaagatggccaattcctggtgtcatcagacatgac

SEQ ID NO: 114750 - DNA, 790 bp, Homo sapiens
aggatataagattacagctagataggaggaatgagttctctagtgttctctagttctataggatgactatagttaacaataatgtattatacatttcaaatagctagaagaaggatattgaatgttccaacacaaaaatgtttgagatgatggatgtgttaattacccagatctgatcattattcatgattgtattgaatcatcactgtaactcataagtataattattatgtcaatttacaaaaacattttatcattgcatttgcttcattgctcaatacccttcctctccctacagacacacacacatgcatgcatgcacacacacgcacgcacacacatgatcattcatgtttttttgaatctttgcaaagcaagctttacaaacaatgtcccattaccactaaacactccagtctatattttcaaacaacaaagatattctcctaaaaattggcatacagccctccaaatcaggaagccaatatcaatataacattgctacccaatccacaaaccccattcagtgtcaccagctgtcccagtggtacctcttctttctttctggcccagtgtcctatccacgaacatgtgatgcgtttagtagttatgtttcttcagactcattcaatctgaagcagtcctttagtctttctcttgacagtgttaaagagtacagaccttgattatacaggatttccctcagccttgatgtgcctgatgtttacttgtgaccagacttatgtcacacattcttggcaacatcaccacctcccatcactggtgatgt

SEQ ID NO: 114751 - DNA, 427 bp, Homo sapiens
taattgatgaaggacttgtatccagattatacagagaaaagtaaaaaacttatcaataagaaaacaaacaacctagtaaaagtcagaaaatatttgaaacaagaaaaatacataaatggcaaacaagcacctaaaaaggtattcaacatcattaggcatagtgaaaatacaaattcaactgcaatgacaacactgcaaacttactagaatagctaacattgaaaaagactgaccataccaagtattgttaaagatgtgtgcagaaactggaactctaaaatactgctagtcagaatgtaaaatgggacaacctttttggaaaatagttttgttaccagaaacaggtcctgatcctgatccaaaagaagcctcttggaccttgctcaagaaagaatttggggtgagtctatagagtaaataaaaaaaa

SEQ ID NO: 114752 - DNA, 344 bp, Homo sapiens
cacagcaagaaaatgaaagactgttgatctcataaattctgtgctccagtgagtggattataagtcactttttaggttctgaatattttgcctgagaaggatcatctctaaaatcaaaaactataggccgggcgcagtggctcacgcctgtaatcccagcattttgggtggccgaggcgggcggatcacgaggtcaggagatagagaccatcctggctaacacggtgaaaccccatctctactaaaaatataaaaagttagccaggcgtggtggtgggcgcctgtagtcccagctactcgggaggctgaggcaggagaatggtgtgaacctgggaggtggaggt

SEQ ID NO: 114753 - DNA, 279 bp, Homo sapiens
atgttctgtaatgacaggaaggaatgcatatacacattgcagcagtcaaaactctggaaattaggactgtgactcattggttgtttttgtttttgttttgagaaggagtcttgctctgttgcccaggctggagtgcagtggcgcagtctcggctcactgcagcctctgcctcctggattcaagtgagtctcctgcctcagcctcctaagtagctgggattacaggcatgtaccaccacacccagctaatttttgtatttttagtagagataggtttcac

SEQ ID NO: 114754 - DNA, 508 bp, Homo sapiens
gatatgcccctttataatttcaatagtttaaataatgattgtcaggcacagcaaaatactcaggcatcagatactcagttaactctgttatgtttgctattcttagaagattattaccacactttagaacagttttcaatatccaaggctgtttgcttatttcactggaattaactaaaagtaattagggaattcattcctcagaataatttatatcctaagctttatgatgaagaaggcttttatttctaattgtatattccagccttggaccaaaaatgtacatgctaaaatatcaagacaaggcaaagatatatttttgcttttctgtcacttaatactatttcaaaatagtttcagatttatcaattggcccagaaaaagagtatttaattcctttgatttggaacatctgattcaaattaatgatttgagaagtttttaatatactttgggaacttcaacttggaattctgaggtaaattgttttaaagggaagattcttttg

SEQ ID NO: 114755 - DNA, 185 bp, Homo sapiens
cccccttctcctgaactctagagccctggctgggcagatctcctgctgaaacctggcgcagctgtcatggggaccgcccacgtttcctttgtccatgtctatctatactgatgtctttcctctctttgagagctgtgcctaacttacccatatctccgccatcctccacctagccacacatccat

SEQ ID NO: 114756 - DNA, 766 bp, Homo sapiens
aagctcagtagtagaattggcagaagaaatagtaaatgaacttgaagaaagattgatagagattagaggaaaaagaattttttaaaagtgaacatggcctcagagaaatatgtgtgacctttaaggacaccaacatacacatcataggagtttcagtagaagaggagagagaagggagctgaaaatacattcaaagaaatgacagctaaaaattttcccaaattttttgtaaaacaataacttacatattcaggaacctatatgaattccaagtagcataaacacaaagagtttaaaaaacagacatgtcctaacaaaaacaaaaaagctaaaagacaggagaaaagcttgaaagtagcaagagaaaagcaacttgttactcgcaaggaaatatcaacagctgaccattttaggagaaacaacaaagccagaaagtagcagatcactttcaaaatgctcaaaataaaaaaaaaatgtcaaccaataattctatatccagcaaactactttcaaaactgaaggtgaaacacagactttctcagataaaaagagaatttgttgctgggagacttgccttgcaagaaatactaaaagaggactccaggttgaaagcaagggactccagatagtaatttgaatacataccagtaaaggtaattgtgtaattatataggacagtacaaatgaatatctcctcttgattttaagaagaaacaaattatataaacactatatataatagtggccctataaatatgaaaatgta

SEQ ID NO: 114757 - DNA, 363 bp, Homo sapiens
gccagtgtccatcatccaggtgctcagctcccagtgcactgaagctcagacccttcctggttccctggtctcttgcactgagctctgatggtgagacttgaggaagacttccactgggcctgcttttcctgagccagtgcccatcacccaggtgctcagtccctggtgcactgaagctccagcccttcctggcgccctggtctcctgaactgagctgtgtgagctcttctgccaagcggttcccctggcattgaccaacatagatggtgagcctggaggaagacttgcgttgggcccaaaggccctagaccagtgtctgtcagccaggttcccaacccccgatgcgctgaagctcaagccttt

SEQ ID NO: 114758 - DNA, 388 bp, Homo sapiens
cctggctctgacattaggatgcgttgttcatcttctcagtggggcactattcctccaagttcctaacaaaatgcactttaaactgtacttgagtcactacatacattccctccctgggtaatattacttttaacagcaaaaaccacaattacttttgcaccagtctaacagcatccacagggactccctcaattgcaatttctatgaagaggcctccctgacctccagaccaacatcgccacctatatgaagaatgtttccaatcataggtaggtctggcacttaaaactcatgtagccaaagtaacagtacttctgctccaaacctattattgacctcttcatttctttttctttttcttttttttttgcctgagttcagaatctcg

SEQ ID NO: 114759 - DNA, 297 bp, Homo sapiens
ctcattttcctagcagcctccaggatcttcaggggtgaatccctcctttcccacgttggtactctgtacacacaacatgcccattccctgcctggggagctgggcattgcttcatgaatcagaggtcaattttttctctattaaagtcacagatgctcattgcaccattgtgagaatgaatgaagatagtgcttataaatcagccagcaaggtacccagcctcactgtgtcagggtctccctgggcatgaggtggttagagtgtgtgacatgtctgtccccaagcctgtcagctccc

SEQ ID NO: 114760 - DNA, 631 bp, Homo sapiens
gaccagcattcaaattcaggaaatacagagagctccagtaagatacttcacaagatcatccccaagacacataattatcagattctccaaggtcataataaaagaaaaaatgttcaaggcagctagaaagaaaagccaagtcacccatcagactaacagcagacctctcagaaaccctacaagccagagagattgggggccaatattcaaaactttttttttgagacagtgtctcacttctgttgcccaggctgcagttcagtggcacaatctcaactcactgcagtctcaaactcctgggctcaggtgatcttcccacctcagcctcctgagtaggtgggactacaggtgtatgctaccatgcccagctaatttttgtatttttagtagagacgggtctcgccatgttgtccaggctggtctcgaactcctggacttcagtgatctgcctatctcggcctcccaaagtattgggatcacaggtgtgggcctggcctatattcaacattcttgaagaaaaatactaaccaagggctaggtatggctgctcatgcctgtaatcccagcattttgagaggccaaggcagatggatcacttgaggccaggagtttgagaccagcctgggcaaca

SEQ ID NO: 114761 - DNA, 347 bp, Homo sapiens
ttctcctgcctccgcctcctgaatagctgggattacagatgcatgccaccatgcctggctaattttttgtatttttagtagagatgggatttcaccatgttggccaagctggtcttgaactcctgaccttgtgatccaccctcttcggcctctcaaagtgctgcgattacaggcatgagccaccgcagccagcctctgggctggtgtttttaaacagtttttatttgcatggctctgggtcctcagcctgattttacccttggagttcaaagccatctaattggaaatgaaaggagcctgattgatttggcaactctgcggccagcccacgtggcggtgatgcgatg

SEQ ID NO: 114762 - DNA, 356 bp, Homo sapiens
tccatgaaagctttgatatggtggatctttggtgagcatcccattctttaaataaaagtaactcagaagctaatttaaagaagatatgctcttggaatttaacgcagctcttggaatttaacgcagcttaattacatttttagcataatggtcatatggaggacttaatgcaattgaagttaataaaagtattatcactgtgcgggaatgtcttgcgggtccttaaacttcagtgtgcactgatgcaattttggagcgcttcagagaaaggattcagaattatgaatacaaaatgtttgcaggtcctctgggcggaggctgtgcctgtgcctaggctagctctccatgtgctattt

SEQ ID NO: 114763 - DNA, 463 bp, Homo sapiens
tacacaggaagcagtggaaatgtcagagagggctggggaatcaaacactgtagaaagggagcaacaggactcaataggtctcttcacctttttctctttctctaccctccagatgaccaaagttagtccaggtgcctagaatgaaaattaaccagtcttgaatccttaacaggaaaagttgttcagctccttctaaagagcctttgattcttttattccagaccatcaggacactgctaacagcagagaacctgttcaccaaccaccatagcagctcccttcccagctaagagatcaactttcatcttcttcacctcccccctctattcaatcatttctcttgtcctcaccttcccatagagggttcatttcctcattatgtctattgtgatagccaacacataaatgaaaatattatagatcattgactttcccaatagcaccagccatgtctcagccactg

SEQ ID NO: 114764 - DNA, 159 bp, Homo sapiens
gatgccactgctccaatgaataaaagaggatacaaacaaatggaaaacattcattaagtcccaaaaaggtaaagaatgacaaattaagcatgtatcttattagtaagagtaatataaagatgctcactcctatttataaatatttgacaatcatgttaa

SEQ ID NO: 114765 - DNA, 772 bp, Homo sapiens
atagaaaacattataaatgggtgagatgcggctaaagaagtgcttacatggaaagttatagctttacatgcttatgtttaaaaagaagaaaggtttaccatcaatgacctacttctactttaaaaacctagactaaaaacttctctggtttccattgtaacatgtaaggagtttggaagtcattactgcatcctaacaacaaacaaaaagctgaaaagggcctggaaaataaaaacttgtctcagatctatcagagaagtgaggtcacagggcaaactactgtcctaaaaattagagagactgaatacagagaattacaacttaaaggagaagaaacccacaagcagaaacctccacaggaaccagtgctgggctatataaacctaaactctaattgacaaattcttagagccttagtgtagagaaatctaagagttaaaacaccatgggaacccagtcatatgggaacccacacaccttcatgagtttaccattcagagattgaccctattctcccagtagatattgaagaaaaatcctctcatgcttctgtcaggggaagggggaaagtaatcatttaaaagtataccagagcatgccattcttcttaacaaggcctgtcctcaggagaaactatttttaccagagcctaacctattggagtttttcagagcccaactgactgagggaaaggaaatattcaactctaccccactctagccatcctcttctacctaaaaggggagaaaagtgagaagcacatacaaacttc

SEQ ID NO: 114766 - DNA, 333 bp, Homo sapiens
gccagtggatactgcggtgagccgagatggtgccattgcactccagcctgggcaacagagcaatgactccgtctcgggggggtgtttaatataatcttagtatacattctaactgctgataattaatttataagaacagcatatccaactggaaatataaaacctatacgataagtaaaatgcagcatgtttaaagtgcatgtataaagtacacttccagggagcaaaggtaaatttaggaaaaccctggcaattagtctcacttccttcatttttatatttaaacacacacaggcctttttaagtttgacacaaaagtcattaaaaagttac

SEQ ID NO: 114767 - DNA, 757 bp, Homo sapiens
ttcacctccccctaggtaacgatgctattagctatgtgtgtccttccagagccagtttattcataaccaagcaattatgtatgtattcagcacccccttgttacacaaacaatagcattctgaaacgtccttctgtttcttgcttttattaactttagcgaattaatatatcctggaaattcttacagatattcacaaaatctgaaaatgggaaattttatttttaactaaatatttatttttgacgttttcacaaaagtttttatacctttctggcccctctccattgttctggaaactctagattcctgcttgccaattcacaaagtttgaatatccttgtagcaaacccaatatgaaccgtaaggcagaaaaatagggtctggagacagggaacctaaggccaattcacgctgacttcctagaactaaatcaaaaggaaaacccgaactttccatgcccaggtaacaaaaggaacagaagctagtccctttgcaacctgccccgcttttctgcctggcagatgaaaaattgaaggtacctctgattggtcccctcttgcaaccaatcaggctgatcacaggccactacttcttttacatagagtgtacaccaagtaaccaacgggaaccctctagagggtatttaaactccagaaaattctgtaaccgggctcttgagccacctgctaggcaggctcccaacctgtggagtgtgcttttgttttcaataaatctctgcttttgttgcatcattc

SEQ ID NO: 114768 - DNA, 358 bp, Homo sapiens
tgacgggcgctgggctgctcacccagttttacatgggaagtggtagggccctgtctcccctggcccctgcccatgccccgggagaaatgggtatgtttgggtggtaccttcctgcatgggcagaggcaggtgattgtatcgccagccctggagctcagcgtgcacagcttgggcttccatttggaggaacctgatccttggacttgaacactctgctctttgtgttttgcacaacaggagagtcctgctcctcgcttagctcagcacagcgagtcccctggcttcagcttccctcctgagcacctgacggttgtcggtttactgtgactcactgccattctatctgcctgggcttatg

SEQ ID NO: 114769 - DNA, 389 bp, Homo sapiens
ggtggctagctttagtcatgttcagatgcaaaaccgtaatgagtttgagtatgcaagtcccagggattctgttgaaggccatcttttctcggccatcaagggagacaattttctaggtttaagcctccctggcaagttagcaagcagggaactgcctgccctagcttgcacctgtcccctgaaggggattctggcctgacggtgaagacccaccatcccttccagacagcccattctgccgctggggcacctcccgacaaaagggggaagcccactaggaagtggtcacgaccaaccaagccacaaatcctcagggtgtgggatttccacctctataccacgtctgaaaaccgaaaataggcgcccgcttgccatactgcaatgggatt

SEQ ID NO: 114770 - DNA, 395 bp, Homo sapiens
gttattattttttattaaaagacatacaataacaagtgttgttggcaaggatacggagaaattcatatgctggtagttagaatgtaaaatgatgcagctgctgaggaaaacattctggcaagttgttcaaaatgttaaacatagagttgtcatatgacccagcaactctcttcctaggtactcaagataaatgaaaaccaatatccacataaaaacttgtatattaatgtttataatagcatgtttagtagctcaaaagtggaaacaactcaaatgtccatcaaataatgaatggattaaaaaatgtagtatgaaaaaaattagctgtgtgtggtggcacatgcctgtaatcccagctacttgggaggctgaggcaggagactctcttgaaccga

SEQ ID NO: 114771 - DNA, 258 bp, Homo sapiens
aagtttcagcagaatagcaccaaagactagttcccaacccagctcccagagccagagccagagccaggctggctgcatgagatcagctgggagcttttgaaaacctaggtcctagctgagcccctaaacatcagactgggagtcactgggagtgagctccaggaactggtttatttaataagcacccccacacacatgattctgatgttcctaagggttgtagaaacatggaactatagaaaacactaaaaaaaaagg

SEQ ID NO: 114772 - DNA, 492 bp, Homo sapiens
caaagacgatatcataattcagactgcagatctgccaacattcaaatggctctagtcctcgagtgttattttctaactccgcttttagatgcaccattgtatagcccttacaactgggcctgtcccttctgtagatgtgggagtagctgaactccacagaaccccaggttacacactaaggacacaggttgttagggctcctggatgagggtaagtgtgtttattttaaaccacgtgcttttggctattgagcttatgatttcaaaggtgaaagcttaagcacgttattagacttctcaaggagagttcccctagattgggagaaaagttgacattgggtaatattaaatctttcttttaaaaccagggctattttgttgttgtttacaattttaagagtctagactgaaagagtcatgaaatgcagccacctatctgacctcttcccccaacagttagggaattcgctctgcccccaggccacccaacctt

SEQ ID NO: 114773 - DNA, 684 bp, Homo sapiens
aaagtgctgggattataggcatgagccactgggcctgtcagtgggtggacttcttgagggtggggagctgtgtctgggtctccttgatgctccagaacttagttattttcctgacactgcacaggtatatcaggtgagtgattgaataaattctttcccatgcaaggccaaagagagacacaagctggtggttttgaggaggagaggttggttctttccaactggtggactggggcaagtatcacatatgtaacacccactgagctgtgcatgagtggtctgcagaaatgcagtagatgggaagaggaggggtgatgcatgaaaggcaagccccaaattggggcttagcctgagagggttcttggctttgcccaggaaagaattcaagggtgagatggtggtaaggtagaagaaaacagctttactgaagtgtcagtgttgcagttctgacagtgatgcagctctgtgactgctcctgcagagcagggctaccccataggcagtgtgctgagagctgcagctcagggcaggtgtgcagtcatagttatatctacttttaattgcatgcagattaagaggtgtttttttgcggacatttctaggaaaagggtagtaacttctgcaccatcaggtcatttctatggagaggagtgataactcctgggtgttgccacgcaaaggtaa

SEQ ID NO: 114774 - DNA, 842 bp, Homo sapiens
gtgcccggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggagtttctcagcacaaggtctctctttgcctgctgccatccatgtaagatgtgacttgctcctccttgccttccgccatcattatgaggcctccccagccatgtggaactgacccatgccccctttgtgatgaagccaaggaagtactcaagccttatgaaaacaggcaaccctacaaggatcagaagctgccaggaacaaggagaagacgctccccttcctcaccttcccacccccacatggcttctcagtcggggaaaagatacaacttaactttaaaccaagtcttaagttttgattatgacatgggattagatgcaccaaaaacaatttcaagtgactgtggggcattctattgcctgagaatgttcaagagtcctgatatgacctgttgtttttatcctaaacagtgaaaaattcatccaccaaatatataggaatagagggagacagaaagatgctttctgaaggtatcccatatttagagtattggttacatatacctaatgttggttttaacctatagctcttcaataaacttactcatcaattcttatttcagagaggaata

SEQ ID NO: 114775 - DNA, 1088 bp, Homo sapiens
gtgcccggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggagtttctcagcacaaggtctctctttgcctgctgccatccatgtaagatgtgacttgctcctccttgccttccgccatcattatgaggcctccccagccatgtggaactgacccatgccccctttgtgatgaagccaaggaagtactcaagccttatgaaaacaggttcattttacaggaggtgaacatcacacttccagaaaactctgtctggtatgaaaggtataaatttgatattcctgtctttcacttgaatggccagtttctgatgatgcatcgagtaaacacctcaaaacttgaaaaacagctcctgaaacttgagcagcaaagtactggaggctgactgatgccctcatgattttccaccctctcttcccataaagcatcttcctaaggaaatgaccatggcctgatactcattttgtcacttgtacagagccctaaggatgttctgaattcagtggtgccaaataaatgttgacattccccttttggttgatggaagtatcagtgtgggaactgtttgcttaatggcattttataaaataagaagagcatattagcagggagggagatgatggagggagggagaagtccatttgtcttatttatcctttttgtattaatagagaagcacttcacagtcactgggcaatgccatttataggaagaaggttctgcattcctgctgctgccccggagggcttaactttttaatgaaagaataaatgctcttccactcagtagataaagtgaaatgtgaattgttaataactgtgcacggtcaataaagcgatgttttaaggaataaaaaag

SEQ ID NO: 114776 - DNA, 1063 bp, Homo sapiens
gtgcccggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggtacaaagtgaaaaagtaaaattgttgggtgaagaaagttgtacatttaagaaaaagggacaaagttgaaaggaaaggcaatggaataagctttcttcagacctgctcttcaatttttctatcagcacaacagcagcaactcagttttctacccagataccttattatctcccaattagcaaagagtaaattgatgtatttaatggtcatctggcccctacattgaaaaaaatgaagtataggttataatatggtgtttactataaagtcaccttgaacgctgaattaatgaatattgctcctaggggaaatacacagttaggttcctatgagtctctggtcataatattttcatcagcctaccaaatacagaaccttattttatgtgtgattctatttaaagatactttatttttacatttgcaccatggaatactatgcagccataaaatagatgaaataatgtctttgcagcaacatggatgcagttagaggccattatcctgagcaaattaacacaggaacagaaaatcaaatactgcatgttctcacttataagtgggagctaaacattgagtacacatgcacacaaagaggggaatgatagacaccagggcctaattgagggtggagggtgagaatcgaaaaactacctatcaggtgtatgcttactacctgggtgatgaaatcatttgtacaccaaaccccagtggcatgcaatttacccatgtgacaaagctgcacatgtacccccgaacctaaaataaaagttgaaaaaaaatttttttaata

SEQ ID NO: 114777 - DNA, 882 bp, Homo sapiens
gtgcccggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggacccatgccccctttgtgatgaagccaaggaagtactcaagccttatgaaaacaggtttctgatgatgcatcgagtaaacacctcaaaacttgaaaaacagctcctgaaacttgagcagcaaagtactggaggctgactgatgccctcatgattttccaccctctcttcccataaagcatcttcctaaggaaatgaccatggcctgatactcattttgtcacttgtacagagccctaaggatgttctgaattcagtggtgccaaataaatgttgacattccccttttggttgatggaagtatcagtgtgggaactgtttgcttaatggcattttataaaataagaagagcatattagcagggagggagatgatggagggagggagaagtccatttgtcttatttatcctttttgtattaatagagaagcacttcacagtcactgggcaatgccatttataggaagaaggttctgcattcctgctgctgccccggagggcttaactttttaatgaaagaataaatgctcttccactcagtagataaagtgaaatgtgaattgttaataactgtgcacggtcaataaagcgatgttttaaggaataaaaaag

SEQ ID NO: 114778 - DNA, 136 bp, Homo sapiens
aggggtaacagaaaagcagcaagatcaggaagtagagaatataatgaaaccagtcaagttttggaaatcagggacattagatcactgtggacctaaaacaaacaaacaactataaggaaaatggcattagaaatgg

SEQ ID NO: 114779 - DNA, 978 bp, Homo sapiens
gtgcccggcgcagggcggaagcagaggcgttggcggcgtgaggctcaggactgtacatcagaggaagccaaaagccagctggaatacttcctgaatacagttttaatcttgtttgcaattatttcgaaggggagaaatcatctggatcagaattaagatgctctggtttcaaggaaatagcatgcaacttgccagatcctcctttggactcttcttgagaaattgctctgcctctaagacaactctgcctgtgttgaccttattcacaaaggacccatgccccctttgtgatgaagccaaggaagtactcaagccttatgaaaacaggttcattttacaggaggtgaacatcacacttccagaaaactctgtctggtatgaaaggtataaatttgatattcctgtctttcacttgaatggccagtttctgatgatgcatcgagtaaacacctcaaaacttgaaaaacagctcctgaaacttgagcagcaaagtactggaggctgactgatgccctcatgattttccaccctctcttcccataaagcatcttcctaaggaaatgaccatggcctgatactcattttgtcacttgtacagagccctaaggatgttctgaattcagtggtgccaaataaatgttgacattccccttttggttgatggaagtatcagtgtgggaactgtttgcttaatggcattttataaaataagaagagcatattagcagggagggagatgatggagggagggagaagtccatttgtcttatttatcctttttgtattaatagagaagcacttcacagtcactgggcaatgccatttataggaagaaggttctgcattcctgctgctgccccggagggcttaactttttaatgaaagaataaatgctcttccactcagtagataaagtgaaatgtgaattgttaataactgtgcacggtcaataaagcgatgttttaaggaataaaaaag

SEQ ID NO: 114780 - DNA, 537 bp, Homo sapiens
acatgaggggcaccccttactttccatccatttgctgtccagttgaggagataaaataaccacaacagagaacagctatgaaaaatgcagtactttgggaaagtagttttcaaattatgttctgtggaatcctaaggagttctatagaggcaccccagaggccactgaggaggaagggttgggggccaagagctatgagtctccattctgtcccttcactacaataaggacagctttaattttatctttggagtttagcatcaagattttagaagcactgccataggacatcagagaaggaaagaagtttggtactttctgtgttttttgagacagacctcaaggaccaaataaaataggacaggtaggaggcagtctgagctgggcaacagcatgagttaagtttgagggctacttctaaggaacaagtgcctcctgagtcagctgattcctcctgtaagggaaggaagagtgtgtcccacggcacctcctctgcctttctatagaaaaagggatggagccaggggagacaaggaa

SEQ ID NO: 114781 - DNA, 328 bp, Homo sapiens
cttagtttcagagccgctttctacaaagaaacattaaatttaaaaaaaaattttactagacaaataataattgtagatattcatgggatgacattttgatacatatttgtaatgtgggatgattaaatcaggctaattaacaaatccatcaccttacatacttatcatgttttggcagtgaaaacatttaaaatcttctgtcttggcaattttgaaatatacaatccattattaaatgtaccctgggaagatggccatgagtagggaaggactggagaggagagtcactctccagctaactgagtcacttaggcacgtcacccttgca

SEQ ID NO: 114782 - DNA, 275 bp, Homo sapiens
ctggagcaaaattagtatttggctctgcctagtgcctaagtacatgcacttaacctctgcaaatacagtgttctagaaccctcatcattgaatccggaggtacttgtagtcatttgtgacactggagtcctagcctccaaaggactttcagaagagtcttagattagttcctaagaaagatttctacaatatgaacttagatgaatttgaagggtgcccggaaatacagatgttggagaatatgcaggaagagtttagaggatgagaatgctaaa

SEQ ID NO: 114783 - DNA, 676 bp, Homo sapiens
tagataatagcaaagtgaagcaaaaagccaactcaagagtagtgagctttgaatatgtactaccttgtttaaaatatgacatatttaattttaagtttatttacttgaatttttaataatggctgttttttaagtaagcgacttgtaaaattcctaaaactttgtcagctcttccaaaccagtgtcagccagttccagcacaccagtgagaaggtccctcagtagggggaagaaaactttctattatccaactactatgtaccagaaagggggctagcatgtcccatgtgttattctatccaaccactgtggtatcacttttagggtagatgttgtaactcccattgctatgaagaaactgaggcttagaggttaaaaaaccttgtccaagttcacatagtaagtggtagggtcaggattggaacccagactgtttgactcctaaacttgtgctttgaccatttactgtgctctaaagcccagagtccagagcgagggctaagctttggggaagaggcagggtgcttgtttgatttctatgtggagctggcctctccattgaactctcagcaggtacaaagattcttgtagtcatctcgggttccacaaatgagacacctcttgacttgcttcagtatggggtattggtgctaatacattgagctaggtgacatgc

SEQ ID NO: 114784 - DNA, 578 bp, Homo sapiens
acattcttgaggttgtaggtatttctttgacctacttctctttgagatttactctatattgctttatactagccacaaactccagttgacacgggtgtgtttgttgtcttgcctgataatgttgttgagtgttcagcactcctagatctggatggggtgaagaactcactggaaagagcatggagtcaggataaggacacttagtcttcaatcctgactttctgctttattatccccatgtttttaggcaagtacctgagggtctccattacctcccctacagaatgaggaatatcattcctgcctcactgaacacttatgaggattaataattcaataaatatttaaagtactcagcccggaacttggcatccgttgggtgcgcttcgcatcttccagttggagaaatcagttatcagtgtttgggaattgcattaagctcataaagtaatggctggaaattattaagattgatttttaaaaatacaatcatgcttttattctcttttggaaaacagaactttattgcttctcacaacaaaactttcagtgccctccgaggagaaaaataaacttac

SEQ ID NO: 114785 - DNA, 485 bp, Homo sapiens
ctactactactaaattcgcggccgcgtcgactttttttttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114786 - DNA, 838 bp, Homo sapiens
agcgggtgacgtcacaaaaacctacgcgtcgcgcggtgggcgggagttggcggacggtccctggctgggttctggaggccctgggaccgcggaagaggcttcagacgctgcagcgatgcctcgcccacggcggatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacaggatcattcccgaagaagtgttggagcaattaagaagcgca

SEQ ID NO: 114787 - DNA, 1934 bp, Homo sapiens
agcgggtgacgtcacaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatctattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114788 - DNA, 2047 bp, Homo sapiens
agcgggtgacgtcacaaaaacctacgcgtcgcgcggtgggcgggagttggcggacggtccctggctgggttctggaggccctgggaccgcggaagaggcttcagacgctgcagcgatgcctcgcccacggcggatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114789 - DNA, 1415 bp, Homo sapiens
  misc_feature (45)..(45): n is a, c, g, or t
ataagcgctgcattaatgtttaattattttcttttgttccccctncccccacaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114790 - DNA, 2177 bp, Homo sapiens
  misc_feature (6)..(6): n is a, c, g, or t
  misc_feature (10)..(10): n is a, c, g, or t
  misc_feature (24)..(24): n is a, c, g, or t
ctcgtncgcntcgtgccgctcgtnccgctcgtgccaatatttccagatatctcacagacattaagcctttgcctcccaacataaaagacagactgattaaaataatgagtatgcagggacagataacagattcaaatataagtgagggtcatgctccgttgcccaggctggagtacagtggtgcaatctcagctcactgcaacctccgctgcctggacttaggtgatccctcttcagcctcctgagtagttgggactataggtgtacaccaccatgcctggctaatttttgcattttttgtagagacagggtttcaccatgttgcccaggctggtctcgaactccggagctcaagtgatccatccgcctcagcctctcaaaatgctgggattacagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114791 - DNA, 1927 bp, Homo sapiens
  misc_feature (6)..(6): n is a, c, g, or t
  misc_feature (10)..(10): n is a, c, g, or t
  misc_feature (24)..(24): n is a, c, g, or t
ctcgtncgcntcgtgccgctcgtnccgctcgtgccaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114792 - DNA, 786 bp, Homo sapiens
agcgggtgacgtcacaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatctatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaattgataaggtgtagtctgtcgggctagtcgggggtaccagctcgagtctatctga

SEQ ID NO: 114793 - DNA, 258 bp, Homo sapiens
cctgaattagccatctcaacagtgctttgtgtcccaagaaggactttgccagcactgaaagctgcacctcctgctggaagtagaagtggttttctcctgctttgtgtgtctgtctgcacatggatatgcttctgtattctttgctgtattttacatcagccacttgtctgttatgaccaccaaaacactgaatatggaataaatatttgtatttatagaaagaaataattttttcaaaatcacttatttgttatagat

SEQ ID NO: 114794 - DNA, 475 bp, Homo sapiens
actacacctaataatagtgagggctaccattaattaattattagtgagttagttgtatattgtgctttatagatcacctcctttaatcctttaaataactgtataataattaacatcacctccagttagacatgaggaaacattaaacattttttattgtcaattaatatattgtcattgttttcttttatagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattct

SEQ ID NO: 114795 - DNA, 2067 bp, Homo sapiens
agcgggtgacgtcacaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatctatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114796 - DNA, 2276 bp, Homo sapiens
agcgggtgacgtcacaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatcttgatgcttaggaaagattttatatcattaaaaagaaattgggaggtcacttccaagatggctaaatgggaacagctccagtctgcagctcccagcaagattgacgcagaagatgggcgatttctgcatttccaactgagatgctactggacttgaatggttaataaaattgcacaatgttgttggtggcagtgacttctttctgttcagatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114797 - DNA, 2022 bp, Homo sapiens
agcgggtgacgtcacaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatctatgcctttggtgcttcatgaagaatatttccagatatctcacagacattaagcctttgcctcccaacataaaagacagactgattaaaataatgagtatgcagggacagataacagattcaaatataagtgagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggagtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114798 - DNA, 2352 bp, Homo sapiens
agcgggtgacgtcacaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatcttgatgcttaggaaagattttatatcattaaaaagaaattgggaggtcacttccaagatggctaaatgggaacagctccagtctgcagctcccagcaagattgacgcagaagatgggcgatttctgcatttccaactgagatgctactggacttgaatggttaataaaattgcacaatgttgttggtggcagtgacttctttctgttcagatgcctttggtgcttcatgaagaatatttccagatatctcacagacattaagcctttgcctcccaacataaaagacagactgattaaaataatgagtatgcagggacagataacagattcaaatataagtgagggtcatgctccgttgcccaggctggagtacagtggtgcaatctcagctcactgcaacctccgctgcctggacttagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtatctgacagtggtgtgattgcacttgttagtggaccttgtgcgaagaaattagaggagattcatatgggacattgtgtaaatctgactgatggggctgtcgaagctgtccttacttactgtcctcaaatacgtatattactcttccatggatgccccttgataacagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtcttaagttataactctcagagaattagctaagtcttggtatatacatggtttgtgctttactcttaaacatctttaaagtgctattattctatatctgttggatgagtcattatttttgaaatgataatcctagcatgaactctgatctatggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgtgtaaaaatgagtaaatacagaatatcactacagagacttgtatcctcaggtttattgatttcacattgtgaaataaacagcaaaggtcttagttttcaagtgaaaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaactccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacaatt

SEQ ID NO: 114799 - DNA, 1625 bp, Homo sapiens
ggttctggtacattctggccactgccactgatgcccaggattcttgccggccagggacaagaggaagctgggggcgtccgtggtaaaggtgaacaaagtgggccagctccgcgtgctcctcgccttcagacgataggcagaatgtttcgagcttccagagtctgaaggaattcatggacgcttgtgacattctggggctctccaaggccgccgtcatcctcccgaaagacgcgtcccgtacacacaccatcctgccatgagagccagcgtcctctgctcttccctttcgacgcgtggtcctcccagacccgaggagcgttgttccagatgtcaagtggagaccacggcttgttgagaggtgtttggtgactctaggtcattgacagtgtgaaaatcaagtggctcaagggatcctttatgatcacagaaagatgggggaaggaggatacaggctgaccgggtggcgagatgtcagccaggccccttccccactgtcttctggagcacactgcaggctgctgctattccctgtctgctgtgaaacagaccacaggccggcccaacgcagtcctcgccgtgtgccttgcctctgccctccacgccgccgccaccctccgcgttcctttacatcctgcactttctcaggaagccgttcgcatatccacccaacatggaggagcccccatgacgtgccaggcagcgtgctggcccctgcggctgcgttagggaacagaatcggcaaacgcagtcccagagttgatgcctgatcaggagaagccaacttcagcagtgtggtcacctggatactcgagtatagaccctagatcacctggatactcgagtatagaccctagaagtgtatctaggcgcggccagggccccacaacagcaggtctgactcattccatccagggcagcatcagggagagcttcctgggggaagtggcatttgggctgacctgggaagggtggtgggtgttaagtcagtttgggtggggctggaggagcaggggtgcatccccagaacaggatgtgacttctgaaaagacatcagagtagagaaaatggtttctcaaggagattggggacgccagtatcagaatggcggcggggagagccacagaggagcaggagggggcccaccagaccacggcacctcgaaggctgcggtgaaggcttaggtctcactcaaggggtgatgacgggaggttgtctgagatgaaccccccaactgaatgaatggaccttcttctggccaaggggatcccaaagaaaccctgaacccgagtcctcagccatgacggggtaaggggtcagcccctccttctggcccgagaagagatcagagattggttctgggcagtccatggagaatttgctcagctggaccagtacacgcttctcctttcatgaatattcatgactcctcctgaagcttattgaacatctctatttggccatctccttcagcgtaaattcctgtcccctctgtccctcccctccaagtgtctgttccaggcttctggcctgaggctacgcttcctagcctgtcagaagggctgccctgctggctgcaatctcttatgagaaataaagctctcctgtgtgcaaaaaagtaaaaaaga

SEQ ID NO: 114800 - DNA, 1593 bp, Homo sapiens
ggacatttcagcagctcctggggtagggatgggggtcagggtgcagaccctaaaatggccagagctggagtctctgatgtgatcctgatctcaacctcagataggcagaatgtttcgagcttccagagtctgaaggaattcatggacgcttgtgacattctggggctctccaaggccgccgtcatcctcccgaaagacgcgtcccgtacacacaccatcctgccatgagagccagcgtcctctgctcttccctttcgacgcgtggtcctcccagacccgaggagcgttgttccagatgtcaagtggagaccacggcttgttgagaggtgtttggtgactctaggtcattgacagtgtgaaaatcaagtggctcaagggatcctttatgatcacagaaagatgggggaaggaggatacaggctgaccgggtggcgagatgtcagccaggccccttccccactgtcttctggagcacactgcaggctgctgctattccctgtctgctgtgaaacagaccacaggccggcccaacgcagtcctcgccgtgtgccttgcctctgccctccacgccgccgccaccctccgcgttcctttacatcctgcactttctcaggaagccgttcgcatatccacccaacatggaggagcccccatgacgtgccaggcagcgtgctggcccctgcggctgcgttagggaacagaatcggcaaacgcagtcccagagttgatgcctgatcaggagaagccaacttcagcagtgtggtcacctggatactcgagtatagaccctagatcacctggatactcgagtatagaccctagaagtgtatctaggcgcggccagggccccacaacagcaggtctgactcattccatccagggcagcatcagggagagcttcctgggggaagtggcatttgggctgacctgggaagggtggtgggtgttaagtcagtttgggtggggctggaggagcaggggtgcatccccagaacaggatgtgacttctgaaaagacatcagagtagagaaaatggtttctcaaggagattggggacgccagtatcagaatggcggcggggagagccacagaggagcaggagggggcccaccagaccacggcacctcgaaggctgcggtgaaggcttaggtctcactcaaggggtgatgacgggaggttgtctgagatgaaccccccaactgaatgaatggaccttcttctggccaaggggatcccaaagaaaccctgaacccgagtcctcagccatgacggggtaaggggtcagcccctccttctggcccgagaagagatcagagattggttctgggcagtccatggagaatttgctcagctggaccagtacacgcttctcctttcatgaatattcatgactcctcctgaagcttattgaacatctctatttggccatctccttcagcgtaaattcctgtcccctctgtccctcccctccaagtgtctgttccaggcttctggcctgaggctacgcttcctagcctgtcagaagggctgccctgctggctgcaatctcttatgagaaataaagctctcctgtgtgcaaaaaagtaaaaaaga

SEQ ID NO: 114801 - DNA, 392 bp, Homo sapiens
cctggtctctgactaggatctgtgtatgttctaagtctttctctcctttaaaaaaaagagataatctgattctattttggatctgtgtacattctaagtctttctctcatttagagaaaaacattctcaagtctatagaagaggaaaaaaaattaagattaggaccaacatttcaagctgcctttaggaaagaaaattaaaaacagaggtagatggttaattattagtggccaagttactcaggtgactaattttttcttggtacacattcaccaaaattttatacttgaagccaaatagtaaataactttaggagcctggctctgaattagggttgacaattggattaaaaaaatgactttgtcctactaagttcattctgacatctttat

SEQ ID NO: 114802 - DNA, 371 bp, Homo sapiens
ggagaatttcttgaacccaggagacggaggttgcagtgagccgagatcacgccactgcactccagcctgggcaacagagtaagactctgtttcaaaaaaaaagcaaaaggatatgttattatttatataaacttagaacaaaagtatgtactaggtacatacaaataaagtaaaattataaaacagatgggacaaatacacaccaatttcaagattttggatccttttaggaagaaaaaagagaaatggaataaggtgcctgggttgggagaagagatagaccaaaaaaatttaagaaaaatgtgagagtatgtttatgtgagcaaagtataacgtgccattgggaggcaaaaaaataagattgattaaaa

SEQ ID NO: 114803 - DNA, 335 bp, Homo sapiens
caataaaaatacacctacaaggtttccagaaatataaaaatgaaagcaggatataaataaaggaataagttttagggaggcatcagacttctcaacaataacacagtatgaaaaagcagatgggccaatagctatacattactgtaggaaaccgatttagggcctagcatcttgatactcaccaatttaggatttaagttttttggattataaaaatttagtatccagagacatttcttgccagatttgctcaaagagtaaaaggcacaatctgctaagaagatgtaacattctgtaatatatgtgattatgtaagttggtatttttactgttct

SEQ ID NO: 114804 - DNA, 216 bp, Homo sapiens
cacagacagtgggtctccatgccaagcacaatgcctagaacagaggagtatgtttggagtatgtttgttgactgcatagcaaataggaaaataacccaggccaaccccacttctgagtgaggagagaaacacacacatgcacagacacacatatgcacacagaggcaatctggtagctgtgtgtagagtataaaagacaatatgtagcagaggcta

SEQ ID NO: 114805 - DNA, 344 bp, Homo sapiens
actgtattactgtttttaaattttttgcttattttgaaaatatgtataaaataattacctgaactattatatgaagtaacatttacccagatgtcagactcaaaagtagaacccaaaagttgacatttaagtagcttcagcaaaacttgcctcaaagaactagagttaatatctgataatttcattttgtaggaacactgatgctcctggctaatatatcaatcaattcctcatcatcttttttattttttagcctaaaaaaacttagactgtagattttttgtttgtttctttacctatattttctttgtatttgttttttgttttttgcttttaagacagag

SEQ ID NO: 114806 - DNA, 262 bp, Homo sapiens
gtgttaagcactgtgtattatttcatttattcttgaatatacaaacccctcaaagtcaaaatcgtcagataatcctttataatccaccatcaaaacatatccagaatctgattcacttctcacaacctctgctgctaccacccttgacgaaggcaaccagcagctcttgcctggacatccagaataacctcctcactagtgtcccagcctctacttttgttcgttgcatttcattctccacaaaccagaatgttctttttca

SEQ ID NO: 114807 - DNA, 693 bp, Homo sapiens
gaggaggaaggagagaaaatggcatccatggattacagtacctatagccaagctgcagcgcagcagggctacagtgcttacaacacccagcccactcaaggatatgcacagaccacccaggcatatgggcaacaaagctatggaacctatggacagcccattgatgtcagctatacccaggctcagaccactgcaatctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcaatctgcatatggcactcagcctgcttatccagcttatgggcagcagccagtagccactgcacctacaagaccgcagaatggaaacaagcccactgagactagtcaacctcaatctagcacagggggttacaaccagcccagcctaggatatggacagagtaactgcagttatccccaggtacctgggagctactccatgcagccagtcaccgcacctccatcctaccctcctaccagctattcctctacacagccaactagttatgatcagagcagttactctcagcagaacacctatgggaaaccgagcagctatggacagcagagtagc

SEQ ID NO: 114808 - DNA, 414 bp, Homo sapiens
cctctcttagccatatagtagaagcccgatcatagactctcacccttacaccatgacttgagttcctgctcatttttatccctgagctctgcagacttctaagcagtggaagttttcattctctttcccacattgcactcaagagagctaacatgagagattctaaatcctgggattcctctgcatctggctttaagtacaggagcagaacacagggaatttaaggaacaaaaatagccagagcttcaggcttcttccactgatggtaagtcattgacatgcacttggatgaaatcctgtatctgttctttggactagcactatcgcctgagattatcagtttcagagagttacagagaggcagtagatttcatctttcctatttcaggaggagttattttggttgtttaaaaa

SEQ ID NO: 114809 - DNA, 390 bp, Homo sapiens
cactgcagccccacagaagccccagacaagaagtgaacacaggggaggaactgtggctccaataaacctttattcacagtaggaggggggcttcatctggattgtgggccatagtttgcccacccctgcctgacctcatgacaacactgaccttcgtatttatgcctcttaaaaacatgtgtaagccgagtgcagtggctcatgcctgtaatcccaacactctgagaggccgaggctggaggattgcctgggggcaggaggtccagaccagcctggataacacggcgagatcctgtctctacaagaaaccatttcaaaagcagccaggcatgggggcccacacatgtagtcccagctgttcaggaggctgaggtggggaggattgcttga

SEQ ID NO: 114810 - DNA, 374 bp, Homo sapiens
ccagtttgtgaagacttattattttcttcaatgcagaaatatgatctcttggcaagaatagtgagtttatatagatttttatgtatcatctgcatatatcctatgatatttattgagtgctttctctgtaacaggcagaattttagatgtttactaatgaatgacaagcttgcgatatctcagtgctcatctcacccaatttctcagcaacttttgacacagttgatctctccctccttgaaaaacattcctcagttgttcctgggaaaccacacttgcagcctgtctccctgtctctctgactgtgctgtctcagtctcctttgcctcctcttcttcctgactgttacacattcctggagtggctgtggctca

SEQ ID NO: 114811 - DNA, 324 bp, Homo sapiens
gaagtgttcgctgatgatggtgaagaacgttatgtccatttatggtcactaacttagtgcttttcccttccaattgagcttgtacctgttgagcatctcctatgtacatggattttgatttacttggatgagaatcactgttgattaaagttgtaaaaataattttcatctcagatagaaacttcatcccagacttccgtggtatcttcagatagcacagaaggttttgtgaaggtcaggaaggttgttgctgaagtcttgacagatgatatctggatcccagtttagaaaaacttggactcttgttacaggtgagcagagcgg

SEQ ID NO: 114812 - DNA, 394 bp, Homo sapiens
catcatcatcatcatcatcatcatcatcactaatgttttgcaatggtagttttgagaagagaataggatctacccaaggaacagtactgaaaggggtagtgaagtcaaatgtatttcagagaattattggcttgggaaagatggagagtgtctccaaccagcaggtcaaccattacattagaaagttcccaggtgggaggtaaaattcctaatttagggtcagatattgatgtattaggtataacctttttaagagatgtgcaggctgggtgcggtggctcacacctgtaatcccagtactttgggaggccaagggcaggtggatcacctgaggtcaggagttcaaaaccagcctggccaacatggtgaaaccctgtctctattaaaaatacca

SEQ ID NO: 114813 - DNA, 567 bp, Homo sapiens
agccgaggaattattcccaatatctttctttttttttttgcattccacatccagttaatcagcaaatcctgtcagatttgtcctaagtatatatcaaatatagaggcttcacaccacctctacctcaccgtcctggtgtatgccacatacttccctttaagaatcctactgccttcttcctgttggccactcttactcattcttcctcctgccagacctcccccgacccccactgccattccattcttcacatagaagctagcatgaacttctaggatacaaagaagatcatgtaattctcccagtcagaacactgcactatgaattacattgtgtctggaatttgtgtcagaataacctgtggttctccccctccctcacccctccacagagtaagtccgcaagtccccttgatgctaaaccccaaatatctctcgagtcagtctcttttgctccttactcacagtctctgccttagtgggggaaagagagcctataaagcctcacaaaatgaggctcccacctacctctctccatccccatgcctcattgctcaccttagccata

SEQ ID NO: 114814 - DNA, 1062 bp, Homo sapiens
cactgatgaagaaccctcctttgagaagctgcctttgtgtcctacagacaggctggggccaaagccattcaaccaatccccagataatccagagctcttgggagcagaaccttaaagagagatcgtggagagagccagggcccagaagaactctctcaaagagaagagggcagccaagatgacccgatggtccagttacctgttgggatggacaaccttccttctctattcctatgagtcaagtggagggatgcatgaggaatgtgtctttcctttcacctacaagggatctgtttacttcacttgcacccatattcatagcttatccccttggtgtgccaccagagccgtgtacaacggccagtggaagtactgccagagtgaagattacccacgctgtatcttccctttcatctatcgaggaaaggcttataacagctgcatctcccagggcagcttcttaggcagtctgtggtgctcagtcacctctgtcttcgatgagaaacagcagtggaaattctgtgaaacgaatgagtatgggggaaattctctcaggaagccctgcatcttcccctccatctacagaaataatgtggtctctgattgcatggaggatgaaagcaacaagctctggtgcccaaccacagagaacatggataaggatggaaagtggagtttctgtgccgacaccagaatttccgcgttggtccctggctttccttgtcactttccgttcaactataaaaacaagaattattttaactgcactaacaaaggatcaaaggagaaccttgtgtggtgtgcaacttcttacaactacgaccaagaccacacctgggtgtattgctgatgctgaggaaaggagaaatatcttcagaggaagactgccgccatactgaggctgagcacagatttgtctttttcattgcatctgtcaagcttaaataaccacctttagaaataccctctgcaccacctgcttcaatcagctggtcctttgtgaagaacgtagagagaatgcggcataaccaccaataaaggagtcttgatttaaccctggga

SEQ ID NO: 114815 - DNA, 924 bp, Homo sapiens
cactgatgaagaaccctcctttgagaagctgcctttgtgtcctacagacaggctggggccaaagccattcaaccaatccccagataatccagagctcttgggagcagaaccttaaagagagatcgtggagagagccagggcccagaagaactctctcaaagagaagagggcagccaagatgacccgatggtccagttacctgttgggatggacaaccttccttctctattcctatgagtcaagtggagattacccacgctgtatcttccctttcatctatcgaggaaaggcttataacagctgcatctcccagggcagcttcttaggcagtctgtggtgctcagtcacctctgtcttcgatgagaaacagcagtggaaattctgtgaaacgaatgagtatgggggaaattctctcaggaagccctgcatcttcccctccatctacagaaataatgtggtctctgattgcatggaggatgaaagcaacaagctctggtgcccaaccacagagaacatggataaggatggaaagtggagtttctgtgccgacaccagaatttccgcgttggtccctggctttccttgtcactttccgttcaactataaaaacaagaattattttaactgcactaacaaaggatcaaaggagaaccttgtgtggtgtgcaacttcttacaactacgaccaagaccacacctgggtgtattgctgatgctgaggaaaggagaaatatcttcagaggaagactgccgccatactgaggctgagcacagatttgtctttttcattgcatctgtcaagcttaaataaccacctttagaaataccctctgcaccacctgcttcaatcagctggtcctttgtgaagaacgtagagagaatgcggcataaccaccaataaaggagtcttgatttaaccctggga

SEQ ID NO: 114816 - DNA, 618 bp, Homo sapiens
cactgatgaagaaccctcctttgagaagctgcctttgtgtcctacagacaggctggggccaaagccattcaaccaatccccagataatccagagctcttgggagcagaaccttaaagagagatcgtggagagagccagggcccagaagaactctctcaaagagaagagggcagccaagatgacccgatggtccagttacctgttgggatggacaaccttccttctctattcctatgagtcaagtggaggaatttccgcgttggtccctggctttccttgtcactttccgttcaactataaaaacaagaattattttaactgcactaacaaaggatcaaaggagaaccttgtgtggtgtgcaacttcttacaactacgaccaagaccacacctgggtgtattgctgatgctgaggaaaggagaaatatcttcagaggaagactgccgccatactgaggctgagcacagatttgtctttttcattgcatctgtcaagcttaaataaccacctttagaaataccctctgcaccacctgcttcaatcagctggtcctttgtgaagaacgtagagagaatgcggcataaccaccaataaaggagtcttgatttaaccctggga

SEQ ID NO: 114817 - DNA, 1104 bp, Homo sapiens
cactgatgaagaaccctcctttgagaagctgcctttgtgtcctacagacaggctggggccaaagccattcaaccaatccccagataatccagagctcttgggagcagaaccttaaagagagatcgtggagagagccagggcccagaagaactctctcaaagagaagagggcagccaagatgacccgatggtccagttacctgttgggatggacaaccttccttctctattcctatgagtcaagtggagggatgcatgaggaatgtgtctttcctttcacctacaagggatctgtttacttcacttgcacccatattcatagcttatccccttggtgtgccaccagagccgtgtacaacggccagtggaagtactgccagagtgaagattacccacgctgtatcttccctttcatctatcgaggaaaggcttataacagctgcatctcccagggcagcttcttaggcagtctgtggtgctcagtcacctctgtcttcgatgagaaacagcagtggaaattctgtgaaacgaatgagtatgggggaaattctctcaggaagccctgcatcttcccctccatctacagaaataatgtggtctctgattgcatggaggatgaaagcaacaagctctggtgcccaaccacagagaacatggataaggatggaaagtggagtttctgtgccgacaccagaatttccgcgttggtccctggctttccttgtcactttccgttcaactataaaaacaagaattattttaactgcactaacaaaggatcaaaggagaaccttgtgtggtgtgcaacttcttacaactacgaccaagaccacacctgggtgtattgctgatgctgaggtgagagcagggaccaacagtggtcatttcacggatgcagaggaaaggagaaatatcttcagaggaagactgccgccatactgaggctgagcacagatttgtctttttcattgcatctgtcaagcttaaataaccacctttagaaataccctctgcaccacctgcttcaatcagctggtcctttgtgaagaacgtagagagaatgcggcataaccaccaataaaggagtcttgatttaaccctggga

SEQ ID NO: 114818 - DNA, 403 bp, Homo sapiens
tcctcagcacaggatggaagagttcgcagctgccatggcctcggaagacatgggttcaagtcccagcgataccacttagctgtgtgaccttgggcatgttacttaacctctctgaacctcggtttcctcatttgcaaaaggggatattaatgttcactttcaggaccattatttgaaagtagtgagtagcaagcacccagcacagtactggctcataagagacacttaataagtagtagcgatagttcaactttatcaggcgctatctgcagtcctaaagcctttctctatttctctgaaactttgaaggcaccagatcacatttaaaaattacataaaaattacttgaaatgggcaaagagctataaatgccgacaaaccatcttgtttcacaaaaaaaaaa

SEQ ID NO: 114819 - DNA, 369 bp, Homo sapiens
cccggccagtattgggtagtattattaggcagaggttccaaggttctcaagtgtttggtaaggccaaagctggtgcccaagctattgtctttttaagtgttctccatgctagctggtatcccttccctgtaccagtgtttcatttagataattggaccaagcatcggcctttcttactgtaatgcaaccattacaaaagcttgttgataccaggctcttttcatttgttggcctagtgactttatcgtttgtccctttcctgatacattgctctcctgctaaggaaactttcatctaggccactgtagtcagatccaagctgtatctttccgttgactttcttccctgtctgtattgcccccaagatat

SEQ ID NO: 114820 - DNA, 723 bp, Homo sapiens
atgtatatgtgttatgggttagttttcatcagtataagttttaaattttacttaaaatttccttagaaataagaagctttttcacaagtgacaaaacacattaaaagcttatggtatgtgtggtctatatttatcttcatatttcatttaccaataaacgtatttatttaaaaatgttatttaccaatgaatttactaatatatttttgtaaataaattgtaatattatttatggttttgtttcacttagtgtgaattttcacacatttattcgcagaaatagtaagattaatgtgtttcattacatagtactgtcctgtacccatttggaatgttacaaaatgtatgcaatttatgtagtatattccaaaggattccaatttcatcctgaattccaaaaaattctcatttccaaaacacatttggtccccagagtttttaagagattatagacctgtgattcttttttgttgtgaatgatccagtgaaatgatcaatgtaaaatgtctcacacaaagtaaatgcccattaagtgtagttgctattattaatattgcgttactctactttaaaaatgtaagacaagctttttctgacattgaagttagcaatagcataggtaatgatatgcattcttcaagttttattactctaggagatgctttggcaatgtgctgctgataaagtgtattagagtatctcctaaatcttcatccaagaatg

SEQ ID NO: 114821 - DNA, 713 bp, Homo sapiens
gcttttcacccatgtagttactgcttatggacttttctccattaaaaaaaaatcaaaacactaaaagcctttatttacactgtttgctctttcttttacatctactctgtatcttcttcctaattaagaatagttgggaacctccagggtcaaatagaaatggtggcatcaacacggtcatagagaactctgatgttcaaaggacatggccatggaaaatcaaagggaagactaataaagttaaaggaaagtttcaggtttgttgggcccaaggactcctgaaaggataggattaatgtgttttttgagccaaagttctgcccttgaaagggaaatctcctctgagctttgagtagctggtgctgcatcctttaaaaatgtattggatggaattaatagtgagcgttgccacatcccttcttcccagcccaaacaagaaccagggaaccagtcattctgtcacaaaatgaataagaagttatatccaaatgccaataaaacccagttagaatttaatgtaggacataactagagtgtcaaatatgacaaactaactttgagataagtctgagagctcaagttccaacagaaacaaaaccttttatggacaaatagcttcgtatctcatatgctactcccaacagctcatttagatgaataatacagattctgcattggatctgtattggatggaggaaattgagacatagagc

SEQ ID NO: 114822 - DNA, 365 bp, Homo sapiens
cgactctagcaggatctcccgggtgatgcatgtggatgaaggaggaatcaggagtaatgccaagaatgagaaatctgtataagcagttcagaaaaggggcgtcatgagtcactctcctcagtgctgcccaagagttccacagtttgttccttacatcattcacttggataaaacctttcaatgtctctccatggccttcagagttaaatcaaaactattccttggaatgacttaaaacccatactacctctaaagcctcatctcttgactctctcgcaccaagctcactgagcttccagccctactgaatttcttcagtaacaaactctcacatctcagagcctttgcacatgcatgcacccagg

SEQ ID NO: 114823 - DNA, 304 bp, Homo sapiens
ctggagcagggcagggatgtcgccacccttagtgtcctctgtcccacagagcccaacagaaatttcatccttccttctcttgtatccctagaatccaggaatcgccttcaagtagcttatagactcaaaagggatcaggagagactgatttagagagggctttgtgccctgagagtgacaagagagcagagtctggttccagctgtgcatttggagctcccctcgggggaaggccagtcctcacgaggtctgccaggcccaagggctctgccgcagcacctgccctgccctgtctctgatgtca

SEQ ID NO: 114824 - DNA, 365 bp, Homo sapiens
tttcttggcacgtggcatgtcaatggatagctctactattccccagatatgatatttaacagattctggggtctatcctaatgaatcaggcccagtgtgatactggtccagcagcttgaatcgcttccaactcaaacttctgtggcctcggaatatgattaattgcttttcattgttactgttgttggtttaaacagaccatagaacctgacatctgatctcatacatcagatgcatataagctatgactgctgattggaaatgccctttcactgcacctcctttccctttgtagttgtagctaaagaacacgtgtttcttgaagttattgttaacttattgctgaatgtctcctaaagccaaag

SEQ ID NO: 114825 - DNA, 329 bp, Homo sapiens
ctgagatgacagtcggccgaggttgagaccctgattctggttctgtttcatgcaccactggtgtggcttccttttcgctgcgattgctgtcttgtctagtgaaaacgggttcctcctctttattacagctgttttcactttcttgtttttctaccatgggctctaaattaggttctctggggtcaattttctcctctaatttttccctttccttctccagctccattcttttggttgcttttcattctcttgacagtgtcttttgcagagcagacatttttgatgaagtctagcttactaattctttctttcatggatcttgcttttag

SEQ ID NO: 114826 - DNA, 412 bp, Homo sapiens
caggatgtactccaagctagtgatggtggttgcctctgtagagggaagtggtgggctgaggctggggagaaagtggagcgctcttttattcttccctgtaaattattctatatggcttgaattttttataatcagcacgaactacttgtaaaaacttttaaagcaactcaaaccttaaaacacaaaaaggaacacacacacacacagagattctccagccccactctaaatgtgctgaatcagaatttccaccaggaacccaagctctggtccaagccctggctccccaccattgcgctcttgcatacccccagtgatggggatcttactgcctccctgggcattggatgtctttctgcctgtgttgcctctggtcctctaccttgaattgggctccccctctgggtctttc

SEQ ID NO: 114827 - DNA, 352 bp, Homo sapiens
atttacacaaacctagatggtagagcctcctacacacctaggctatgtggtgtagcctcttgctcataggctacagacctgtacagcagcttactgtattgaatactgaaggcgaatcataacacagtggcaggtgtttgtgtatctaaacagaaaaaggtacagtgaaaatacagtattataatcttataggatcacatcacatgtgtggtctttgaccaaatcattatgtagcaggtgattatatatttcattctttagaatttcctaaaattatctttccggtagtgtcagcctgtaatttccttaagacacaagaggaacttctcatgcacttagttgacttctaatc

SEQ ID NO: 114828 - DNA, 519 bp, Homo sapiens
ggagattggttaagcaacatccatacagtgaacagtattcagccatttgaaatgatgtggaggaaattttattgacatgatacattgttaagagcaaaagaaaaagttttaaaatacaaatgtttaatttgtaagtctcacaaacatcatctaacgaaatatacacgaggtgttaagtcagccttgcaaacgtaactattttttcattatttttatatcagttactgttattggagcattttatattgactgaggatctttattaaaacttcttcagccttctgtgaaatcttgttatgatggctatagtgacactatataaaacacataaccagaatatgtttatgctcaaatatttcaagcaatatttgatgcttaaaataccaaagtgacaatgaaaatgaaagaaatttggatagttccttagagttatttgtttgtgtttcagatatgaacataaagtatgtttttaatattaccagttttgagaataatagaataaatgccttctcaccttaa

SEQ ID NO: 114829 - DNA, 540 bp, Homo sapiens
tagggaaaaaaatcttatcacatacttacacacaaaaatacatctctatgacattctttatttctacctcagagccaatgctattattatgcaatatttcaactagtgttttagtctgtgtgcaaaggctttgaggctgcagcattacagaacgcaacccaatcttaaatttacacatgagggcaggctcactgtcacttgcctgtgtaaagtatagattgagatagtcccataacttcagatttcactttataaaatcacctgttagtatcttgaatagatcttgcctacttcttccaactctagacataaatttttttgtcatcttagttttcttaagatttcattctgctttcccaatctactgctgctcctgggagtcatcagggcagctgcatcctaaagtccaaagatacatccattacccaggtcattagaattagaaaaaaaaaaatcattagcagagatcactggatatggtacagcatgaattaaataaaaatattaaatttacattactaattcaaacaagatttgcaa

SEQ ID NO: 114830 - DNA, 270 bp, Homo sapiens
ttttcttctatggctggtattgctcagaaggtaattctaaaaaagagttttaaaatgttctgttcatggccaggtgcagtggctcatgcctataatcccagcactttgggaggccgaggtggatggatcatttgagttcaggagttcaagatcagcctggccaacatagtgaaaccccgtctctactacaaacacaaaaattagctgggtgtggtggcatgtgcctgtagtcccagctacctgggaggctgtggcatgagaatcgcttgg

SEQ ID NO: 114831 - DNA, 413 bp, Homo sapiens
catagggaaaaataacaggaaagtgggaacaagcaggcagtgagttttgtgtaaaaagaattcagttaaatagttgagtgtctactctatatttggtacttttacaataagagatgcaaaggtgaattgtgctgtttaacagctgactgtcagggtttttccatctcatcaatgttgacagtttgggccagatattgttgggcaggtggacatgctgtgcgttgtagggtgtttagcaacatccttagcccacatgatatgccactaccataacccaggcttaccaatccagaatgtctcctggtggacagattcaccccttgttgagacccatgagtctagatagattagagctggtaagaacagttgagaacctggcttaagtggactttaggacctggtttaagttcgtc

SEQ ID NO: 114832 - DNA, 430 bp, Homo sapiens
gcgcacctgaagggtgtcaaatctttggcattttgagatggatctccaagatcagctggtttaatcactttattttccagatagggagactgagcctcacaaagggaatgggatccacatcactgggcatttgctgttaaatttccaatccaggcccatccaattctgaaacctagactcctgtttaccaaactctggcagcccataatataatatcatccttatacttagccccgcaagagctggatctgtgttacttttctaagctaggcaccatcctgtgacatcttcctgaaaacaaaggaaaccttatgtcccgttggtgggattgcaaggtgacaagcattctcgggggaagagcctaatattgcaggttaatcagtgatgaccaaagtcagctttttggagagatgtcaggtttggttagact

SEQ ID NO: 114833 - DNA, 289 bp, Homo sapiens
ggatcttattcgatagccgacactggcggggggtgcctgttgacttgggaagggccaggatcgcgatcaatggtgagttgggggttggaggaatgggaaggcctagttcagggagagtaattggaaaaccactcgctccggtttggacattctttaaaaagccgaggatgacttggggagggggggtggtcttttgtggaggggaggttacatcggttcgcatcgcaggcggatttcaggtccgaaagtcttggtcaaggagcccgatgctgcctctcggggctcgggg

SEQ ID NO: 114834 - DNA, 422 bp, Homo sapiens
ttggatgcctatttctgtcttccttatctactactgtcactgtcaaccccttgtggctgttccatccccatgtgtcagctctttgtgggctggtttgcccccggaactattgctctgagttctgtccattccctgctcggctcagtgggctcctgagttagcctttagcatgtcacctttctggcatctccatggtaccagaacctttacttttcacgtgggctccaaccagcagcagctcccaactaggagtgtcccagcctggtggaaaggactggacacacaagatgggtcggaattgaatattaaatgaatttcaatacttggtgtacctttgtgaagtagcacattgattttgagagagcattgactttaaatctgatagatttttttgcaagcttcttttcagcaaatggcttact

SEQ ID NO: 114835 - DNA, 220 bp, Homo sapiens
tgccacctcacacccctgaggatggctgctattaaaaaaaaaaaaaaacctccagagaatcacaagtgttggtgaggacgtggggctatcggcccctgtgcgctgttggtgggaatggaaaacagtgcagctgccgtggaaactctacggcagctcctcaaacacttaaatcagaatgacagtatcatccagcctgggtgacagagtgagactccgtctc

SEQ ID NO: 114836 - DNA, 692 bp, Homo sapiens
tttcttttcttttcttctcttcccatgcactattctggaggtttgccaggtttggggagacatggagtaaaagaaagataggcaactcatggatggtgggagagcaggtaagcaggtctgatctcaagggcccacatgaggcatcagtatatattaggcaggtagggatctctggctttggtaattctttatgagaggatcctagcctttgaagctgggagcaggagtcagtggctacagtgggaaggagtactgcaggttggggccaaagtgatacacagcttagaaggcagccttcctccacttactcaacaaatctttatttagtgactctccaagtcctagtgattattattattgttcactccacatttggcttaatgggtaatgctattacccattgcctaactaggtttgcagtagtggaatctccagagatagcaggcttagtaagctggaggtaggacatgaagtcccccaaaacttgatgtcctatttttatgtgagttggacagtggttatcttttgcctgttgatatcttaaagcagcagagtggtatagaaatttgcggttatgacagacccgggttaaaaatcacagctgtgccatttgctttgatattttgagcaaggtagctaaattttctgagcttctattttctcatctgtaaaatgaggatacgtacctgttc

SEQ ID NO: 114837 - DNA, 459 bp, Homo sapiens
tttcttttcttttcttctcttcccatgcactattctggaggtttgccaggtttggggagacatggagtaaaagaaagataggcaactcatggatggtgggagagcaggtaagcaggtctgatctcaagggcccacatgaggcatcagtatatattaggcaggtagggatctctggctttggtaattctttatgagaggatcctagcctttgaagctgggagcaggatcatcatctaaagaattccattgctcacctcctgcatagcagcacagccccatgaggccacacaccagatggaggggataaaagtacgaggtcatggcttcttgcaagaggctttttcttaaactaaccctgactcctggaaaagaggcagagcaggagagtgttgaatgagctgctgatgacagcagcttcataggtcttgtgtataaaggaaggaaaaagctaacttggct

SEQ ID NO: 114838 - DNA, 430 bp, Homo sapiens
tggaatatagagaaggaaacataaatctgcatattagacagttctgtaataaacagtacttacatagacataataatgtaaaaacacagaccaaggaagactaactatgaacagaacatgttatcaattatataaaaataaggatggccaggtgtggtggctcatgcctgtaatcccaacactttgggaggctgaggcaggcgacctgcttgagctcaggagctcgtgaccagcctgggcaacatagccacaccccatttctacaaaaaatacaaaaaccagctgggcatggtggtgcgctcctgtagttccagctacactggaggctggggcaggaggatcatttgagcctgggagatcgaggctgcagtgagctgagatcacaacaccgcacttcagcctgggtgacagagtaagacccactctcaaa

SEQ ID NO: 114839 - DNA, 627 bp, Homo sapiens
ctgaggaaaccaggcgacaaaggccaagctgggaggagagcctcgcttccaggtatcccctgggttccacagactcccgtgcacgtgtgtccaagtgaggggcagtggctgtcactatcatgtgcgctgccggcggctgccgggcagatttctcttctgggtttgaaataaccggaggcgatcttaagaacctactgacgacccgccgctctggaagaaatcattttccattctgcatctagcatcagcatttcacatccagatgcaggaagtcttcgtggaattttacatacattgcttggtttgcttccaagaactcatgattttgccttctggtttactctccttactgcttcaggcttgcagcgataggaacccatttctcccttgggttgctgtggcagcgtgacggtaatgcagattcaggagattgcagtatgaggttcaagtgtgggctgcgttcagatggggtcccttgacctgcctcatcctgtttccttaccatagtgcttcccatgtactgtagcatttttttctttttaaaatgatttatattatattattttattttttaaatgtttatttatttttgagacagagtttcactcttgttgcccaagctggagt

SEQ ID NO: 114840 - DNA, 549 bp, Homo sapiens
taagatctagaatattgcctatactttagaagtcccctaagaaccctctccctctcaagtaattatttggaaatttgtgtttgtcatttgctttgtacataggtatctctaaatgaaatgttaattttgtatgtttctcaattttgtataaatggcataatgtttgtttacttttgtgactttcatttttattgctgtattgtattatatgaatacttattcttctgttgatgtacatttgagttttatttagttttgtttttgctgctgaaactgctgctgtgaacattgtctgtctaggagttatagtgcttgatcatgtgctatgagtatcttcatttgtataaaataatgccaaattataaaaaatattagaattatagcctttaatattactattcagttatgttagctagtctttaggacacttgccccgttgtactttgtattaaacatgtggtcaaaaaataatgtctttatgcggatattcctgtttaatgaagtacgtgttgtagttaacttcttggtaaagcaaacaatgttaaatga

SEQ ID NO: 114841 - DNA, 757 bp, Homo sapiens
agcaaggaaagccagtccaagttccaaaactgaggaacttggatccgatgttcaagggcagggcgcatccagcatgggagaaagatgtaggttgggaggctaggccagcctgtctattcatattttttctgcctgcttatattccagctgcattggcagcttattagattgtgcccacccagattgagggtgggtctgcctttcccagcccactgactcaaatgtaaatctcctttggcagcacactcatagacacaccaaggagcaatactttgtgttcttcaacccaatcaagtggacacccagtattaaccatcacatctggtaacttcccaatatttcctttatatccatgtcttcactgcatcgtttccatacctgcaccccccaaccagcaaccagtgagtgcagggggccccgtgcctgagaaggctattttctccttatggtccatgtgctttctccccaccttttcttatttaatgtctgactgtcccccgcaactggattgtaaaccccgtgagggcagagaccttgtccattttattctctgaagaatccccagcatgtgctccatacatgttggatggccagatggacaaatgcataaataccgagcttagtgggtgagcaggtccgggcttacaggcttcaggaccttaggtaactcccttgacctgcctctgcctaaggtctactgtctggctgatggttactcttcctaggttgagatccaaagctgggaaaagcagagaga

SEQ ID NO: 114842 - DNA, 728 bp, Homo sapiens
ggccacgtcactgtccttaggccctggagagcgcggctccgcccctaccgcccccaccggagcgctgggcacttagctaagacgcaccggccccagcccagggccagcccagtcgccgccgcccgcccacaaagccacaggcaggtgcaggcgcagcgcgggagagcgtatggagccgagccgttagcgcgcgccgtcggtgagtcagtccgtccgtccgtccgtccgtcggggcgccgcagctcccgccaggcccatgcggccccggcccctcgtctccccgcacccggagccacccggtggagcgggccttgccgcggcagccatgtccatgggcctggagatcacgggcaccgcgctggccgtgctgggctggctgggcaccatcgtgtgcttgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggccgcgccctcatcgtggtggcccatcctgcttggccgccttcggggctgctaggtggcgctggtgggcgcccgtgccaccaactgcgtgcaggacgacacgggccaaggccaagatcaccatcgtggcaggccgtgcttgttccctttctcgccgccttgttcacct

SEQ ID NO: 114843 - DNA, 351 bp, Homo sapiens
acactcccaagccaacagcacaccactaaaaagtcaacgaacaaatatcaagaaacaaagcttcccagttggttgggaatgagaagcagccaggtcttctctcttctgttgcaggtacacgtcacaccaccatggaatcttctcttttgatttagtgagggagactggcgtcttctagatgtgcagtgtatgacaagcttctctcatccttgcatgtctgcagaggtgtgacatggttttgtgacacagcttctagtcttggggggattcattgtgctcaccctttttttcctggccagttgctaactcaaacctgtccccttctgggatttggaaaggattgtttgcagc

SEQ ID NO: 114844 - DNA, 345 bp, Homo sapiens
gttttagtactctggaagtaggatttcaaagcaaaagcttaactttttaaatacctagctggcttacgcagtgcaatatttccaaatcattttgtttccatataaaaaaataataatcaaactaaggctgctggtagccagtattaacaaataagatctttcttcaattacccaatatgaacgaaccttcaatgattattttagtcacatgaagtctacatttcactttcaaacactctatggtaaactttacaactctagcttaaaattgtagcactgacataaggcaagatttcaaaaagctttcttcatttgggagcaactgaggagaaattttaggtaatt

SEQ ID NO: 114845 - DNA, 648 bp, Homo sapiens
caagatttcgccatgttagccaggctggtctcgaactcctgacctcaggtgatctgccagcctcagcctcccaacatgctaggattacaggtgtaagccaccgcgcccagccccagaatactttataaagaataaaagttttctttttggcttaataagtattttaatgaaaatggatattgtctttaatcacgtacttttgttgagatgatacatattcttttttacctgtaatacctcaatgtggtgattgcattaatgttagtcataatgtgttctatttttaatatttattcagcagatacctgtttggttattgcattgtgtcaggaactatgtcacacactggtgttagcactaagtctgaaaggttcatttttttttatggagaagaaataataagcaagtatccaagaacaagataatttcaggctgtggtagtattatggaggaaataaagaggatggtgtggtagaaagataaggagagaaactccgttgatagtatcatctgagtaagtaaaacataagctaagacctgaagaacgaaagggttgggaaaagcattccagacagctgagtgcgatggctcacgcctgtaatgccagcactttgggtggctgagggggcggaatggtagccaggcatg

SEQ ID NO: 114846 - DNA, 1041 bp, Homo sapiens
aatgtgattgtggttgaggcttaagggtactgctaagataaaattatttttaggtttcaagcacttgatgtttttaattttttgtgtcttatagatagtatctgacagatagccagtctttagggagcttattttagttatggagttatatattattgccatatggtgccatgacttaaaatgttctcatgctgacaatactataggaggaataaagtaaacaagcaaaatccagtaaaccaaataggaatgggtaagcaatatgtagggtgactcagaatgcatgagatgttggtagtgcttacactagaacacagcatgtctatctagtgttgtctttgtgcttgaccatctgtgacatctatattgctttctggcctattgccaggtcttgattgaccattaccagtcccttcttacaaaatactaaaaacacctgggtgtgtaaatagcggaggtaatggaaggactgaggcagcttcaaagaactacattgtggaaagttgccataatggtcagagccacccttgttcattcattcttaactttggttatacagtaactcaaggattgaaatatatttggtagcactgacagtttcattgcaaaatattatctaggccctttggggctacttatcaccatccatccctctgagcataggctggacatttaattgtgaaaaaacacaaccacgaaacacaggtaaagtaaaaaagataaaactaaaccatgggtgatcattagtagaccagaattcattaacataatcattatccagagggtgcagaatttcccccccaaatgatagcatttcataaatttataatattgtataaataactctcagatgttttcattatccatttattttgcatgggaaatataacttatttttatagtgtaatttcatttgggtttctaaaagtacatgatgttactgttattacatcaatatcatttataacaagttcttttccattcagatattcagaatccacatattaaatattagattggtacattatggctctagaactg

SEQ ID NO: 114847 - DNA, 747 bp, Homo sapiens
acagagagacagagtcttggtatgttgccctgtctccaactcctgggctcaagtgattctcctacttcagcccctggagtagctgggactacaggcacacaccaccttgcctggctatttaagctaatttcttttggcactctgtagcctcccacattcagttcctcacatttattttacctataatttcttctaccaattctcctgtattttctccttttcttttgctttcctgttctctgtggtgtcttcctttgtctctctttgcctcctcttgcctcccctatcttttttttcttttaggttgggtttcctttttttccctttaggttttcccttaggtcttcatgggcgttgctttgcctcactaacagttaacataaagacgtatttctgtttcttgtacccatgtgctaaaggtacaactgttaggataccacttcatttcagttagatctagtttaggcatacaattgtaatccaagaagactgatctcttctagtgattcagattggttttatctttgatttttagatttcatctgcatttcttgattaattactcattttggtttagttgacagttgagcaaaaaaaaaattactttctccggagtaaatcatctgttttatttatgctttctatgttgttctatgttgtagtgcagtagcacattaggaggtatctttgtggagtgaaaagatttttgtggctgggcgcggtggtggttcatgcctgtaatcccag

SEQ ID NO: 114848 - DNA, 280 bp, Homo sapiens
atccccagccactgtaagcaccatcctaccctctgcttctatgagagagatttcattgactcaggtcatgttatcaagaagacattcaagggccaggtgtggtggcacacacctgtaatcccagcactttgggaggccgaggtgggcggaccacttgagatcaggagttcgagaccagcctggccaacatggcaaaaccccatctctactaaaaatacaaaaaatttagctgggcatggtggtgtgtgcctgtaatcccagttactcgggaggctgaggc

SEQ ID NO: 114849 - DNA, 822 bp, Homo sapiens
ctagtctttttttatgctcgtaatcatatccatgttggtagaaatgcctctaatttttttttagctatagttcgtgttttgaaataatctcaaccttagagaaaaattgtaggaatagtacaaagaactcccataaaagcttcttgcaaattcctcaattattgacaatttacaaaatttcctttctcatctttcaaaatatagatgtatgtgtgtctgtatatgcatttttttttaaattttgtttcgaaccacttgaagttaagttgcagacatgattccctcattacccctgaattctctaatgcagtgattttccaagtatgatccccttgacaagtaacaccaacattgaaatcatctgggaactaacaagtacatttctaacaaaagtacaaattcttaggaccctccctggacctactgaatcaaaaactcttggtttaacaagccctccaggtgattctaatgaatgaatgaatgctgaaacttgggaaccactgcttagtgtatatttctgcaaacaagagctctcacttaaatatctatagtacaattatcaaaagcaaaaaattatcattaatacaatattaacatctgatgtaatacaatacctactctggtaaattataatttgttgccatcattattttaatgctcaaatcgtcctagatttgatcaatgagaaccctttgaagctggcttttatatcattttgatatattcccatcataatttgagggctttctagaacaaaaaggtatttcaggcagatcttttaccttccctacccctgccctgggatcagttgtttctcctagg

SEQ ID NO: 114850 - DNA, 735 bp, Homo sapiens
ccttggcctcccaaagagctgggattacaggcatgaaccacagcgcccagcccccagaagagtttttaaaaggtgttaaaggaggtttatgcacgtaacagacctttctcaggtggtcccctaaaaaaaatcctgccaactagggaggggaagtccaacctgctatttgaaagccttcacggtttgccaaatgtacatttcttgagaattatcttctttcccagggatattgtacctagaggacaggttggttagggaactatggacgaccagaagagatgttcttttgaagcattcttactggataaagtaaccccatggtatcattactttctacaagttttttacttacaaatttgccatttttttaactgatattttctaaatgctcattctgtctatgtagccggggggagattatatacaagttttaaaacttctttgtgatagtgtattgtgctctggggtctattcaaaatttggtgtttgaggttttgttaatttgattgcctggagatctgctaaaatcctagaatctcaaaaagccaagtttgaagccactgagagcaaacaatgaggtcattgttagcctggttccacactcctgaggacttggctgttctttttcaccttattatgttctaatggaagtaaaaaccctcatagtgaagaagagcagtatatacaccagactagtgtataggaacttcttcattaaatattgcagtccttatg

SEQ ID NO: 114851 - DNA, 375 bp, Homo sapiens
tttctgattggactactgcttggcagcatttgtggacatttgtccaacggcaagagggagggatgactgtctggtagctaaaaccctacaagagaatgagctggaggtggaagataacgcagtagaaaggcattgagctgtgactaaagaggccaggtttctagtttgagctctaaccctatttcattatgtaaccatagccatataacccataaaaagtctttttcctaaaagacggggttggtctagactatttccgggggctcctttacttttagtagcctatgacacccacgctgtgaattcacaaactacgtttttctgacacaactttgtactacaaatcacctatataactgaattttcctactccaa

SEQ ID NO: 114852 - DNA, 184 bp, Homo sapiens
acagtttaaatctgtgttgttccagggtcaactgtattattattatgattgttgcagtaattaaattaaaatattgtaacaaaattgggccaatgtttaaaccttattctcacattttttaactttatataggtagaaagacatactggctatgctcaaaagtctatgtaccaccatgatgcag

SEQ ID NO: 114853 - DNA, 323 bp, Homo sapiens
agcaagagaccgaaacttaagtgtgtgacaacctcagtactgtagttaagctacattccccaaattcgcttttgtgaactgactgggaccctaatctctttcgtaactgtttgagaaaaactctgaagcacctgatattcacacaaactcatggtacctacttaactcatttgtaaattggcgatgtagctggctgtagtattgctttgataatttttttcttttaatttacctaatatatataaggaaggggtttggatatattaaaataggtgttaattttatctatttaccaataaattcatctctttaattcagtggct

SEQ ID NO: 114854 - DNA, 657 bp, Homo sapiens
gttttacacaatgttctccctttgtctctagttcttgttttagtcctaaagggttttttcagctcttactgacacaggcaaatctatactgatgttgaacaggcgaagtgggaggagtctatcacacggtaatgtcactagtggattctgtgatgtccctgatggacagctggaactgtaggaagaaggaggactgttgtccacactgtagctgccttgtctgcagaaatccccgattcttgtaaatgcaaacatagttgatctgtggtgtaaagtttctcataagattattgtaaacagatcaatactactttcttaaaagtttttctgctgtttcttgttatttctgaagcagaccctgaggagaaatagcatggtatggtctaccagttcttaaagtcataaagcatttagccatgtgttaaaaggggcgtggcatggggctcagctcattaattctgaaaaccaatttccctaatgttgaaagatgaaacttcaaaattggtattatcctgaatattgctagccccttcctaccctctttataattgtataatctgagtttttgccagacagtaaaattatggtctccatttttccatttccataacagcatttgttaatagataattgcaaaactggtagcaatttaaccaa

SEQ ID NO: 114855 - DNA, 318 bp, Homo sapiens
ggcgttgtattggctcttacttctctgtggaccattattgtcccaggtatcatcatggctaactcatggcaacttctcaaagaggagaccatcctgtttaaaaccaaaaacccaaactagggccacctgtaatcccagctactcaggaggatgaggcaggataatcgcttgaacccgggaggcagaggttgcagtgagccgagatcacgccattgcactctggcctgggtgataaggcaagactccgtctcaaaaaaaagaaaaaagaggtgacatcacaaattcctgtctttcaataactcagaaggtctgggagtg

SEQ ID NO: 114856 - DNA, 419 bp, Homo sapiens
  misc_feature (418)..(418): n is a, c, g, or t
gcaaataataacccaggctgacatttgtcaaataagtgactatgcgatggatagtatgctaagcaatttacttgcatttatctcagttaatttccctagcaccccattagtttatttcagtcattatcattaccattttacaggtgtagaaagtggggcttagtgatgttttggttgctcaaggtgaaacacctgataagtgatgatgatgctgggcttcaataagggctgggattttagggcccatactttaaaccagtatccttcactgactcccattaagaatgaatagggggaggagctgttcctattctgccatcatgccagcaagtcccccatacctaatttttattcatagcattgtatgctttcttcttttaaaaaaaccttataaattatatgaggctttgggcccctng

SEQ ID NO: 114857 - DNA, 180 bp, Homo sapiens
gcctgtcctggggatgttctgggtctagggctctctttgaccatagcacacaccaagtctgtgtcttccagagcagcctctgtgcctgttcgctgcctctccttgaagtgctattgcattgagacagagaacacatagtttttcttcaagtgggtccttgctcaccctgaagtgcacctg

SEQ ID NO: 114858 - DNA, 400 bp, Homo sapiens
tcctcaattgatcctgctacctcagcctcccaaaatgctgaattacaggcatgagccactgtacctggtcttaaacaattttaaaataacatttttatccaggattttagttaattttcaacaggtggattagttcttgctgtattctcgtaaacagaagtcctggtttatttttatttgttttaaacattgaatcccatactcctccccaccttaccctacccagaatttagactgttaatgttttgaagccacagcctgcatcttaatcactattttatcttagtgcctggtcttagaaattatattgactctttgatagaccatatataaggcaggtggatgagaatgtgggtagctagttggaaaaggctgcttggtcatttgcttgattattttc

SEQ ID NO: 114859 - DNA, 326 bp, Homo sapiens
gcagtggcagaaccatccagagggcaccttacatgttgtctacagtgtgccaataaatagtcctggcagacgggccgtgttttagggaataagtcattttggataagcatgatctctgggtagtggagacctgcttcttttaggcatactatattcatgctattaagggtaatttgtgagatgcgagtaaatttccttttctctctctgttcatcacttgctctcttttctcctatactgtgccaaaccaggcactgctttcgatctccgtggttcatttaatctcttttctgatttctcatttccaaattctgctcacgacccct

SEQ ID NO: 114860 - DNA, 391 bp, Homo sapiens
tcaacgttggctgggcacctgacttccattatcatagctctgcgatcctctaatccatctcccccatgaccttgtgaagttgatcttaatccattttacacacaagaatactgaggctcagaaaggttaagccagttgcccaaagtcctcaagtcaagaataggagagttaagatttgaatccagttttgtctggttgcaaaattcactctcttaaccattgttccctgctggcacctggcacaggtaatacactttcattgtcataggattgcagggctttgtttctgatggagtcagggtgactttgagacagggtttcactaccattccctaggctggaatgcggtggcaccatctcagctcactgcaacctctgcctcccaggctca

SEQ ID NO: 114861 - DNA, 207 bp, Homo sapiens
atggagaggtgcaggcagggcccagagcatgtgtgcctggtctggcgggtacccctcaggacacacagtggcatatgcccattatattgctcctgtgcagcctccccaagggcaaatttagcagataaagatgtacacgcttcaagtcgggctccagagaaaccacagatacaattgtagtatcagtccaccccatgcgggttctcg

SEQ ID NO: 114862 - DNA, 369 bp, Homo sapiens
gggattacaggtgtgagccactgcacctggctaacttgatttcaaaaaaaaaagaatgaagtatgagaaaaagttaaaatgggctttttagatttagtgagatacaatgctatgttactctacaaagatatctagcaatacagagtataggaatttatttctcacacagtagtcaagagggctggtccaggtccaggtcagtggtgcaggtcttctctgcacagccgttcaggaaccctgggtcttcccatttgtttgctttttctgccattttctaaggcagtgggcctctgagacttcagtgtacatcatcatcccctgggaggcttgttgaagcccccatggctcaaccccacccaaagtttctcg

SEQ ID NO: 114863 - DNA, 431 bp, Homo sapiens
attttctgattccaaagatgcaatcaaattttgaagagccaagaggaaatctactacaacaacaaaagtaatagcttcactatgatcacagagatgatcaatgatctaaatgcctcacctattttcagcagagccatggatacaagtaatcacaaggcagaagatattttccctttgcttctgaactgcttttggtggcaatgatacaaatacaaattgtggttgatgtttgcataagggcacagacatgcttggtccaagctgaagtaaagattccaagttgtggaccgtcctgcccacattctgcatcatgatgtcaaaatagcatctgatgttctttgcattttcattgaagtaattatcacaaaattgttctcttacttcagcatttacactattagaattgagtgattaaaggattgtgtgatttt

SEQ ID NO: 114864 - DNA, 296 bp, Homo sapiens
ttcaactgtctgaggctggattgagctattcaaaagacggagctgctcatcctggcctccttgtcaggatgccaagccctctccaggggtctagaaacagcaaagatgttccctgttacccaaagcagttgctctgaggcccccatttaggaatccacccagtaaattaatgaccaactcaattgcttcctctgccaggcagcacactctctaggaatatctgccccaggtatacctgatcaacatcacactcatgtgacattaccaggacaggatgttagtttaaaaagcaaaaa

SEQ ID NO: 114865 - DNA, 621 bp, Homo sapiens
ccgtcacgaacgtacccctgctgggcccccgcaagtgcaccaaccgactcgaaagtcccagagagggctggcgggcaaggacctgagtctccagccacccctgcaggaggagcccagggaccctcgcatccctgataaggaagcaggtggcgtgccctgctgtgaccccgaaacagcctgtagtctcaccctccatttccacgagactctaagtctgccgcttttgcagcaaaagcccagtgctgggggtgagcgtgtggggagtgtgggagacgggctctgacccggccaccctgggcagctgtgctcacgcagcacccccgccgttcccagctggacttcacctggcaggacagccaacaggcctcaccgtggcctccgtcccgggggtcgtgcatgggggactgggccagcccgagcagtgggacatgctgccttcctaccctgctccacctgccacaaacacaaactggaatgttctcagccacctccagacttcacaccctttgggctttggggcacagaggtcgggctgccctggggaaaggagggagagaaggaggcttcgagagagcacggacatgagtcagacctgaaataaagcaaagccacaccgcctca

SEQ ID NO: 114866 - DNA, 542 bp, Homo sapiens
  misc_feature (528)..(528): n is a, c, g, or t
ttcagtcaccttaatgttattggaaagttaatgtccatagtataaaccttagagcactacctaacaggacaaaataagcaaaaacatatgactaataatctattagttgaaataaaataaaattcaaaattaaacacttaatccaaggtaaagcatcaaaagtggaaaatagtaataaagaacagattaaattttatggaaaataaattttatgatagtagatttaaggccaaaatatagataacaatattaaatataagtagtctaaaactactatttaaagtaagaattttaagactaaatttaaaaagtaatgttaaatcaatataaagacaaaggttggtcagaaaaaataggttgaagatagctgtacttcaccatgatacagtaagaggaactaaactaaattctttacaaaacaaacaaacaaaaaacaaaaaaacacacacacaaataaaaactaactgcagacaaaatataatcaacagtgattttttaaccattgacaagaagctgaggatgctgatncctgtggaaaagta

SEQ ID NO: 114867 - DNA, 198 bp, Homo sapiens
accccacagctgcagggcttcaggctcggtcagccacacttcctgtcctcaccaccggccctccttcctcggctccctcagacaagcacaaccttcctcctgaggaggaggccaggaaccctcatcttgcaaatccagtggttaatttccacctgcatctgacttgactttctgcccttggcttccagaacatgattc

SEQ ID NO: 114868 - DNA, 382 bp, Homo sapiens
acgaagaagcatgggttactgagcatctactgcgtgtcaggcactgttcagatatggagacataccaactcatacaatcctcaccccaacccatgaggtagatgctgttatcatccccactttacggaagaggaaactgaggcacggagaggttcattaatttagccagagagtcaataagtaacaaagcttgtatttaaactggggcagcctggctgtagagcccatctacctaaccactgctctgtcttattgtaccgtgattattgtttctatttcaatttcccctctcccatctttctttcattctgttccacttaccctcattactgatcttccttctctgccatcctgaccccttcctgtccttggatgcctttgg

SEQ ID NO: 114869 - DNA, 578 bp, Homo sapiens
tccccttgcacaacgggcaaagaccggccaaggagcatctgctaagttcttataggagcttctgggctcaatcacccactgatcgccaagctgggtgctggcgatgcaatgggggcaggatctagccacaggcttgggggagcatatgagtcacaaataaaggcctgtgtacccccaggcttccttcccacacccatggcaggcattaccaattggtccccatgctctcttacagagctccttgtagcctcagaattgctattctgtatagcactccaggctgtcactctcaggcagagcataagacaaaacctacagcacttgatgtccctgttagtggagcaactactacattctgctgggttcagccacatctgggagagctagggcctggtcttggtctctggcctaggagagagcagccagatggtgtcaagcttagaccctcagtttgggaacttcaatggagaggcacagagggcctgggggtggggggatttggttttgctacagaatcccagcttcttggccaagactctccacgagagtggtttccttggcccggatgccagaatggg

SEQ ID NO: 114870 - DNA, 442 bp, Homo sapiens
  misc_feature (66)..(66): n is a, c, g, or t
ggtattgcatttcttttacttgtgtgttattagtccatatggaaaatacaatgtttttatgtatgnaaatggccgatttgaaaagagtatataaacatagacatactgtgtttgcccttttttaaaaaaagggctgtttaaatgggtccctaagataactttttgataatgtaatattgacatgataaaattgtaaacttcataattctggcacaggaacaatttatgaaaacatactaaggtatttgtaaattgatgaaataatatatatcttaggaaagtcataattattacacttgtacatacccttaaaataaaagagcctgcttgaaatgttgcaaaaagaaacagaaatacctgctaatatgcccttctaattaaggatgatgccaattaatctctttatataaataataaactttgagttgttttaaaaaaaaaa

SEQ ID NO: 114871 - DNA, 440 bp, Homo sapiens
cttgtccccaaaaagcagaggacccgggaggtaggcattttacagccaggaagtatcgctggaccatggcccacagttaagacacagtatctgggaccagaagaaagcaataaaaggtcaggacacacgtgccttgtgggtgggagcagaagagatggcccaacatacacagtcatgttatggaatgtaacccttacatgttatggaatgtaacccttattcatgacggttacattccataaagtcaccacaaacatgaagtagtggacactgagacgttggtcctgaggaactacagagttgtttcctgtgagcctctgcccacattttgtcaaccaatcaatacataaccttgttttaagtgtgtttctatttaaagacaccttatttaatatatatgattgattcatgaacattaaactcctggccactagcaccgt

SEQ ID NO: 114872 - DNA, 487 bp, Homo sapiens
ccccagtatgggttctctgatgtaccataagactagaattataactgaagaccttcccacactcattacattcatagggtttctcaccatgcctgtaatcccagctactcgggaggctgaggtaggagaatcgcttgaacccgggaggcagatgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaa

SEQ ID NO: 114873 - DNA, 429 bp, Homo sapiens
aacaaccttggttttctgggacttttcttttatgagtatttttttattaatgtaaagtttcaaagaaggctaatcaaacacaaaaatatctgcaaagagccacaataagccttgaacaacatacagtcagtaaaacatcaaggtttaaattgttgctttaacttccttttggctggaagctccatattctggtaattcaccaaaatggccaacacaaggaaaacaggagaggcacccagtgtatgttttctaggccttttagaaaacatggagttggccacatgcatgggagtctataaaaaaggtgatactgtagacatcaagggaatgggtatggttcaaaaaggaatgcctcacaagtgttaccatggcaaaaactggaagagtctataatgttactcagcatgctgttagcattgctgtagggaa

SEQ ID NO: 114874 - DNA, 272 bp, Homo sapiens
tgagccaccacgcccggccgtctgtgacctcattttttataactattccttttctgtcactcagctctggccacactgtcctcagtgttccttgaaattccagggcatgctaccttactgccctccagggccttgcatgtatccccatgcagtgggataaaagcctttggcttttccctcacttttttcagtaagacatcctctgactctcctatttaaaattgtacccaccaatactcccagtcctccttccatgttttatttttctctgt

SEQ ID NO: 114875 - DNA, 684 bp, Homo sapiens
ggggaagccagcctctgcttgaggaggggaggctccagggcagaaggaagaggctggaggtgaaccttcactttggtccctgaagggatgggcagtagcagcagagcccggaaggccagccttcccagagagtgaccttgtctttggcccttctgtccttggccagaatgcgtgtctttgcagggtaactggagggtagagtaggtctttggcggggctgatggaatgggtgtccaagcaggggaggaaggcggtgtggatgcagcctgcctgatctgggatgtcactttttgctggcgaccaggaggagaggccttcccccacagcccctcccccccatgcccgcatggggcacctctctcaggtccctgtgccacaatttccttgccacctggtaccatttaacaagagaagtggcatcgcattctccagccaagagtctgggaaccttccaagcactggggaacacagtgctgtcactgccgccagctcccagctgagcttggcaggggccctggaaccaggaggcctcccactctagagttgggggctggcctgcccctgcctcacagcagagctgagccacacttaaatggcaggcaggtgccctcagacctgctgtccctggaaggcgggggatgggtggccagagagtggggttgcttcacgccatctggagaccca

SEQ ID NO: 114876 - DNA, 2139 bp, Homo sapiens
agggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttgaag

SEQ ID NO: 114877 - DNA, 1467 bp, Homo sapiens
tttcagtgtgaggagtctgatagcagcccatcccatttgggtgggaaggttatagaccttgcacattaatgccatgctcaaagcagatttgcaggtatcctgcaacacagggactttcacaaaacccgctttggcttattctacctgaactacttattttaattaactaaatggatatcccaagcattccatgtttatcctgttgctcagtgaatcctcaaatcgttaatttggtagattctcttttttgtcttcatactattatttcttttagcttttaaaaaaattgtgtactgcctacaggtctttatggaagtttcacctttctttgtgtcgcactggcatcggctgtataatttttgcagctagaccacattttaaaaaaatctacatttttggaactagtaaaagatacttatttgtgttatttaagtattcacgtcttttaccgtgggtagttaagtttaataatttaaaaagacacattttatcagtaacaatgttcattttatttttcagactcttccctctactacttactctgtatttctgtctcttctaatgactaggaaaggcagtttctcaaaatcatcttctatttagttggcaaatgtgataatgtgggtagtgttcctaccttcctgctgtatgtgttctactgaaatgagatataatagccatctggctacaattttgatttctaagaagttcttatgtcattttaaattcaaaaactaagtatttcaacatttggtctctcatatcttaagttttattttctttgttccagctgttcagagatagtgtgttctaatatctccacaatcaagatttttgactaaaatggatcagtacatgaaaaagagggactagtattaattttagatcttgttagttaatcatggtcttactaataatttggcaagttctttaatgagccaaatctttgtatttcaaatgccttgaagttgtattctttcctattagtaccctgatgggaggatgaaaacagcagaaaggagcagcaccagatgatcttttcatgggcacgtactctttcaaggaatcccatggagctcagtgaaattacactttggcttagagataattaagttgtggaaggaggtttaagagaggagcttaggtgaaatttgagctgtaaatgagtatgctaaattaaagaaatgattagtaataaatgagatttgctattaagaaattcactttggatctgagacaacattttacatacaatgtagaaaactttatggtcagaacagaacacagtctgaacctaaattaacagtagtgttaaagaattcagggcgggatattatccaagaaggcctagccagctgctccacttaatgttacatcacaagtggtttctgtgttgctattgtttttattagcatttcaatgactgtgtcatattacattaaatcaattggctctaacttacctaac

SEQ ID NO: 114878 - DNA, 1702 bp, Homo sapiens
gttagaggaggtcctgtgcagccttctgactcctttattactttcacagagtcagattgctttcttctaaaatagcccctctatgtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttgaag

SEQ ID NO: 114879 - DNA, 1284 bp, Homo sapiens
gatcataactcaggaaaagacagatattggtcaatatttccttccaaaagtggagatgataaagtagaagtatagaaatcctaaagtccagaccttccttgttcagccaggttttgctccttctccacacacctttgttcttttctccaacttccaaggaatctcacaaaggaagtgggaaacaatgaacctattacttctttcctgctttaaatccaattccacgtagtcacggagactgttgggcaggatctctggcttggtggaaagtggggcgtgctgcctaaagtgatagtttggaggccttctctgtgccgtcgctatgggaatgccagctatatgttggctgggtgcggggcccagtcgccaggccacactgcacgcctccacatcctcagagggcccgggacttgggtcctggccccgccccctgcggacccggcactctgtcagttccgtccccggtcctgggaaccgctctttatcccactctgcgtgtctgccggaacctggctgggaagcgctacttgctgccctgccagcccgggtgagggcggagccaggcctccagccgcgaggactggagtcgcgggaggtggagccccagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgaggaccagcagagagaagagattccatcttcctaccctgatgggaggatgaaaacagcagaaaggagcagcaccagatgatcttttcatgggcacgtactctttcaaggaatcccatggagctcagtgaaattacactttggcttagagataattaagttgtggaaggaggtttaagagaggagcttaggtgaaatttgagctgtaaatgagtatgctaaattaaagaaatgattagtaataaatgagatttgctattaagaaattcactttggatctgagacaacattttacatacaatgtagaaaactttatggtcagaacagaacacagtctgaacctaaattaacagtagtgttaaagaattcagggcgggatattatccaagaaggcctagccagctgctccacttaatgttacatcacaagtggtttctgtgttgctattgtttttattagcatttcaatgactgtgtcatattacattaaatcaattggctctaacttacctaac

SEQ ID NO: 114880 - DNA, 427 bp, Homo sapiens
tttcagtgtgaggagtctgatagcagcccatcccatttgggtgggaaggttatagaccttgcacattaatgccatgctcaaagcagatttgcaggtatcctgcaacacagggactttcacaaaacccgctttggcttattctacctgaactacttattttaattaactaaatggatatcccaagcattccatgtttatcctgttgctcagtgaatcctcaaatcgttaatttggtagattctcttttttgtcttcatactattatttcttttagcttttaaaaaaattgtgtactgcctacaggtctttatggaagtttcacctttctttgtgtcgcactggcatcggctgtataatttttgcagctagaccacattttaaaaaaatctacatttttggaactagtaaaagatacttatttgtgtta

SEQ ID NO: 114881 - DNA, 944 bp, Homo sapiens
gatcataactcaggaaaagacagatattggtcaatatttccttccaaaagtggagatgataaagtagaagtatagaaatcctaaagtccagaccttccttgttcagccaggttttgctccttctccacacacctttgttcttttctccaacttccaaggaatctcacaaaggaagtgggaaacaatgaacctattacttctttcctgctttaaatccaattccacgtagtcacggagactgttgggcaggatctctggcttggtggaaagtggggcgtgctgcctaaagtgatagtttggaggccttctctgtgccgtcgctatgggaatgccagctatatgttggctgggtgcggggcccagtcgccaggccacactgcacgcctccacatcctcagagggcccgggacttgggtcctggccccgccccctgcggacccggcactctgtcagttccgtccccggtcctgggaaccgctctttatcccactctgcgtgtctgccggaacctggctgggaagcgctacttgctgccctgccagcccgggtgagggcggagccaggcctccagccgcgaggactggagtcgcgggaggtggagccccagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgagaccacagagagagagagaaaaaaaagatacaaatggcttaatttgagaagtgagtgataaaagactaaggaaaccaagattcaaactcacatctctttgcctaaccacagtgctagagtaaacactccctaaaggcaggctctgaactgggtaccaaaggatccaaaaac

SEQ ID NO: 114882 - DNA, 2504 bp, Homo sapiens
aaactagaataataaaagggaaattataatattcacaaacttgaagcacactggaattctgctataaatgtttgttatagaatagaatttggtgcagggtgaatttgatttaagagggtttaaattatatgaactgtgtgaaaacatttagatctaaggctgaaaacaattatcaactcaatgaaattttaatatggtatttcacaactgtgacttcatgacagctgttacaagtgtcaggaatggtaaatatgtactatttactaatgccaacactgtacagaagtgctttatatacaataaatcatttattactcacagcaatccttaccagtagatgctatttctatctgaggtttgtggttaaggaaaaagagtgaactgagtaactggtgtgagttcactcagtgagtaagtaccagagcgttgtcaagagaaccaagtgtagcatccttcgtaccatagtcacagtcctacagcagaaatttaagagagcatcaagagagatgcttgcttacccgctttgtatttacttgctctctgagaagtctacttctcatttatttctggaacacaattaggtaaactctatctatttcaaatgttctcttcagttgtctagtttgaagcctttgaggattagcaccttccagtttattcaagggaattggacaaagaaatgagaatgaactataggattaaaggataaaactaaagaaggtgagttagaagagtttgagttcatggcgcagatttaacataaaataatcgaataattagtaggcataaaaaggtggatatcgacctaactagtaagcatggagatatgtgtatttgtctaaaactcatttcttcatttggggaaaaaaagtattgctataattacttttcatgagaaattatcaaatttatgtatccagaacactgattattattaaaatgtttgaccagagtgggaatttttttttatcattctgaactctttcctattttattctgtttaattcaagatggtttctaaattttaattttactttgttttagaatttatatttcctttctctatgggagaaaccccagttctgtgtttgagtgtatagaataattccacatagggagaattgcagtaaacattataaccctgtaatctgccttgtatctgttagacaattagtgaatgctgttgaagaaatgagtgaatcctgtagtttttcagcaccacttttttgtgtgttaagtctcatccttctgcatatgtttctacatgtaagagattagtgcataaacaatttaactgatcaagattggtgaagatcttgtgcccgcacccatgaaagttttctatagctatatagtatctattgtatacaggccacgttaggaatgcatattttataacttgaataatgtgttagcctcttacctcttcactatattggttacctttcaaacatacaagggctgagttctttctccctttagatcttagcgtaaatgtcactgctttggggaagcttttccagcccatgcccctaagttgttttcattctgttgttctctatttggaacctcctttttttctgtgacagagacaatttaagttctccaaatatccacatgtcctcttatattttggggcttctctttgcaattagattgagcccatgtgactactggacaatagattgtaaaaggaagagacatttttggaaccacttccagactgagatggttaaaagctgttgtgccctcctccttcacttctgtttctgttgcattgttcttggaaactaggtattacagatggttgtaaattacaaaaagtagggcagtagaattcttattggacttgacatgaataagaaataaatacccttttataaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactttggggggggccccggacccaaattggccttatagggagtcgttttacatttaatgggccgtcgtttaaaaacgtcggaattggaaaaaccttggggttaccaaattaaatcgctttgaagaaaatccccttttggcaagttggcgtaataccaaaaaggcccgaaccaatggcctttccaaaaatttgccaaccctgaatggcaaagggcaaattgaaagcgtaaatttttggtaaaaattcgcgtaaaattttggtaaaataagttaatttttaaaccaatgggccgaattgggaaaaatcctttttaaatcaaagaattgacccgaaatgggtttgatggttgttccatttgggaacaagagtccccttttaaggacactgacttcaaacgaaaaggccaaaaaaccgtttttaagggcaagggcccaatacgggaccctttaccctaataagattttttggggccaagtcgccaaaagcctaaattggacccctaagggaaccccctttt

SEQ ID NO: 114883 - DNA, 818 bp, Homo sapiens
atatattttgatagttttattttttaagaggcactagcaagttagataaggcgggggttttgacgcctctttgtactgaataccatctctgaaggtgaggttggccacaaggttgaaaacacctgtggactggtgggtctcgggtgggaggaattcggacagtgtgttgatgcttattgggtgtctcttttctcttctaggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctcaatgagttttcctttaaaatttgcagtgaatttgttttcctgtttatgcatgagaatttaggtcttattaattgggggaaattaatgttaaagtaataaataagcccttgttgcagcttattgtttcttgaaatgaattaactatccaggcaaaaggtt

SEQ ID NO: 114884 - DNA, 912 bp, Homo sapiens
gcacaacaagtccccagggacagctaagcactccagtgtctagggactgtgggaaactggaaagaaacaatccagtgtaaatatgacttctaagctggctgtgctctactgctttcttggcagttgcatgctttctgtagcactgtgtgaagtgtgaagcttattcatgaagagacctctgcctgaacatacagcaaatttaagaaggttgtgcagatagtctgaaggaggctggtgcagcatggaaacacggatttgagctcattactccaattttcacgctgagtttggaagggtcctagagggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctcaatgagttttcctttaaaatttgcagtgaatttgttttcctgtttatgcatgagaatttaggtcttattaattgggggaaattaatgttaaagtaataaataagcccttgttgcagcaaaaaaaaaatacatggccttgttggcctta

SEQ ID NO: 114885 - DNA, 2700 bp, Homo sapiens
gctgtacggccgggatattagggatctcgttcaccagagcacctactatgttccaggtggtatcataagaacttgggagacatcactaaacaaaatagaaaaatccctgcccttatggagctgacattctagtgggggcttggtttttttccttgggtactgggtttgtttttccatgatgagcatatcctatgatgcactatagcactcaagcaagatgcctgaagcaaaggaggccaaagtaatgattcatggattcagcacactttcctttgttgaaaagcactgcttgttccccctcaaagctatgtgagaggctgtgtaggagagagtggagagcaggtagcctaccggacctacagttcaccatttcagccctgtaattgaccagctgtgggacctcagtgtgaagcttattcatgaagagacctctgcctgaacatacagcaaatttaagaaggttgtgcagatagtctgaaggaggaccagcagagagaagagattccatcttccacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttgaag

SEQ ID NO: 114886 - DNA, 1165 bp, Homo sapiens
gctgtacggccgggatattagggatctcgttcaccagagcacctactatgttccaggtggtatcataagaacttgggagacatcactaaacaaaatagaaaaatccctgcccttatggagctgacattctagtgggggcttggtttttttccttgggtactgggtttgtttttccatgatgagcatatcctatgatgcactatagcactcaagcaagatgcctgaagcaaaggaggccaaagtaatgattcatggattcagcacactttcctttgttgaaaagcactgcttgttccccctcaaagctatgtgagaggctgtgtaggagagagtggagagcaggtagcctaccggacctacagttcaccatttcagccctgtaattgaccagctgtgggacctcagtgtgaagcttattcatgaagagacctctgcctgaacatacagcaaatttaagaaggttgtgcagatagtctgaaggaggctggtgcagcatggaaacacggatttgagctcattactccaattttcacgctgagtttggaagggtcctagagggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctcaatgagttttcctttaaaatttgcagtgaatttgttttcctgtttatgcatgagaatttaggtcttattaattgggggaaattaatgttaaagtaataaataagcccttgttgcagcaaaaaaaaaatacatggccttgttggcctta

SEQ ID NO: 114887 - DNA, 848 bp, Homo sapiens
gcacaacaagtccccagggacagctaagcactccagtgtctagggactgtgggaaactggaaagaaacaatccagtgtaaatatgacttctaagctggctgtgctctactgctttcttggcagttgcatgctttctgtagcactgtgtgaagtgtgaagcttattcatgaagagacctctgcctgaacatacagcaaatttaagaaggttgtgcagatagtctgaaggaggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctcaatgagttttcctttaaaatttgcagtgaatttgttttcctgtttatgcatgagaatttaggtcttattaattgggggaaattaatgttaaagtaataaataagcccttgttgcagcttattgtttcttgaaatgaattaactatccaggcaaaaggtt

SEQ ID NO: 114888 - DNA, 646 bp, Homo sapiens
  misc_feature (23)..(23): n is a, c, g, or t
actactccttccaatatgatgtntatgttatggccttcgagggccaccaggatagaatagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctcaatgagttttcctttaaaatttgcagtgaatttgttttcctgtttatgcatgagaatttaggtcttattaattgggggaaattaatgttaaagtaataaataagcccttgttgcagcttattgtttcttgaaatgaattaactatccaggcaaaaggtt

SEQ ID NO: 114889 - DNA, 3182 bp, Homo sapiens
gatcataactcaggaaaagacagatattggtcaatatttccttccaaaagtggagatgataaagtagaagtatagaaatcctaaagtccagaccttccttgttcagccaggttttgctccttctccacacacctttgttcttttctccaacttccaaggaatctcacaaaggaagtgggaaacaatgaacctattacttctttcctgctttaaatccaattccacgtagtcacggagactgttgggcaggatctctggcttggtggaaagtggggcgtgctgcctaaagtgatagtttggaggccttctctgtgccgtcgctatgggaatgccagctatatgttggctgggtgcggggcccagtcgccaggccacactgcacgcctccacatcctcagagggcccgggacttgggtcctggccccgccccctgcggacccggcactctgtcagttccgtccccggtcctgggaaccgctctttatcccactctgcgtgtctgccggaacctggctgggaagcgctacttgctgccctgccagcccgggtgagggcggagccaggcctccagccgcgaggactggagtcgcgggaggtggagccccagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgaggaccagcagagagaagagattccatcttccacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaagctgtgcaactttgttcaggatttgaaatgctcgggatataagagtacacaggcttgctgtttgtccagtagctgaccctaaagctaaggagaaataaaaatgaccgaatgcagatgctttcctactcctgtcctgaccgtgcagagattcttatcaataagtggtcactttgtcgagttgtctagtttgaagcctttgaggattagcaccttccagtttattcaagggaattggacaaagaaatgagaatgaactataggattaaaggataaaactaaagaaggtgagttagaagagtttgagttcatggcgcagatttaacataaaataatcgaataattagtaggcataaaaaggtggatatcgacctaactagtaagcatggagatatgtgtatttgtctaaaactcatttcttcatttggggaaaaaaagtattgctataattacttttcatgagaaattatcaaatttatgtatccagaacactgattattattaaaatgtttgaccagagtgggaatttttttttatcattctgaactctttcctattttattctgtttaattcaagatggtttctaaattttaattttactttgttttagaatttatatttcctttctctatgggagaaaccccagttctgtgtttgagtgtatagaataattccacatagggagaattgcagtaaacattataaccctgtaatctgccttgtatctgttagacaattagtgaatgctgttgaagaaatgagtgaatcctgtagtttttcagcaccacttttttgtgtgttaagtctcatccttctgcatatgtttctacatgtaagagattagtgcataaacaatttaactgatcaagattggtgaagatcttgtgcccgcacccatgaaagttttctatagctatatagtatctattgtatacaggccacgttaggaatgcatattttataacttgaataatgtgttagcctcttacctcttcactatattggttacctttcaaacatacaagggctgagttctttctccctttagatcttagcgtaaatgtcactgctttggggaagcttttccagcccatgcccctaagttgttttcattctgttgttctctatttggaacctcctttttttctgtgacagagacaatttaagttctccaaatatccacatgtcctcttatattttggggcttctctttgcaattagattgagcccatgtgactactggacaatagattgtaaaaggaagagacatttttggaaccacttccagactgagatggttaaaagctgttgtgccctcctccttcacttctgtttctgttgcattgttcttggaaactaggtattacagatggttgtaaattacaaaaagtagggcagtagaattcttattggacttgacatgaataagaaataaatacccttttataaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactttggggggggccccggacccaaattggccttatagggagtcgttttacatttaatgggccgtcgtttaaaaacgtcggaattggaaaaaccttggggttaccaaattaaatcgctttgaagaaaatccccttttggcaagttggcgtaataccaaaaaggcccgaaccaatggcctttccaaaaatttgccaaccctgaatggcaaagggcaaattgaaagcgtaaatttttggtaaaaattcgcgtaaaattttggtaaaataagttaatttttaaaccaatgggccgaattgggaaaaatcctttttaaatcaaagaattgacccgaaatgggtttgatggttgttccatttgggaacaagagtccccttttaaggacactgacttcaaacgaaaaggccaaaaaaccgtttttaagggcaagggcccaatacgggaccctttaccctaataagattttttggggccaagtcgccaaaagcctaaattggacccctaagggaaccccctttt

SEQ ID NO: 114890 - DNA, 1392 bp, Homo sapiens
gatcataactcaggaaaagacagatattggtcaatatttccttccaaaagtggagatgataaagtagaagtatagaaatcctaaagtccagaccttccttgttcagccaggttttgctccttctccacacacctttgttcttttctccaacttccaaggaatctcacaaaggaagtgggaaacaatgaacctattacttctttcctgctttaaatccaattccacgtagtcacggagactgttgggcaggatctctggcttggtggaaagtggggcgtgctgcctaaagtgatagtttggaggccttctctgtgccgtcgctatgggaatgccagctatatgttggctgggtgcggggcccagtcgccaggccacactgcacgcctccacatcctcagagggcccgggacttgggtcctggccccgccccctgcggacccggcactctgtcagttccgtccccggtcctgggaaccgctctttatcccactctgcgtgtctgccggaacctggctgggaagcgctacttgctgccctgccagcccgggtgagggcggagccaggcctccagccgcgaggactggagtcgcgggaggtggagccccagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgaggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctcaatgagttttcctttaaaatttgcagtgaatttgttttcctgtttatgcatgagaatttaggtcttattaattgggggaaattaatgttaaagtaataaataagcccttgttgcagcttattgtttcttgaaatgaattaactatccaggcaaaaggtt

SEQ ID NO: 114891 - DNA, 869 bp, Homo sapiens
gatcataactcaggaaaagacagatattggtcaatatttccttccaaaagtggagatgataaagtagaagtatagaaatcctaaagtccagaccttccttgttcagccaggttttgctccttctccacacacctttgttcttttctccaacttccaaggaatctcacaaaggaagtgggaaacaatgaacctattacttctttcctgctttaaatccaattccacgtagtcacggagactgttgggcaggatctctggcttggtggaaagtggggcgtgctgcctaaagtgatagtttggaggccttctctgtgccgtcgctatgggaatgccagctatatgttggctgggtgcggggcccagtcgccaggccacactgcacgcctccacatcctcagagggcccgggacttgggtcctggccccgccccctgcggacccggcactctgtcagttccgtccccggtcctgggaaccgctctttatcccactctgcgtgtctgccggaacctggctgggaagcgctacttgctgccctgccagcccgggtgagggcggagccaggcctccagccgcgaggactggagtcgcgggaggtggagccccagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgaggtacgagggctgcgggcgccgggtgcggagccgctggcggtgggaggtcggcgggggcgcgggcggcgctcgcgcgcgtggggcccaaggctcgt

SEQ ID NO: 114892 - DNA, 2961 bp, Homo sapiens
gatcataactcaggaaaagacagatattggtcaatatttccttccaaaagtggagatgataaagtagaagtatagaaatcctaaagtccagaccttccttgttcagccaggttttgctccttctccacacacctttgttcttttctccaacttccaaggaatctcacaaaggaagtgggaaacaatgaacctattacttctttcctgctttaaatccaattccacgtagtcacggagactgttgggcaggatctctggcttggtggaaagtggggcgtgctgcctaaagtgatagtttggaggccttctctgtgccgtcgctatgggaatgccagctatatgttggctgggtgcggggcccagtcgccaggccacactgcacgcctccacatcctcagagggcccgggacttgggtcctggccccgccccctgcggacccggcactctgtcagttccgtccccggtcctgggaaccgctctttatcccactctgcgtgtctgccggaacctggctgggaagcgctacttgctgccctgccagcccgggtgagggcggagccaggcctccagccgcgaggactggagtcgcgggaggtggagccccagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttgaag

SEQ ID NO: 114893 - DNA, 2683 bp, Homo sapiens
gcacaacaagtccccagggacagctaagcactccagtgtctagggactgtgggaaactggaaagaaacaatccagtgtaaatatgacttctaagctggctgtgctctactgctttcttggcagttgcatgctttctgtagcactgtgtgaagtgtgaagcttattcatgaagagacctctgcctgaacatacagcaaatttaagaaggttgtgcagatagtctgaaggaggctggtgcagcatggaaacacggatttgagctcattactccaattttcacgctgagtttggaagggtcctagaggacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaagctgtgcaactttgttcaggatttgaaatgctcgggatataagagtacacaggcttgctgtttgtccagtagctgaccctaaagctaaggagaaataaaaatgaccgaatgcagatgctttcctactcctgtcctgaccgtgcagagattcttatcaataagtggtcactttgtcgagttgtctagtttgaagcctttgaggattagcaccttccagtttattcaagggaattggacaaagaaatgagaatgaactataggattaaaggataaaactaaagaaggtgagttagaagagtttgagttcatggcgcagatttaacataaaataatcgaataattagtaggcataaaaaggtggatatcgacctaactagtaagcatggagatatgtgtatttgtctaaaactcatttcttcatttggggaaaaaaagtattgctataattacttttcatgagaaattatcaaatttatgtatccagaacactgattattattaaaatgtttgaccagagtgggaatttttttttatcattctgaactctttcctattttattctgtttaattcaagatggtttctaaattttaattttactttgttttagaatttatatttcctttctctatgggagaaaccccagttctgtgtttgagtgtatagaataattccacatagggagaattgcagtaaacattataaccctgtaatctgccttgtatctgttagacaattagtgaatgctgttgaagaaatgagtgaatcctgtagtttttcagcaccacttttttgtgtgttaagtctcatccttctgcatatgtttctacatgtaagagattagtgcataaacaatttaactgatcaagattggtgaagatcttgtgcccgcacccatgaaagttttctatagctatatagtatctattgtatacaggccacgttaggaatgcatattttataacttgaataatgtgttagcctcttacctcttcactatattggttacctttcaaacatacaagggctgagttctttctccctttagatcttagcgtaaatgtcactgctttggggaagcttttccagcccatgcccctaagttgttttcattctgttgttctctatttggaacctcctttttttctgtgacagagacaatttaagttctccaaatatccacatgtcctcttatattttggggcttctctttgcaattagattgagcccatgtgactactggacaatagattgtaaaaggaagagacatttttggaaccacttccagactgagatggttaaaagctgttgtgccctcctccttcacttctgtttctgttgcattgttcttggaaactaggtattacagatggttgtaaattacaaaaagtagggcagtagaattcttattggacttgacatgaataagaaataaatacccttttataaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactttggggggggccccggacccaaattggccttatagggagtcgttttacatttaatgggccgtcgtttaaaaacgtcggaattggaaaaaccttggggttaccaaattaaatcgctttgaagaaaatccccttttggcaagttggcgtaataccaaaaaggcccgaaccaatggcctttccaaaaatttgccaaccctgaatggcaaagggcaaattgaaagcgtaaatttttggtaaaaattcgcgtaaaattttggtaaaataagttaatttttaaaccaatgggccgaattgggaaaaatcctttttaaatcaaagaattgacccgaaatgggtttgatggttgttccatttgggaacaagagtccccttttaaggacactgacttcaaacgaaaaggccaaaaaaccgtttttaagggcaagggcccaatacgggaccctttaccctaataagattttttggggccaagtcgccaaaagcctaaattggacccctaagggaaccccctttt

SEQ ID NO: 114894 - DNA, 335 bp, Homo sapiens
cagccatcacatctgcattccagccagaagccttgcttttcccatgtgtacaatggggattacatctaccttaggtcatcaaaaataggagatgggatagaagtgtctagtgtggagcctgctgtgattatggccagtaccccctagaggtgcttggtaagaccaaggttcccctttttttttttctgaggcggctgcaccctggggacctacccagagggctttggaggcacatgatggcctgcggacctcaagcgggctcctctttcctggggcgccatcccccatgctctgagctcccgctctccccagcctctcaggccccatgggcaggg

SEQ ID NO: 114895 - DNA, 4735 bp, Homo sapiens
  misc_feature (140)..(140): n is a, c, g, or t
gtgggatttggggggcgctggtgggcacccctggatctggcggctgcggcctcgcggggggaggctgatcggtgacaggggcagggggctattttgggggtagaaggcagtgagagcgtgagggggaggggggtccccancgcccaagccggagccagagacgcggagcccgcgcgagcgtcggagacagggctccagggctccgaagcgacagagccgggccccggccgctgccaggggccccgcccggcccccccactccaccccacgtccctcctgcagcccagctccgcccgcagccgccgcggaccaggcaggcccgcaccgccgccatgatgtgcgaggtgatgcccaccatcagcgaggatggccggcggggctcggcgctgggcccggacgaggcgggcggggagctggagcgcctcatggtcacgatgctcacggagcgcgagcgcctgctggagacgctgcgcgaggcacaggacgggttggctacagcgcagctgcggctgcgcgagctcggccacgagaaggactcgctgcagcgccagctcagcatcgcgctgccccaggagtttgcagctctgacgaaggagctgaacttatgtcgggagcagctgctggagagggaggaagagattgcagagctgaaggcggaacggaacaacacgcggctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccgagaccaaggagatcagctgggagcagatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcggggtcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaagcttacttgttgac

SEQ ID NO: 114896 - DNA, 1011 bp, Homo sapiens
ggggaagggagggaaacccatgtggagcccggcgatcgttgtgacatcgggaagggaagtccaaagggaggaatcctggagaggaacagggaggagggtgctccaggctgaaccgctgctcgctctccctccaggccagacttctgggagttcccgggcagacggcgtttcggtccggacctattcctgctagtgcaggcctccaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcggggtcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaagcttacttgttgac

SEQ ID NO: 114897 - DNA, 426 bp, Homo sapiens
taggggactggaaagctcatccgtgactccacttcccctgctgctcagggtgagtctacattatgggattatgtgccactcagctccgccccgccgcgtccggtcgccggtcccccgggtcatctgcgggcggggtcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaagcttacttgttgac

SEQ ID NO: 114898 - DNA, 4364 bp, Homo sapiens
tgggggcggggcctcgtggtgttgaagtggggggcggggcctctcagtgttgcagcgtgacctatttttttcccccatctcgcctttctgtcttctcctcttccctgctcccacttcctggctggtctcccactctggtgccactccttcctccctgtctccataacttttctcttttctgtaccaccggttccttgaccccgacctcctctcttttcctgacctgtctcggtgctcctttatatggctccatcttttcctccatgtgtccgccctacctgtcaccctttttctcacatctgccccttttcccttgcctcttttcattgaccccatgccgtgtgcttgcagctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcggggtcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaagcttacttgttgac

SEQ ID NO: 114899 - DNA, 4469 bp, Homo sapiens
tgggggcggggcctcgtggtgttgaagtggggggcggggcctctcagtgttgcagcgtgacctatttttttcccccatctcgcctttctgtcttctcctcttccctgctcccacttcctggctggtctcccactctggtgccactccttcctccctgtctccataacttttctcttttctgtaccaccggttccttgaccccgacctcctctcttttcctgacctgtctcggtgctcctttatatggctccatcttttcctccatgtgtccgccctacctgtcaccctttttctcacatctgccccttttcccttgcctcttttcattgaccccatgccgtgtgcttgcagctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgaggaccgtgctgggcgaccttgggggtgcggggcggcacggtggatcttcactgctccacgcgctgcccggcgtcatgcaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcggggtcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaagcttacttgttgac

SEQ ID NO: 114900 - DNA, 4288 bp, Homo sapiens
tgggggcggggcctcgtggtgttgaagtggggggcggggcctctcagtgttgcagcgtgacctatttttttcccccatctcgcctttctgtcttctcctcttccctgctcccacttcctggctggtctcccactctggtgccactccttcctccctgtctccataacttttctcttttctgtaccaccggttccttgaccccgacctcctctcttttcctgacctgtctcggtgctcctttatatggctccatcttttcctccatgtgtccgccctacctgtcaccctttttctcacatctgccccttttcccttgcctcttttcattgaccccatgccgtgtgcttgcagctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccgagaccaaggagatcagctgggagcagatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaagcttacttgttgac

SEQ ID NO: 114901 - DNA, 1095 bp, Homo sapiens
ggggaagggagggaaacccatgtggagcccggcgatcgttgtgacatcgggaagggaagtccaaagggaggaatcctggagaggaacagggaggagggtgctccaggctgaaccgctgctcgctctccctccaggccagacttctgggagttcccgggcagacggcgtttcggtccggacctattcctgctagtgcaggcctccaggtgaggaccgtgctgggcgaccttgggggtgcggggcggcacggtggatcttcactgctccacgcgctgcccggcgtcatgcaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcccagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcggggtcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaagcttacttgttgac

SEQ ID NO: 114902 - DNA, 4348 bp, Homo sapiens
tgggggcggggcctcgtggtgttgaagtggggggcggggcctctcagtgttgcagcgtgacctatttttttcccccatctcgcctttctgtcttctcctcttccctgctcccacttcctggctggtctcccactctggtgccactccttcctccctgtctccataacttttctcttttctgtaccaccggttccttgaccccgacctcctctcttttcctgacctgtctcggtgctcctttatatggctccatcttttcctccatgtgtccgccctacctgtcaccctttttctcacatctgccccttttcccttgcctcttttcattgaccccatgccgtgtgcttgcagctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaagtgagggcaccccagattctctgcacaaagcccccaagaagaagagcatcaagtcatccataggccgtctctttggcaagaaagagaagggacgaatgggacccccaggccgggacagctcttctctggctggaacaccctcagatgagacactggccactgaccctctggggctagccaagctgacaggcccaggagacaaggaccgaaggaacaagaggaagcatgaactcctggaggaggcctgccgccagggcctaccttttgctgcctgggacgggcccaccgtggtgtcctggctggagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcacttccacaggaaacgtgtggatgacacacgaggagatggagtcccttacggccacgaccaagcccatcctggcatatggcgacatgaaccacgagtgggtggggaacgactggctgcccagcctggggctgccccaataccgcagctacttcatggagtcgctggtggacgctcgaatgttagatcaccttaacaagaaggagctccggggccaactcaagatggtggacagctttcacagggtgagtctacattatgggattatgtgcctgaaacggctcaactatgaccggaaggacctggagcggaggcgggaagaaagtcagacccagatccgagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggcccggcagcttctggagaaggaattcagcaaccttatctccttaggcacagacaggcggctggacgaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggccagacttctgggagttcccgggcagacggcgtttcggtccggacctattcctgctagtgcaggcctccaggtgaggaccgtgctgggcgaccttgggggtgcggggcggcacggtggatcttcactgctccacgcgctgcccggcgtcatgcaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcattccttcttcgtccgaaaggaggggaggggggactcgctgctacaagcctcgccccctgtgccactcagctccgccccgccgcgtccggtcgccggtcccccgggtcatctgcgggcggggtcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatgccgctgggcgacgtggcgtgggggcagggggacggtgggggagccctcgcccccgactctcggtcggcctccccgccccaggcgtcactcagtgatcacgggtaaagagaactgtttcaaaaagcttacttgttgac

SEQ ID NO: 114903 - DNA, 1903 bp, Homo sapiens
tgggggcggggcctcgtggtgttgaagtggggggcggggcctctcagtgttgcagcgtgacctatttttttcccccatctcgcctttctgtcttctcctcttccctgctcccacttcctggctggtctcccactctggtgccactccttcctccctgtctccataacttttctcttttctgtaccaccggttccttgaccccgacctcctctcttttcctgacctgtctcggtgctcctttatatggctccatcttttcctccatgtgtccgccctacctgtcaccctttttctcacatctgccccttttcccttgcctcttttcattgaccccatgccgtgtgcttgcagctgctcctggaacacctggagtgcctggtgtccaggcacgagaggtcactgcgcatgaccgtggtgaagcgccaggcccagtccccgggtggggtctcctcggaggtagaagtgctcaaagctctaaagtctctcttcgagcaccacaaggccctggatgagaaggtccgggagcggctgcggatggcgctggagcgcgtggcagtgctcgaggaggagctggaactgagcaatcaggagactctgaaccttcgagaacagctgtctaggcggcggtcagggctggaagagccgggcaaggatggggatgggcagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggccgaggaacgtcatgggaattttgaggagcggcttcggcagctggaggcccagctggaagagaagaatcaagagctgcagcgggcccggcagcgggagaagatgaacgatgaccacaataagcggctgtccgagacggtggacaagctgctgagcgagtccaacgagcgcttacagcttcacctcaaggagcgcatgggggcgctggaggagaagaactccctgagcgaggagatagccaacatgaagaagcttcaggatgagttgctgctaaacaaggagcagctcttggccgaaatggagcggatgcagatggagatcgaccagctgcgggggaggccaccatcctcctactccaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggattgggagcggtctgcccctgcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagctgatccaagaggagaagtgcgcctggtgcgggaatcctc

SEQ ID NO: 114904 - DNA, 217 bp, Homo sapiens
caactccaaagtcacattgcctggtacatggcaggtgccctataataagaatcattccttttctctgttactgcttgccccagaaagcaggagggacataaacgtgtggcccagggccttcaggaggacaccctccttcctctcccccacgcgaagccctctcccaccatccattaacactccctgcccctcagtccacaggaaacgtgtggatgac

SEQ ID NO: 114905 - DNA, 174 bp, Homo sapiens
atgcgattaacaatattatattggataaattacataaccctcccatgtgtaagtttaaaataaaagtcagaaggattttgagggttaaataagtatatattaataacagtacataaaacacactgtaaaataggctaggcacggtggctcacacctgtaatcccagcactttgg

SEQ ID NO: 114906 - DNA, 715 bp, Homo sapiens
tgcctttagtttcagctacctgggaggctgaggtgggagaatcagggaaaatcgcccgaggctatagtcgaggctgaagttagctgtaatcatgccattgctctccagcttgggtgaaagagaaagaccctttctttaaaaactcttaaaaatagaactaccgtgtgatccagcaatcctgctgctgggtactgctgctgggtatatacccaaaagaaagaaatcagtacattaaagagacatctgcactctcatgtttgttgcaccattgttcacaatagccaagatttggaagtaacctaagtgtctatctatagatgaatggataaagaaaacatggtacatatacacaatgaagtactattcagctgtaaaaaagaacgagatcctgtcattcgcagcaacatggatagaactggaatgtcattatattaagtgaaataagccaggcacagaaagacaaacatcacatgttctcacttatttgtgggagctaaaaattaaaacaattgagatagaaagtagaaggaagtttaccaggggctgggaagggtagtgggggactgtggggatgtttaattggtacaaaaactagtttaaaagaataaataggacctagtatttgctagcacaacagggtgactatagccaataataattatacattttcaaataactaaaagagtataattggattgtttgtaacacaaaggat

SEQ ID NO: 114907 - DNA, 199 bp, Homo sapiens
aaagccgcggacacggaagggaggcgaccaccccgctggggtgctggggtcgccaagtttcaggttccctctccgggtgggggcggagtcggttgccgtagcaacggaggctggggccttgcctttatagactgcatcagacttgatcaggttatattttccactgtttcatgaactgctttcatctgccctgttaacc

SEQ ID NO: 114908 - DNA, 198 bp, Homo sapiens
gcagtatgtcccatccctagaatatctggcacctggttaagtgttcagtacatatttgttgaatgggtaaatgaatgagagctggagggaaatccaaactcaggggtgcctgtgccacagcaaacactctccctctcacaccacctggaatagagatcagctagagcagaggctgctaagagagggaacagaggctcc

SEQ ID NO: 114909 - DNA, 229 bp, Homo sapiens
ttgcaacagcaagcatggactttgcagacagaaagacttgggtttgaatcccagctctgtcaccatccgactgtgtgatatggggttttgcaggctcatccttggggccaggactatagagaggcaagtgaccagacgccgaagacaaaaattcctccaggttcaaacttgccctaccctgcttcgatgcataagcagttgactcaataaagatgtgtctctgacccag

SEQ ID NO: 114910 - DNA, 2124 bp, Homo sapiens
attttatggaaagttatatatgaagagtttattattaagcattcctttcatcagtttaaatgtttaattcctcccaggcgtttttcctccaattttatatttgatttttcattcaattcacagttggtatcattaaaaaaaattctaatacaattagctagaccttctgagaaaaatgttagaattaaactcaagcagtcagtatagtatatttcttaaccgactggttttagcttatcagaaagtaattattttatgtatttaaatacatttacaaagaaaatgaggcttttaaacagacctcactatttaacattgtacccagtagtggtgagcatgcttagtacccaaattttggtttctaaatgccattccccactaaaaggaaccagggttccttggagaaatggctgattccatgtttggagcaggggaagtgggtggtgtggctaaaatactttttattaagaaaataaaataaaaagcaagatagtatttgaagactaatggggtaatgtcagaagggaacaggcgccaagttgaaggtattctcactggccaaatttaggacaacttagaataatcactcttactggtgataatactaagaaggaaaagaagttcataatgatgaaagtagagaaaaaagaaaactctatacaattatttgaagaatgtcttcttttaaatgtacatggaatgatagatttggaaaaattaccattttacaacccttaatgtaattaaatctggcaaaaatcgatggtaaaacccattaagtggaaaaaattttaaggaactttgtttacaaggtgtcagaacatcacagatatctattgcaaaagaattgcctttacagtgagatttggctatcaaactgcatttcactacttctggaataagccagcattatgtggctcttgatgggatgcggtatgaagcatgtgtgatcatccttgatgtactgccgaaaatgtttacctcaaatttaattaaatcttttgtctagacttatcttcctgtttaaagaaatacaggaatagaggaacaagttgaattacacagtatggaaataaatagacaagtccagagttggtataggacaactggacttttttttatatatttattttaaaatggttttcttaaatttatttttttaaacataacacgaggaagctgttaaaactggtgtaatagctcaaaagaactaagtattccagatttcgggagggatgaagagggagatattcagaaaccttcaccagattcctcccaacttgatcatagtggattaatgacgtgctttgtggatgtggttagtcaatgacaccagcttgacggatctttctttctgcaccaaaccccattgagttatctggtccccttggctgacgaagagccattaggcgaggatcactggcatcatccagggtgatgttcttcaagcgactgaccaaccgatcaggtcgaggagctgcaacagccttggggccctcacagactcgccaaacattccaggcactgcacttgccatcctcaacttctttcatatggaaaaagagcttcttgctatcccctacttcatagttaatgaagccaaactgatcttgcacacattccactggccctacgcaggggtgtgatgttgtaagccatagtttgtgcattttggccctggtctggacttttcaaaaagcaaatgtagtaaaacaaaaagtggtctctgctagattaagacaagagacataaccaaatggaaagtgtgatcctttattagcttctgattcataaaaaaacctataagagacatttggggggatatttggggaaataggaagatggaatgggtagtagataatgtggtatatttgatttttctagaagtgataattgagttacgtaggataatgttctaattcttaggagatgcatgcagaagttttttttttaagttttgaaaagtcatgatgttgacagcatattttcaaataaatatgtacaaaatcagtcaattgttttttgtggtggatctatatgtggtggatgttcattggtcatttaaaacatttttctatgtgtgtcaatttttaataaaaatgcaaaaagtgattggataaagaa

SEQ ID NO: 114911 - DNA, 2184 bp, Homo sapiens
attttatggaaagttatatatgaagagtttattattaagcattcctttcatcagtttaaatgtttaattcctcccaggcgtttttcctccaattttatatttgatttttcattcaattcacagttggtatcattaaaaaaaattctaatacaattagctagaccttctgagaaaaatgttagaattaaactcaagcagtcagtatagtatatttcttaaccgactggttttagcttatcagaaagtaattattttatgtatttaaatacatttacaaagaaaatgaggcttttaaacagacctcactatttaacattgtacccagtagtggtgagcatgcttagtacccaaattttggtttctaaatgccattccccactaaaaggaaccagggttccttggagaaatggctgattccatgtttggagcaggggaagtgggtggtgtggctaaaatactttttattaagaaaataaaataaaaagcaagatagtatttgaagactaatggggtaatgtcagaagggaacaggcgccaagttgaaggtattctcactggccaaatttaggacaacttagaataatcactcttactggtgataatactaagaaggaaaagaagttcataatgatgaaagtagagaaaaaagaaaactctatacaattatttgaagaatgtcttcttttaaatgtacatggaatgatagatttggaaaaattaccattttacaacccttaatgtaattaaatctggcaaaaatcgatggtaaaacccattaagtggaaaaaattttaaggaactttgtttacaaggtgtcagaacatcacagatatctattgcaaaagaattgcctttacagtgagatttggctatcaaactgcatttcactacttctggaataagccagcattatgtggctcttgatgggatgcggtatgaagcatgtgtgatcatccttgatgtactgccgaaaatgtttacctcaaatttaattaaatcttttgtctagacttatcttcctgtttaaagaaatacaggaatagaggaacaagttgaattacacagtatggaaataaatagacaagtccagagttggtataggacaactggacttttttttatatatttattttaaaatggttttcttaaatttatttttttaaacataacacgaggaagctgttaaaactggtgtaatagctcaaaagaactaagtattccagatttcgggagggatgaagagggagatattcagaaaccttcaccagattcctcccaacttgatcatagtggattaatgacgtgctttgtggatgtggttagtcaatgacaccagcttgacggatctttctttctgcaccaaaccccattgagttatctggtccccttggctgacgaagagccattaggcgaggatcactggcatcatccagggtgatgttcttcaagcgactgaccaaccgatcaggtcgaggagctgcaacagccttggggccctcacagactcgccaaacattccaggcactgcacttgccagtgcgctgatgaagaatcacggagaactccacctcatctcctgcctggagctcaaggccatcctcaacttctttcatatggaaaaagagcttcttgctatcccctacttcatagttaatgaagccaaactgatcttgcacacattccactggccctacgcaggggtgtgatgttgtaagccatagtttgtgcattttggccctggtctggacttttcaaaaagcaaatgtagtaaaacaaaaagtggtctctgctagattaagacaagagacataaccaaatggaaagtgtgatcctttattagcttctgattcataaaaaaacctataagagacatttggggggatatttggggaaataggaagatggaatgggtagtagataatgtggtatatttgatttttctagaagtgataattgagttacgtaggataatgttctaattcttaggagatgcatgcagaagttttttttttaagttttgaaaagtcatgatgttgacagcatattttcaaataaatatgtacaaaatcagtcaattgttttttgtggtggatctatatgtggtggatgttcattggtcatttaaaacatttttctatgtgtgtcaatttttaataaaaatgcaaaaagtgattggataaagaa

SEQ ID NO: 114912 - DNA, 296 bp, Homo sapiens
aagttggaagatcatttttatttatttagttagttactattattatttttaaaccagtcaagtacggtagtaaagaaggtcacttttagacaacacagaagtgactttgttcataagggagctggactacatggtaactaggattccttccaaattccaaattttagaatttgccagaaatcatcacctcacttttcaagtcacaaaagaaaaacctaacagccccccatcttagagagcagtaaagggaagaaatgctttgagtcttaatattacggtaaaaaaggaaacacatg

SEQ ID NO: 114913 - DNA, 841 bp, Homo sapiens
aatttttttttgaagggaggtgtctactacaagacttctaatacttcagacatagcatttggaagctcaggctgtgaaattaagctgctgtgagcattcctaacgataatttgtgaaagtaagtttcaattaattcatctttctgttttcaaagtaccaatccgtctgcatcagccctggacactatctcctaaactttcctttggcctgtggaggtcactggtggtactgaagtacctgccaacctcaagaacagtgaaaaagcactctctggaaaaaccatttacccaagccaggtatgggagacagttgtcagatgaacacgtaaataaggccatgccccatttttagttttgtaatttatacggggaatgggggactctttgttccatccctccccagcatcacatctcagggttcggggctgaccaggattccgtaagtccacatggtgctggatcattcctccttcacccccctgtggaaaagtctgttcatagaggggttgtggcaaccctccataagaagcctcatcgtttttcttcttggctgtctcataacacaatgcaggccacagccagggatggaaaacctggaagctgacaagtgcgctgaaatcctggcattatgctggactgctgttttgtggcactggctatgactgtcacgtctcacttaagacacagggtggacatgaactcaaggcttgtagaagcccctgccttaggcagactcctcgaagcccaatggcagaacccctgccgaggtttcatgtgcacattgagtgcagggttcctccggatctgggggaactctaccagaaacccatccttcacaccca

SEQ ID NO: 114914 - DNA, 731 bp, Homo sapiens
agcttgcctcctcctcggttacagagagggtgattccactggccccttagtcatgctttttatcctgaaattggtgaatgagatgagtcagttgctaagtgtaggcggcaggctgtttggaatctctagtgggtgtgtcagtcagtgcaagagttcattggtaaaaaggggctgagactcaagttacagtcttttttaagtctatgcttttaaagcatagtgaggagagggagcaggcagttagaatgagctctaccttgcctcatttcttgggggaataaaggaactagttcttttaataccttatttccaagggcctaaattacttgtttgtggtctctttttctcattgtagtttaatccagtggccatcttctagctgttttcttgtttttatcctttttttttggtagggatggtgtctcactatgttgcccaggctggtcttaaactcctggccttctcaaactcctgattctcccaccttgggctcccaaagtgttgggattacagacataagctgccacgcccaacctgttttcttgtttttagaagtaaacattaatcatattttggctagagaaatgggaggtttttttcattcttataattctcaaagaaaaacccaaccagcttgttgcctcagtaaaattaaagagaaaaaactagagacactacaataacgtttctgtttaaattttcattttatctataaatatttttaatgtaac

SEQ ID NO: 114915 - DNA, 631 bp, Homo sapiens
atccctaggattccaacacaagtatggaggtgtcgtcacacatcaaccatgaacagcaagaataacccctcaagactagaccccgcacaaagcagggactaccccactccttctctcattaatcctaccacactctctaccatggcccctgaggacctaaactgtattttgcattttcaaccaaattgatattatttttattagcataatcaatttttcttctctcctgaattactttccattagcattttaatctctgatggcacagtatttttttaattctcttgtatatcaaaattttaactttccccagaagcaaatgtaggatttgatataagtctggatcccaaaacggaactcccagaagacctcgattacaaccaaagacctggattatagttccatcttgaaagttatttctagaagatggatctgccatccagaacggggaaatgaggctgggcagaatagccctaaaaaggagtagggagatgagagaaaggaagaaaaattgctggttcatggccatcgacattatgctttcttcaagtgaagatctatgatttgattaagttcctgattctagaatggcatctaggcctaggacaaacatccccaactggggaaactg

SEQ ID NO: 114916 - DNA, 392 bp, Homo sapiens
atctcacccaactcaatttagatgtggatctttgaagagggtgggaaaggtgaactataggatatgggggatatggctccatacttctctgtggtacccagggaggtgatattatgtatttctattctatttctcctgcaaaggcaagctggaatcctcaactcatcaaccttaatttggagtctgcagatgggttgctgacctcttggctttcaaattctctgtaatctgtgtgggtttaatcctggggatttgatgaattgtccaacaacccccatataataatagaatttcaggcaccttagagatcagctccttcaaatcccaccttcccctccccctgttttagagagaggaaactgagtatagagatgggaagggcttacttgagg

SEQ ID NO: 114917 - DNA, 354 bp, Homo sapiens
cacaaactgtgagtctactcgtaatagacagattttaataataaaataccaactgggaaaatctaataaatgctcctaatagtcatcctacagaaactctcaaagtatctccagcgaaaaacgcacttttaaaaaaacaagcatcttttaaagtttttttttcttttatacagtaactttatggtacatgtatctttattgacactggcttatcagtgtagcaaccaacagaaaaaaaaaaaaacaagcataaaaataatgttcccatagtgtgactatctagctaaggatttcatacctaaatttctagtgtgtcaatgcccctagaaatacaatcactggccaggcgcagcg

SEQ ID NO: 114918 - DNA, 250 bp, Homo sapiens
acagaatatagggcactacgttctgtagttgtcttggtgtcagaacccagctcattttcccctgacagaccacaagggatgatctaaatttctcaggttgtcatgaattgcagggacaagagagtgtgtccaaagaattcacatccctaacttcctattaatataaatacttctatttatccatcctcctacagagaccactgctccctaggcacccaaaatatgtctgactgagattctagtaaaagtc

SEQ ID NO: 114919 - DNA, 278 bp, Homo sapiens
cttcaaagcagggccctttttcctgcagaactggttgttaaatatttgccagcacagcactgcctgaatccattctcctaccgtccatccatcctcttattccttcatctgactgtctcttcatccatccatctgtccatttgcccagctatatagtcacctaaccaaatttatccatttgctcatccatctatttatctgtgcatctattcattcatccatttatttattcatccatccatccctctatgagcctgttcgtctacccatccacctgc

SEQ ID NO: 114920 - DNA, 491 bp, Homo sapiens
aaactttctttctacaaaaaatcaaaagcttagctgatagatcatgaaaatagattatgaacagtgaaattcctgagaaggctgaaagtgcggggaaccaaagcaggggagattagccttagtccggaggagggagaagcagatggaagtcagcagcctgccttgtttttacgtgtaatatttaaattttcaaattgtattacaggagggcctactttctgtttttatcaagagtttttcttttgttcaaagacactggttatgggaatattttgaaagggtaagaaacgctggtataaaaggtgttgcagattaatttgaagttcttacgaaacagtccctcaaaatgaagggttatttttggttttgttatgttcgagttgctttgttttctttgttttttgctttaccaattactgatggcttgcttttctataactgtgagaggagatcactgttctcctgcagaaagtgggagggaggcttgatgg

SEQ ID NO: 114921 - DNA, 354 bp, Homo sapiens
cagaattgactgccattggtgacttgctacagtggggatgcaggagagatttctagatggaaagattgatgggatgatgtcaacattaactaggatagagaacacagagaatagaacatgtttgggtgataggaggttccctgtttgtacttggtaaatatgagatgtatacaggaaaccccaacagaaatgtccagtaaatgactggatagaagaatgcaaactctgcaaaatataactgagatagaaacatggatacagatgaaattagctgaaacatcatcattaaagcctccaagtggataaaatctcttagagggtcaggtgttagaaaaagcagggagaatagaccag

SEQ ID NO: 114922 - DNA, 702 bp, Homo sapiens
ctggctggaagatatttggttggagaaaaactcggagctatctttcagggttataaaccagaatgattttgaagtctgcagcagctatccccaaaatagatatttggcatcatggagcgcaagctttttaaagattgcagttggcatttaggtcaggattggtggaggctggctgttgtagagaccatcagttttgtcatatgttttacttctattatctcccagttgtcaggattctaagtgctgtggcatctgatacatgaacgtacggatttccagcacccttttcagtgttgtttctctaacttagcttctgtaatgattaagcgtggtccatttttatgttctctcccctgaatttacttactgcttcttcttttgccctttgagtacatttataatatttggctatagacttcaaaaatttttcttggctgggcgcggtggctcacgcctgtaatcccagcactttgggaggccgagacgggaggataatgagatcaggagatcgagaccatcctggccaacatggtgaaaccctgtctctactaaaaatgcaaacaattagccgggcgtgttggcgggtgcctgtagtcccagctactcagaaggctgaggcaagagaatggcatgaacacgggaggcggagcttcgcgccactgcactccagcctaggcgacagcgagactccatctcaaaaaa

SEQ ID NO: 114923 - DNA, 323 bp, Homo sapiens
caatagtccaggagtagactgactgccttgagggcagtgagttcattatcaaaagaagagcataaacagaatctgagggacattcttgagtaatatgtaacgttgctttggataatctctaaggttttttgtagagtaaagattctaggatttgctgttctccaattgactaatgaagagatctcttaggctttgggataagagagaccacgtttcaagtctaattattaatactatctgcgggaccttacttatttccactttactttcctcttctgtagaatgggtagacttatttggaatgcggtaaggattacattaac

SEQ ID NO: 114924 - DNA, 192 bp, Homo sapiens
tctcaggtactgctcttccgagacttctgcctgacacctggaggaggcaggcccttggtggaactctaggaggcaccagctgaggaaaggggatctcaggaggtagggagagagcagagtgggcagccagctgtgggttcaaatcctggcctaccactttaacagggcgatctggaacaagtgacttctggt

SEQ ID NO: 114925 - DNA, 2533 bp, Homo sapiens
tacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggtgagctggggcaagatgggacagagccggtggtctccagcatagggagggatttcactcttcttcccaggttcttctgaagcacccacacaaaatgcacactctgcgatatgtagtattgtcattatttccttcttctacatcaggtagtggaggctcagacaagttatttagccattcacctagagagtaagtgttgaagccagagccacctccaactctggagcctaccaagagaactgtggggatgtgggatgtggcgggacagggttgctgggtacagaagccagacttcttttacaagtaactctaggctgggtgtggtggctcacgcctataatcccagcactttgggaggctgaggtgggtggaccacttgaggccaggagttcaagaccagcttggccaacatggcgaaaccccatctctaccgaaaaattagcagggtgtggtggcacgcacctgtagtccccgctacgcaggtggctgaagcagaagaatcacttgaacctgagaggtggaggttgcagtgagccgagattgtgccactgcactccagcctgggcgatagagctagactctgtctcaaaaaaaaaacaaaaaacaagtaactctttattccttgtgtgaaaatccagggctgttaaagtttagtggcaggaggaggagttaaggtgatcttgtgagaagagtcatgctggtgacatcaggaggggtacatggctgtgatgggggaggtggtgctgctggactgagccagtggagggggaagatctgcagctagcatagtttcatgctcagtgaggatgatggtcaccgtgtttgttgtgtacttactgtgctgagagctttcctcgcagaggccctcccaacgaacagctctctcagaagcatctgttccttcctggtcacgaggtggccagagcacaatgtataggcagaccagtggtccttcctctcccaatgtggccatgtggaggacaggatgtcttcctgggggttgggatggactctctgggcactgtactctctctcctacctgcctccctgcagtccctcccatggatgactcaggcctcccagaagcaatttctatctgtccccttcactttcaggccttggggagtctctgctcctacctgactctgtgttgtaatttcaggggagcatcagtggaggaggcagtgggggcagcagcagcctcctgaccaatgcccgctcttggggagtgaggattctgcacgtggatggtaccctttctgtgctgggctcctgtggagggagaattggtgactttgaccaggagtgtcagcttttagaaggatcatggtcatgtgagcttctggtcaccggaagccagaaatactcagctgccatgttgatccacaaaggtgggaggatgtggggaagggggaaagcggtgaggacgcagagtgcaggctgtggcctcggcatcccgcaggaggtccctagaacatgccgtttcatgtcacctgctacagctctcccccagctagtatgatgatccgttttacaaatgcagaaatgatcttaatattcatgaccactggccaggcgaggtggctcacacctgtaatcccagcactttgggaggccaaggcgggtggatcacaaggtcaagagttcgagaccagcctgaccaacgtggtgaaaccccgtctctactaaaaatagaagcattagccgagcctggtggtgcgtgcctgtaatcccagctactcaggaggctgaggcaggagaatcacttgaacccaggaggcagaggttgcagtcagccaagatcatgctactgcactccagcctgggtgacagagcgagactccgtctcaaaaaaaaaaaacgacaaatat

SEQ ID NO: 114926 - DNA, 6355 bp, Homo sapiens
tacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggtgagctggggcaagatgggacagagccggtggtctccagcatagggagggatttcactcttcttcccaggttcttctgaagcacccacacaaaatgcacactctgcgatatgtagtattgtcattatttccttcttctacatcaggtagtggaggctcagacaagttatttagccattcacctagagagtaagtgttgaagccagagccacctccaactctggagcctaccaagagaactgtggggatgtgggatgtggcgggacagggttgctgggtacagaagccagacttcttttacaagtaactctaggctgggtgtggtggctcacgcctataatcccagcactttgggaggctgaggtgggtggaccacttgaggccaggagttcaagaccagcttggccaacatggcgaaaccccatctctaccgaaaaattagcagggtgtggtggcacgcacctgtagtccccgctacgcaggtggctgaagcagaagaatcacttgaacctgagaggtggaggttgcagtgagccgagattgtgccactgcactccagcctgggcgatagagctagactctgtctcaaaaaaaaaacaaaaaacaagtaactctttattccttgtgtgaaaatccagggctgttaaagtttagtggcaggaggaggagttaaggtgatcttgtgagaagagtcatgctggtgacatcaggaggggtacatggctgtgatgggggaggtggtgctgctggactgagccagtggagggggaagatctgcagctagcatagtttcatgctcagtgaggatgatggtcaccgtgtttgttgtgtacttactgtgctgagagctttcctcgcagaggccctcccaacgaacagctctctcagaagcatctgttccttcctggtcacgaggtggccagagcacaatgtataggcagaccagtggtccttcctctcccaatgtggccatgtggaggacaggatgtcttcctgggggttgggatggactctctgggcactgtactctctctcctacctgcctccctgcagtccctcccatggatgactcaggcctcccagaagcaatttctatctgtccccttcactttcaggccttggggagtctctgctcctacctgactctgtgttgtaatttcaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcaggtatcccagagcaggatgggacagtggacagcacgcaggcaccagctgaacgtgcagggactggtgaggtacctggacctatagcaagctgccaggacctgggggtgtcagttgatgtgtttgtggaccccccaggataccagtgtccaggagccctgcttgccaatgcctcctgcctagctctggttttatggaactctcctctggcccagacctggcactttttggccacaagcggaaggttcagttccccagtggcagtgctaagaagagagtgggggcctcctggccacaggcttcattttttgtcccaatagcccccaacccctgcggcaccaggacaactagtggcaagcgtcttccctctcttccccttacaggccatgagtccaggctcctcgcctccctccagcccttgtgccactcacagacctgcctctctctcccagaccccttcccctggcagcccacagacagaccagcagagttctgggccacacagccctcctggctggggaaagggtggcccccagggcctgaggattctgagtgtacagccactggccctgtatcccaggaggctggccagctcctcagctgccccacagctccaggctggccatcagctcccctgtactcagctaccagtgtgcagccctcgggagcacctgtagagagcaggtctacctccctcctgcagcccctgccagccagtgcgggagccagctgttcccgatgcctctgggccccccagcctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgtgattcttctcacccttctctgcgtccatgcatttaaagagttgtctctttaaatgttgaagcttccggaagcctgatgctattctgtgtctcctttcaaaggaagaagggggggcccagctatgggtgaggactcaagttattagtttggaaatagagcaactatgtgtacagcccaccttagaggtcatgttacccccttcctgttaaattttacaattaattttggttcaggaaatgtaaataaatttgttaattacaaatagcaaagagatggggctggaatgccatatgtcggtccttgatctgccctccagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatgggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccttctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgccagcaaatctttta

SEQ ID NO: 114927 - DNA, 6290 bp, Homo sapiens
tacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggtgagctggggcaagatgggacagagccggtggtctccagcatagggagggatttcactcttcttcccaggttcttctgaagcacccacacaaaatgcacactctgcgatatgtagtattgtcattatttccttcttctacatcaggtagtggaggctcagacaagttatttagccattcacctagagagtaagtgttgaagccagagccacctccaactctggagcctaccaagagaactgtggggatgtgggatgtggcgggacagggttgctgggtacagaagccagacttcttttacaagtaactctaggctgggtgtggtggctcacgcctataatcccagcactttgggaggctgaggtgggtggaccacttgaggccaggagttcaagaccagcttggccaacatggcgaaaccccatctctaccgaaaaattagcagggtgtggtggcacgcacctgtagtccccgctacgcaggtggctgaagcagaagaatcacttgaacctgagaggtggaggttgcagtgagccgagattgtgccactgcactccagcctgggcgatagagctagactctgtctcaaaaaaaaaacaaaaaacaagtaactctttattccttgtgtgaaaatccagggctgttaaagtttagtggcaggaggaggagttaaggtgatcttgtgagaagagtcatgctggtgacatcaggaggggtacatggctgtgatgggggaggtggtgctgctggactgagccagtggagggggaagatctgcagctagcatagtttcatgctcagtgaggatgatggtcaccgtgtttgttgtgtacttactgtgctgagagctttcctcgcagaggccctcccaacgaacagctctctcagaagcatctgttccttcctggtcacgaggtggccagagcacaatgtataggcagaccagtggtccttcctctcccaatgtggccatgtggaggacaggatgtcttcctgggggttgggatggactctctgggcactgtactctctctcctacctgcctccctgcagtccctcccatggatgactcaggcctcccagaagcaatttctatctgtccccttcactttcaggccttggggagtctctgctcctacctgactctgtgttgtaatttcaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcaggtatcccagagcaggatgggacagtggacagcacgcaggcaccagctgaacgtgcagggactggtgaggtacctggacctatagcaagctgccaggacctgggggtgtcagttgatgtgtttgtggaccccccaggataccagtgtccaggagccctgcttgccaatgcctcctgcctagctctggttttatggaactctcctctggcccagacctggcactttttggccacaagcggaaggttcagttccccagtggcagtgctaagaagagagtgggggcctcctggccacaggcttcattttttgtcccaatagcccccaacccctgcggcaccaggacaactagtggcaagcgtcttccctctcttccccttacaggccatgagtccaggctcctcgcctccctccagcccttgtgccactcacagacctgcctctctctcccagaccccttcccctggcagcccacagacagaccagcagagttctgggccacacagccctcctggctggggaaagggtggcccccagggcctgaggattctgagtgtacagccactggccctgtatcccaggaggctggccagctcctcagctgccccacagctccaggctggccatcagctcccctgtactcagctaccagtgtgcagccctcgggagcacctgtagagagcaggtctacctccctcctgcagcccctgccagccagtgcgggagccagctgttcccgatgcctctgggccccccagcctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgtgattcttctcacccttctctgcgtccatgcatttaaagagttgtctctttaaatgttgaagcttccggaagcctgatgctattctgtgtctcctttcaaaggaagaagggggggcccagctatgggtgaggactcaagttattagtttggaaatagagcaactatgtgtacagcccaccttagaggtcatgttacccccttcctgttaaattttacaattaattttggttcaggaaatgtaaataaatttgttaattacaaatagcaaagagatggggctggaatgccatatgtcggtccttgatctgccctccagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatgggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccttctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgccagcaaatctttta

SEQ ID NO: 114928 - DNA, 6235 bp, Homo sapiens
  misc_feature (43)..(43): n is a, c, g, or t
  misc_feature (45)..(45): n is a, c, g, or t
agcgggttgtcgggaaggggagaaagaaaggcggaagggtcgnantagcgaggcgagggcggagtcgggagggggctaggaagtgaccagcgggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggtgagctggggcaagatgggacagagccggtggtctccagcatagggagggatttcactcttcttcccaggttcttctgaagcacccacacaaaatgcacactctgcgatatgtagtattgtcattatttccttcttctacatcaggtagtggaggctcagacaagttatttagccattcacctagagagtaagtgttgaagccagagccacctccaactctggagcctaccaagagaactgtggggatgtgggatgtggcgggacagggttgctgggtacagaagccagacttcttttacaagtaactctaggctgggtgtggtggctcacgcctataatcccagcactttgggaggctgaggtgggtggaccacttgaggccaggagttcaagaccagcttggccaacatggcgaaaccccatctctaccgaaaaattagcagggtgtggtggcacgcacctgtagtccccgctacgcaggtggctgaagcagaagaatcacttgaacctgagaggtggaggttgcagtgagccgagattgtgccactgcactccagcctgggcgatagagctagactctgtctcaaaaaaaaaacaaaaaacaagtaactctttattccttgtgtgaaaatccagggctgttaaagtttagtggcaggaggaggagttaaggtgatcttgtgagaagagtcatgctggtgacatcaggaggggtacatggctgtgatgggggaggtggtgctgctggactgagccagtggagggggaagatctgcagctagcatagtttcatgctcagtgaggatgatggtcaccgtgtttgttgtgtacttactgtgctgagagctttcctcgcagaggccctcccaacgaacagctctctcagaagcatctgttccttcctggtcacgaggtggccagagcacaatgtataggcagaccagtggtccttcctctcccaatgtggccatgtggaggacaggatgtcttcctgggggttgggatggactctctgggcactgtactctctctcctacctgcctccctgcagtccctcccatggatgactcaggcctcccagaagcaatttctatctgtccccttcactttcaggccttggggagtctctgctcctacctgactctgtgttgtaatttcaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcaggtatcccagagcaggatgggacagtggacagcacgcaggcaccagctgaacgtgcagggactggtgaggtacctggacctatagcaagctgccaggacctgggggtgtcagttgatgtgtttgtggaccccccaggataccagtgtccaggagccctgcttgccaatgcctcctgcctagctctggttttatggaactctcctctggcccagacctggcactttttggccacaagcggaaggttcagttccccagtggcagtgctaagaagagagtgggggcctcctggccacaggcttcattttttgtcccaatagcccccaacccctgcggcaccaggacaactagtggcaagcgtcttccctctcttccccttacaggccatgagtccaggctcctcgcctccctccagcccttgtgccactcacagacctgcctctctctcccagaccccttcccctggcagcccacagacagaccagcagagttctgggccacacagccctcctggctggggaaagggtggcccccagggcctgaggattctgagtgtacagccactggccctgtatcccaggaggctggccagctcctcagctgccccacagctccaggctggccatcagctcccctgtactcagctaccagtgtgcagccctcgggagcacctgtagagagcaggtctacctccctcctgcagcccctgccagccagtgcgggagccagctgttcccgatgcctctgggccccccagcctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgtgattcttctcacccttctctgcgtccatgcatttaaagagttgtctctttaaatgttgaagcttccggaagcctgatgctattctgtgtctcctttcaaaggaagaagggggggcccagctatgggtgaggactcaagttattagtttggaaatagagcaactatgtgtacagcccaccttagaggtcatgttacccccttcctgttaaattttacaattaattttggttcaggaaatgtaaataaatttgttaattacaaatagcaaagagatggggctggaatgccatatgtcggtccttgatctgccctccagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatgggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccttctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgccagcaaatctttta

SEQ ID NO: 114929 - DNA, 3401 bp, Homo sapiens
  misc_feature (43)..(43): n is a, c, g, or t
  misc_feature (45)..(45): n is a, c, g, or t
agcgggttgtcgggaaggggagaaagaaaggcggaagggtcgnantagcgaggcgagggcggagtcgggagggggctaggaagtgaccagcgggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccacctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgtgattcttctcacccttctctgcgtccatgcatttaaagagttgtctctttaaatgttgaagcttccggaagcctgatgctattctgtgtctcctttcaaaggaagaagggggggcccagctatgggtgaggactcaagttattagtttggaaatagagcaactatgtgtacagcccaccttagaggtcatgttacccccttcctgttaaattttacaattaattttggttcaggaaatgtaaataaatttgttaattacaaatagcaaagagatggggctggaatgccatatgtcggtccttgatctgccctccagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatgggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccttctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgccagcaaatctttta

SEQ ID NO: 114930 - DNA, 5080 bp, Homo sapiens
tacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggtgagctggggcaagatgggacagagccggtggtctccagcatagggagggatttcactcttcttcccaggttcttctgaagcacccacacaaaatgcacactctgcgatatgtagtattgtcattatttccttcttctacatcaggtagtggaggctcagacaagttatttagccattcacctagagagtaagtgttgaagccagagccacctccaactctggagcctaccaagagaactgtggggatgtgggatgtggcgggacagggttgctgggtacagaagccagacttcttttacaagtaactctaggctgggtgtggtggctcacgcctataatcccagcactttgggaggctgaggtgggtggaccacttgaggccaggagttcaagaccagcttggccaacatggcgaaaccccatctctaccgaaaaattagcagggtgtggtggcacgcacctgtagtccccgctacgcaggtggctgaagcagaagaatcacttgaacctgagaggtggaggttgcagtgagccgagattgtgccactgcactccagcctgggcgatagagctagactctgtctcaaaaaaaaaacaaaaaacaagtaactctttattccttgtgtgaaaatccagggctgttaaagtttagtggcaggaggaggagttaaggtgatcttgtgagaagagtcatgctggtgacatcaggaggggtacatggctgtgatgggggaggtggtgctgctggactgagccagtggagggggaagatctgcagctagcatagtttcatgctcagtgaggatgatggtcaccgtgtttgttgtgtacttactgtgctgagagctttcctcgcagaggccctcccaacgaacagctctctcagaagcatctgttccttcctggtcacgaggtggccagagcacaatgtataggcagaccagtggtccttcctctcccaatgtggccatgtggaggacaggatgtcttcctgggggttgggatggactctctgggcactgtactctctctcctacctgcctccctgcagtccctcccatggatgactcaggcctcccagaagcaatttctatctgtccccttcactttcaggccttggggagtctctgctcctacctgactctgtgttgtaatttcaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcaggtatcccagagcaggatgggacagtggacagcacgcaggcaccagctgaacgtgcagggactggtgaggtacctggacctatagcaagctgccaggacctgggggtgtcagttgatgtgtttgtggaccccccaggataccagtgtccaggagccctgcttgccaatgcctcctgcctagctctggttttatggaactctcctctggcccagacctggcactttttggccacaagcggaaggttcagttccccagtggcagtgctaagaagagagtgggggcctcctggccacaggcttcattttttgtcccaatagcccccaacccctgcggcaccaggacaactagtggcaagcgtcttccctctcttccccttacaggccatgagtccaggctcctcgcctccctccagcccttgtgccactcacagacctgcctctctctcccagaccccttcccctggcagcccacagacagaccagcagagttctgggccacacagccctcctggctggggaaagggtggcccccagggcctgaggattctgagtgtacagccactggccctgtatcccaggaggctggccagctcctcagctgccccacagctccaggctggccatcagctcccctgtactcagctaccagtgtgcagccctcgggagcacctgtagagagcaggtctacctccctcctgcagcccctgccagccagtgcgggagccagctgttcccgatgcctctgggccccccagcctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgtgattcttctcacccttctctgcgtccatgcatttaaagagttgtctctttaaatgttgaagcttccggaagcctgatgctattctgtgtctcctttcaaaggaagaagggggggcccagctatgggtgaggactcaagttattagtttggaaatagagcaactatgtgtacagcccaccttagaggtcatgttacccccttcctgttaaattttacaattaattttggttcaggaaatgtaaataaatttgttaattacaaataaaaaaaaaaaaaaaaaaaaaaaaaaaaaaaaaaaaaaaaaaaaaaaaaaaaaaaaaaaaacgaaaagaaacaaaaagatcaaccctataggagaggaactacatgtacaggtcatacagctaatatgagagacaaagagtgcatccgcataagacgggcgtcagataaaaaagaagctgaagagacaaagaaaacaacacacaaccatgtacaagacaaacaagacgaacgtcgaggcactgaaccctgcaaggaggacaaacccaaactagacggacatagccacaatcaaggagaggggcgacacacaccgtaagagagcgaacacagcgcaaatcagaaacaaacacactgaatcaccgaaaaagaatcacacgctccacataaaccaggcattagaggccccggctgcaccatcgccccagcaaagggacggggaacaatcagacaaggaacgac

SEQ ID NO: 114931 - DNA, 467 bp, Homo sapiens
cagggtctagtctgtgctattatagcacacagactgagctgtcagtgagggccacctggcttcaggactctcttttcaaacttcttactttgctcctctttattgttttctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaggtaacctgctcttctcctgcgatgccatgtgcctttgcaggcttagagcaggagttggatggggattatatctatggtttccaagtattttcttttttgagacagagtcttgctctataacccaggctggagtgcagtggcatgatctcagctcactgcaacctctgcctcccgggttcaagcaattctcctgcctcaacctcccag

SEQ ID NO: 114932 - DNA, 840 bp, Homo sapiens
  misc_feature (777)..(777): n is a, c, g, or t
  misc_feature (789)..(789): n is a, c, g, or t
  misc_feature (793)..(793): n is a, c, g, or t
  misc_feature (795)..(796): n is a, c, g, or t
  misc_feature (808)..(808): n is a, c, g, or t
tacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggggagcatcagtggaggaggcagtgggggcagcagcagcctcctgaccaatgcccgctcttggggagtgaggattctgcacgtggatgaatgatgatgccgtgcacagctgctcntgcgtcttatgngtgnannacacagcaaganccgagggactttccccgcaagtcagaacggac

SEQ ID NO: 114933 - DNA, 5910 bp, Homo sapiens
tacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggtgagctggggcaagatgggacagagccggtggtctccagcatagggagggatttcactcttcttcccaggttcttctgaagcacccacacaaaatgcacactctgcgatatgtagtattgtcattatttccttcttctacatcaggtagtggaggctcagacaagttatttagccattcacctagagagtaagtgttgaagccagagccacctccaactctggagcctaccaagagaactgtggggatgtgggatgtggcgggacagggttgctgggtacagaagccagacttcttttacaagtaactctaggctgggtgtggtggctcacgcctataatcccagcactttgggaggctgaggtgggtggaccacttgaggccaggagttcaagaccagcttggccaacatggcgaaaccccatctctaccgaaaaattagcagggtgtggtggcacgcacctgtagtccccgctacgcaggtggctgaagcagaagaatcacttgaacctgagaggtggaggttgcagtgagccgagattgtgccactgcactccagcctgggcgatagagctagactctgtctcaaaaaaaaaacaaaaaacaagtaactctttattccttgtgtgaaaatccagggctgttaaagtttagtggcaggaggaggagttaaggtgatcttgtgagaagagtcatgctggtgacatcaggaggggtacatggctgtgatgggggaggtggtgctgctggactgagccagtggagggggaagatctgcagctagcatagtttcatgctcagtgaggatgatggtcaccgtgtttgttgtgtacttactgtgctgagagctttcctcgcagaggccctcccaacgaacagctctctcagaagcatctgttccttcctggtcacgaggtggccagagcacaatgtataggcagaccagtggtccttcctctcccaatgtggccatgtggaggacaggatgtcttcctgggggttgggatggactctctgggcactgtactctctctcctacctgcctccctgcagtccctcccatggatgactcaggcctcccagaagcaatttctatctgtccccttcactttcaggccttggggagtctctgctcctacctgactctgtgttgtaatttcaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcaggccatgagtccaggctcctcgcctccctccagcccttgtgccactcacagacctgcctctctctcccagaccccttcccctggcagcccacagacagaccagcagagttctgggccacacagccctcctggctggggaaagggtggcccccagggcctgaggattctgagtgtacagccactggccctgtatcccaggaggctggccagctcctcagctgccccacagctccaggctggccatcagctcccctgtactcagctaccagtgtgcagccctcgggagcacctgtagagagcaggtctacctccctcctgcagcccctgccagccagtgcgggagccagctgttcccgatgcctctgggccccccagcctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgtgattcttctcacccttctctgcgtccatgcatttaaagagttgtctctttaaatgttgaagcttccggaagcctgatgctattctgtgtctcctttcaaaggaagaagggggggcccagctatgggtgaggactcaagttattagtttggaaatagagcaactatgtgtacagcccaccttagaggtcatgttacccccttcctgttaaattttacaattaattttggttcaggaaatgtaaataaatttgttaattacaaatagcaaagagatggggctggaatgccatatgtcggtccttgatctgccctccagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatgggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccttctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgccagcaaatctttta

SEQ ID NO: 114934 - DNA, 5105 bp, Homo sapiens
tacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccagaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcaggtatcccagagcaggatgggacagtggacagcacgcaggcaccagctgaacgtgcagggactggtgaggtacctggacctatagcaagctgccaggacctgggggtgtcagttgatgtgtttgtggaccccccaggataccagtgtccaggagccctgcttgccaatgcctcctgcctagctctggttttatggaactctcctctggcccagacctggcactttttggccacaagcggaaggttcagttccccagtggcagtgctaagaagagagtgggggcctcctggccacaggcttcattttttgtcccaatagcccccaacccctgcggcaccaggacaactagtggcaagcgtcttccctctcttccccttacaggccatgagtccaggctcctcgcctccctccagcccttgtgccactcacagacctgcctctctctcccagaccccttcccctggcagcccacagacagaccagcagagttctgggccacacagccctcctggctggggaaagggtggcccccagggcctgaggattctgagtgtacagccactggccctgtatcccaggaggctggccagctcctcagctgccccacagctccaggctggccatcagctcccctgtactcagctaccagtgtgcagccctcgggagcacctgtagagagcaggtctacctccctcctgcagcccctgccagccagtgcgggagccagctgttcccgatgcctctgggccccccagcctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgtgattcttctcacccttctctgcgtccatgcatttaaagagttgtctctttaaatgttgaagcttccggaagcctgatgctattctgtgtctcctttcaaaggaagaagggggggcccagctatgggtgaggactcaagttattagtttggaaatagagcaactatgtgtacagcccaccttagaggtcatgttacccccttcctgttaaattttacaattaattttggttcaggaaatgtaaataaatttgttaattacaaatagcaaagagatggggctggaatgccatatgtcggtccttgatctgccctccagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatgggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccttctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgccagcaaatctttta

SEQ ID NO: 114935 - DNA, 5047 bp, Homo sapiens
ggggtcgttaatagctgaggcgatggtgcggagtcgtggagggggcttaggaatgtgaccagtcgtggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcaggtatcccagagcaggatgggacagtggacagcacgcaggcaccagctgaacgtgcagggactggtgaggtacctggacctatagcaagctgccaggacctgggggtgtcagttgatgtgtttgtggaccccccaggataccagtgtccaggagccctgcttgccaatgcctcctgcctagctctggttttatggaactctcctctggcccagacctggcactttttggccacaagcggaaggttcagttccccagtggcagtgctaagaagagagtgggggcctcctggccacaggcttcattttttgtcccaatagcccccaacccctgcggcaccaggacaactagtggcaagcgtcttccctctcttccccttacaggccatgagtccaggctcctcgcctccctccagcccttgtgccactcacagacctgcctctctctcccagaccccttcccctggcagcccacagacagaccagcagagttctgggccacacagccctcctggctggggaaagggtggcccccagggcctgaggattctgagtgtacagccactggccctgtatcccaggaggctggccagctcctcagctgccccacagctccaggctggccatcagctcccctgtactcagctaccagtgtgcagccctcgggagcacctgtagagagcaggtctacctccctcctgcagcccctgccagccagtgcgggagccagctgttcccgatgcctctgggccccccagcctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgtgattcttctcacccttctctgcgtccatgcatttaaagagttgtctctttaaatgttgaagcttccggaagcctgatgctattctgtgtctcctttcaaaggaagaagggggggcccagctatgggtgaggactcaagttattagtttggaaatagagcaactatgtgtacagcccaccttagaggtcatgttacccccttcctgttaaattttacaattaattttggttcaggaaatgtaaataaatttgttaattacaaatagcaaagagatggggctggaatgccatatgtcggtccttgatctgccctccagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatgggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccttctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgccagcaaatctttta

SEQ ID NO: 114936 - DNA, 537 bp, Homo sapiens
ggctactgcgagtgctgtcaggaggccttcgaggagctccatgtggtgagccccttccccattaagcagctgctcccagagtgccctgagggagcctgctcactggggatgagtccttcctatgcgatctctatgctgctatggctgtcctccagggccagagcatgggctgggaggtcagcttccgtgtccccctccccccaggcctcatctaatgccctgtgctcctctcccccgccggcagcatcttcagagtgcccagcaccggagctttgccctggaagcccatctatatgcagaagtggacaggatcattgctcagctcagccacagctttgcagacatccctttccaggctggcctccccaggtgagtgccacgctggcaggcacaactgtgtctgctctctcctctgttgccctctgggtgggaagagaccctcaggttggtggctgctgggaccagactgtgatgttttcctcttttctcaccttcctttccccttatcctcagtcctgtttgttttggggctggcca

SEQ ID NO: 114937 - DNA, 503 bp, Homo sapiens
tctacttaatacctctccatgccaaccccgttgtcatttcccagcggccgcctctataacgggcacttttcagggacaaagaattggtccgttaatgttcctcaaattcgaacgcgcctaggaatagttcggggatcctgttgaagtgcagatcaggattccgtaggtaggggtggggttccaaattctacatttctagtatcttcccacacgatggtgatcctccttgtccctgaatcatggaggagggcaattagggagatgtgagcctggatgcatggtggccttggctatcttaggtgttcttgcccattaaccaagctgggaggaaccgtgtgaatgcatatctatccctgttaataaaagggtagtttgaaggagatgctgacaggagaataattagaaatgtttttcttcccaatccaactatatgcaatacactttataatattcattttagaaatgtcatagataagatttgtaaacattgacatttagcaata

SEQ ID NO: 114938 - DNA, 411 bp, Homo sapiens
gctgagcagttttagtatcaggagctccatctaatctgtttaattttaataaatccctgactgggagagggagtgaaaaaaaaaagagagagagaaactctggaccaaataatacttcttttgagttacttggctaataattactgtagagagaaaactttttgtgcaattatgattcgttgctcctttagcaaaaaaaatccaactgatcaattcatccaagagtcattgtgcaccctatgccctgtccctggactcccatcaggaatttagcagagaaccgaacagacaaaatccctgccctcgcagagcttaaattctagtggagggaaggcagacgattaacaaatgggaaaatgaaataggtcggatgtcagatgccgagcgccatggatactgatgaatgaagca

SEQ ID NO: 114939 - DNA, 285 bp, Homo sapiens
gttccagctacttgggaggctgaggcatgagagtcacttgaacccaggaggcagaggttgcagtgagctgagatggcacccctgcactccaatcttggtaacagagcaagactgtctcacacagacacacgaaaggcatattgataataattcaacttatagaaattgagattaaattgtttgtttgcctaataagaatttccaatattttggggtcttttatgcaagacacagtactaaacacaatggaaaactatagagtaattgacattaccaggacataag

SEQ ID NO: 114940 - DNA, 551 bp, Homo sapiens
gccaggctggtctcaaactcctgaccccaggtgatctgcccgcctcggcctcctaaagtgctgggattatatgagccaccgtgcctggccacttttctcattttcagtgtaaggtgcaatttactttgtcagtgtggattttagaagtcattttattgactggcatttttctagactaaaatataagtagtaagtagagactaataattaacagagtgaaaagtgagatgtaccaaaacatcttactgaattgctctaaacttctacattgccacatcttaattatagctattgggtctcttaaatattttctctaaaacttgcttctagaaaaatgttggtaatacactgaaaacatgtaaattgagagatcctataggaatattcattatttaatatttttatacagctatctaataagtaatgtctttggttttttccatagatatgttttttccatacaagaaaatttcttccatgcaagaaaaatcaaagagacattttattgacctcttgtttagatattcatggagaatgccccaaaacgaacg

SEQ ID NO: 114941 - DNA, 523 bp, Homo sapiens
ggggtacactaatagaaaacccctgggggtttgtttaaaaaaaaggccaggtgtacggtccggattccgggatatcgggggacgtggctgaagtcagtcgggccgcccgcttgctgcacggcagccgtgggactggcacaggctcctcggcagcattatgggcagctggtagagcggccacttctgagagccggatgggccttccgaggtcgggccgtgccccgctgggcagcgcagagggggtgtgtagggcacgcgacttggagccaggtccagacccatcctggctcctctcagggctccttcccctgcccccattccaccccagccctgctggctgtcccgcaggacccagcgccgcggtagccttctctgaactgcggctcaggcggaggtgtcactcctgcctccagcccaggagggcaggtcaggttatgcaacgcgtgccgcgcgatctccccccacctccaacccccttttctcccgggtccacaccgcagttcccaccgctccgggtgtcctc

SEQ ID NO: 114942 - DNA, 328 bp, Homo sapiens
tgggaggtgattgaatcatggagcagacttcccccttgctgttcttgtattctcacaagacctggttgttggaaagtgtttggcacctctcggccgggcgcggtggctcacacctgtaatcccagcactttgggaggccgaggcgggtggatcacaaggtcaggagaccaagaccaccctggctaacacagtgaaatcccgtctctactaaaaatacaaaaaaattagccaggcgtggtggcaggtgcctgtagtcccagctactcgggaggctgaggcaggagaatcatttgaacccggggggcgcagattgcagtgagccgagatc

SEQ ID NO: 114943 - DNA, 727 bp, Homo sapiens
aaccacccaagtttacatccctaaacccattcattcacctaatggggctctataggataaattctatgggagcataacttttctgaccttacctcaaatacaagaacatttagagctgctaggtacttaagcctcatctaatctaattttcacattttgttctagagaaattgaaacccagaggtgtgacttactctgagtcacatagctggctggtgatggatgttctttacacttaccaccctgccgccttatttctttctacatagtctccttttctcttccgaaaatgtggtgattctgtaccataatttgtttgttttggcatcatttttctttattttttactccccgggacctgtgaagccttccttagaacttaggattctataatgggttgcttaaaaattggtaccttcctataaacttgattttattttttcacgcttagtatgtacttctgtctgggtatagagtatacttggaacagaaaagttactacttagattctattgtagactacatgctgtgctctaaccgaagactagtgttttcaagttacaaaagcaggagatacatagggttggattaagatgtattaaattcttaggacatttgtgggaacattatagattatataaccctgtgatctttgatgaaatcattcagtaacaaagttgaatgattccgtatcaagaaatacctattatttttaggagcacatatg

SEQ ID NO: 114944 - DNA, 92 bp, Homo sapiens
tgttcaatccagatgtttgttgggacagaaataacccagagccctggaacaaactgggtcccaatgatcaatacaagttctgctcagtgaat

SEQ ID NO: 114945 - DNA, 744 bp, Homo sapiens
tttattctgtagattaaaggtatcattttaataaggatatatgtatactatttaaagtagcaatttttatttaaagttgtgaaatgagttcaagcatgttaattagtaaggctgttactacagtcctgaagtaaaatgcacacttacttaaatagtaagtaaagcagttttcatttcctggaattttcttcaataaaacgactattgggtggacttacatcatgcacatatttaccataagagaggtccagtttttatgttcagcaaaagatgaagggaggaaaggaggaaaggagggagggagagagagaaataatagagcactagtgagataaatttaacatcccaatagtgaacactgcctgcctgcattcccctcactgaccacaagctctgacgtggatagggaacgggaatgtgctattttttcattcggctctcataaatcttttattgtgtgagtattctacatggtcccttattctggtgtttaaagatcctaattttcctgcaacatgatctctgcaagctaactctttaatccagaagcaagcagtctaggataattttgactctgagcaatctctgcttcatttgttgacttcatttgttgactaaggccctcggaagaagtgaccgttttatattagaggcatgatggagaaactggacagagctcctttttgctggctgttcatcaggagtggggcttcaccgtcatttcagtaggagtctgtatgagat

SEQ ID NO: 114946 - DNA, 553 bp, Homo sapiens
atgtttgcaaaatgattggatgcaaagtgggcttaattcataaaagcaataaaatgttgcttattgactgaacagatgaactagctgaggggagataatttggagtgttcttattggaaatgctttgaagaaatgtaatgatagtggagagacagagtcttattagctgtggtaaatatattttcctacagaaggattaggagattttgaaataactggaaaataaccctcaaatgtttagttatagtgacatttggatcaagcatgtgcaacttttaaccttggaaatttatatattccttgatatgcacaatttgaaatccagagataaatttctgatgtcatgggaaaaatctagcactgggagttaggaccactgggcttgagcctcagttcagtcactaactctacctcttcaccctgtaaagtcaggaaataatcaatgctctgcaataggtacatgctggagagatcgaatgcgccctcacagtctcgtctctcgaggggcatggaggctggtgcagtgtggtgaaatgccccaaagagctccaac

SEQ ID NO: 114947 - DNA, 639 bp, Homo sapiens
ttaaaaaattttaagtgtaaaagcatgagtatactttatgtggccaaatctgcttctattttcttacaacagtaagtgtaacagtgcctttactgtcacacttgaaaggcaccatctaatctatccaagatatttaagttctctacatattttctagtaagttatttccttacgaatatttaaatcgtcatctacttaaacattttttggtatgaatatgattttaactttaaaaatgcccttaattctatggtatgactatgattctaattttaaaaatgtccttaattctaataccatataaaaatcatattatcccatccatttggaagaccacattgttttataaaatatttaaattaatttacatctaattatatacttcttagtgtagtcttttgctttatctgtgcctatgccatatatatactattttcattcttatagcttccaggatatgttccttctcaattatcttcttcaaaatttatttgatgcttttgcagctttttcccccttctaggtacatttgaaagttattctaatacatttcatgaatgtattttttgatgatcttaaccagtattatatttatacatttacttgagataaactgatattgtgataatgttgtgtctt

SEQ ID NO: 114948 - DNA, 269 bp, Homo sapiens
aatcttcacagcaacccagtgaggtaggcaccattattttccccattttaaagggaaagaatcaaaccccagagaggttaagtaactttctcagagacgtataatggaagagctgggattcaaaccccaggagtggcttgtgctcttaacccaatgctatctctagttgacacttaggtcatagatttggtctttttttttttttaattttaacttttattttagattcagggggtagatgtgcaggttatataggtatattgcacaat

SEQ ID NO: 114949 - DNA, 227 bp, Homo sapiens
cgggagggacactgtaactctgagtgtgcactaccttggtacagttctcagagaattccttaccatttgtgtgacttggctttgtttggaagataatggttcctgcaggtaccatgaactgacagagaagaccattgtcagcacagccctgaacactgtgaaaacatgtgacctgagcaaacatcagaaaacattttgacttgagaccacataattaacctcttaag

SEQ ID NO: 114950 - DNA, 376 bp, Homo sapiens
ttagattccatttttgaagaagaaattcagtggggattacataaatgacaaaatgtatagtttgactaagggtctaagttttactgtcctcagatgaagagcataatgggatgcagaattttatttgaattaaaatgctggtgcattttatgagggaaaaacatcaataaaagagcattaggggtaccttggctctgtgattaggagacatacttctaaataagaacattatttatcaaggctggtaacataacaagaagaatgctggaatatggtttattgctcttggttattttggtcctttttccctcatttccttaaacttatcttcaatttcaaacaaacaggaaaccttgttagagggcaatgtaatatg

SEQ ID NO: 114951 - DNA, 220 bp, Homo sapiens
atttgaatgactagtgtcccattgggcaccagaagtcagttcaggtatgattctgtctcaccaaaggcctgtgacagcaacttttcaagcatagaaatctctgggcccctggagacaacacatccctccaagccctgcgcccctggtggcaatccagcccttcaagctgtaacacaaggtggattccagtccagtggagagaaatctgccatgtggtgtc

SEQ ID NO: 114952 - DNA, 401 bp, Homo sapiens
tatgctggtggctccctgaggtgctggtgcactcaggcaaaatgaaccgaacatctgtattctatttgctaatgagcaatcatcatttgtacctttttccagcctgggattcagctgcttggaatactaatgccattagaaattggaatcttttttgaaaaacacatactcttttagcaaaacccggtttcactcactgacatttttatggttcctgggattccttggcaattcactgctggttacaaagcccttaattccccctgggcccctctccgccatgcctgcacctatctgtgtaatatttgggtgtgtgggtggggattgggatccagaagacttgactggtcctagacttgccttttcaactaattcagtgactatgatcggacaagtcaatg

SEQ ID NO: 114953 - DNA, 421 bp, Homo sapiens
taggtacttcataaattaggagctgtctgtagaccctttctttaaagaagagtttattaaactaatgcctttatgatttgattataggtttcgcttaagttttctttagctgtgttgtttcagagccatgtaaacgagctgtttaagagcacttgtagacattaaagtatatttttatttaattctgtttctctgttggcctgaaagcagaatatcttttataaaatcaactagtgattattcctaacaagaaagtgtaaatagaattctaatttaataattagctcattagctctcctatagcatttttaacttgagactactatatgttgagctaacctaacaacaatgttttggttttattttctatattgaaatagatttgaaggcaaggggaaaacttttgtttcgttttgttttg

SEQ ID NO: 114954 - DNA, 195 bp, Homo sapiens
ggaccgcttgagggagacagagtttcgctgttgcaggctccagtgcagggcaggatctcggctcagcgaaacactgtctcccaaaagatatcacttactattaccttcacacattgtgcaattatcaccactctctaataccagaacatttccatcaccctggaaagaaacctggtacctgtttgcaatcgctcc

SEQ ID NO: 114955 - DNA, 641 bp, Homo sapiens
ttgaaattggaaggcagaggttatagtgacccgagatggtggcactgcactccagcctgggcaacagagcgagactccgtctcaaaaataaataaatgagggagcagctacctacccccttgccgtgcgggtcatcgttgtacatcttcatagctttgtgtttggcttcctggaaacctgttgttgccaattgaaagctgaaataccctcagagctgcacctgtgaaactctggcagtgaacttggtgaaaactcaggggcttggcgtcttgtaggaggctgcgctgcaggatgcgtggggctaggggctggcttgggtgggcttgggcctctggcttgactagtctggtggattttggtgttttcttgttttgtgctgcccatgtgtctctgtttagacagagaggattccttcttattccttctttgcccagaagccaaatggcgcaatctttgttttgtgcctgagcccctttctgtttgtttctccagaagcttgaattcgtgtccctgcctgtccagagcagaggagcccgtggtgtaacgagggagggggcagccctcacagtgcctctctgagctgcggccacagtggcaggcacgcggatctctctggaggaatgtatctgaggttgcgtctg

SEQ ID NO: 114956 - DNA, 739 bp, Homo sapiens
cgcctggctaatttttgtacttttagtagagacagggtttcaccatgttggccaggctggtctcgaactcctgacctcgagtgatccgcctgcctcgacctcccaaggtgctgggattccaggcgtgagccatcgcgtccggcctattattttatatatattggataaatgaatgaacccgtgcgttcacctgccctgggacccgcctggcctcttttggaaccactgatcgtgcatctcagctgcttctggctgacttgggtctgtcctcacggctcctccttgctcagcctctggccccgctgcaagacttgcccactacggccctttccatggccacaggatctggtcctgtccatcgtctgtgcatctgatgtttctttcttcctttatggtccagaggcgggaattccaccctggtgtgaacctgccaggactgccctgtgcactccaggagtccaggagtgagacccacgctggagtctggtggtgggcatgcgggtctgggcacaggctcggtctgcatagaacccacgtggtcccagcaagggtgctgtgggcccagaagcgcccatgcctgagagcgtccaggaccaggcagagctgggccttaagggcccttggaccagtgtctgtctgcagggagcccccggtagccactcggatcagcccgagggaagattctggacgagaccgtggccgtcccccgggtggcccatggacagcagcaggggctccc

SEQ ID NO: 114957 - DNA, 208 bp, Homo sapiens
ttgatgttgtaaccactgcctccagctagacagctgcgatgttagttcattggtggttaactcattttcagcattgctacctgcttttgatgatatctgataatagttttccagggaaattcatcattgaagcccacccacaattcctgagtaatgactccactctcctcccagttgcccaagcaggaaactgtaggggtgattttat

SEQ ID NO: 114958 - DNA, 298 bp, Homo sapiens
ttgaagatattggggtggttccatggaatgaaaaaaagaaaggttaataaattagttttctgattcaagaagtttagctgatgaacccagggatacctggaaaactcgtttcttactatgcaaaaccacacagcagccttcctaaaattattactgatataatcttttcttaagctcatccagtgcagtataatatgggtaaaaaaggtcaaagaaactgacttactgctaaaaatatgtgaactttgtgaataattgctatgtcaattctagtgagagtcatcataggcctttccat

SEQ ID NO: 114959 - DNA, 164 bp, Homo sapiens
gcaaacactattcttctatcataaaagtgataccacagcttctgtaaagttttgcaccaggtagtacttataattaacttgggtacagttttttgtttgtttgtttgttttgagacagattctcgctctgtcgcctaggctggagtgcagtggcctgatctctg

SEQ ID NO: 114960 - DNA, 332 bp, Homo sapiens
ggcctccttgtcatgaccctatacctggacgcccaccgcccacctctgctgcctcacacacactgctcccgcagccctcagccttctctgctgagccaacacaccaagtttgtgcatacctcaggctggctgtccctgaagaccctcaccctagaagattccaagcaaagaccctctcccatcctctgaggctctgtacagccattggcgcctcaccccacagaggcaagggtttaaatgaattcactcactccatagccagatacccagcattcactcggttgtaccggctgatggggtacaaggatgagcagagcctgcactaggtgtcc

SEQ ID NO: 114961 - DNA, 109 bp, Homo sapiens
atgctgtcccttacctctgatgagaaagctgcaaagtgtgtgtgggtccctcttggcctctctcttgatgtcccctgcctaacctgggtggtacacacactccacctct

SEQ ID NO: 114962 - DNA, 175 bp, Homo sapiens
tcgcaccaccatggtgtcagagaaggacacatagagagaaggaacaaggaattcctatccttcccagacaggatgttatcagcagagacctagtggagagcctaaacttccaatcccacccagcagtaatgaggccaagtaagaagaaacctggactttcacccacctctgggaa

SEQ ID NO: 114963 - DNA, 471 bp, Homo sapiens
ggcctcaactgcatgtgcactgggacagacagatctgtgttggaatgcgggctcctttatcttccagctgttaccttgggtgcatcttttccttcttggagcccttttcttggtctgttcacaggggatcttcattaggaggtgctgaagggatttcacggctaatggttttgtaggccctctgttaactgaagccctttgcaaatgcccttgaagaaatgctgtttctcccaacatcttccacggagattggtgctcagaccaaggtgggtgcagagctgatgtctcctcctctaccagtggtgcttgaaaaatggtggcatgaggctgaatttccccatgctctgaatgactggggagagtggccacaaatctgaacagcccagatgtaatttctgactctgggcacctgtgtcttgcagaagggaggaaggtggacagatttagctgcaggatgcacagtgcgctgct

SEQ ID NO: 114964 - DNA, 461 bp, Homo sapiens
agaggatccctctacgagcgcagcagaggccatagacattactcctatcctaggcagtggataacacagacctgtctagagcagaattttatttctgagaccacagttattttttttctctctatataatgctatagtaaatagtatagcatttttgcagaggtgatccaaacttctccaaagttattttagttttcatgttgaaacgattttttaataagaaaaaaatacttttatagtgaagttgatcagtctgtgctaaccttctctgtatttctgataattccttctactgtgaaatcatttataacaggtatcttttgttgttatggtctagcaccttcacactccatacctgatggtactggaacactttctaattggtgctcctggcattttatgtcttcttggaagcaggcagttggagcagaaacttggctcctagacttttttgaacatcc

SEQ ID NO: 114965 - DNA, 383 bp, Homo sapiens
gggaaggtggtcgggaggggtcctggagcggtggcaggtgatcagagactctgcagtaaacagtcatgaaacagcaattacagtctcctggaaaagataatttgctttctctctcaagtcccacttatgtgtttgtagattagatttggctgtaaagaaagaaaatggcagcatgtaataaacattaacgccttaaagtagggggaaaagccctctattaacagctaactcaagtaactcatttagctactcggtaagaaaaaaatacagctaaagtatgtcagctactctaaaacatgccaaagcaaaggtgcaaagttattgcatctattttgaaaggaaacacgcacgtatgttctaaaaccagagtcaaaaattacaaa

SEQ ID NO: 114966 - DNA, 385 bp, Homo sapiens
tactaaaatgacactgttctgaatcatgcagtctttgcaaataacaagctggctgaaaaatatctaaatataattttaatttttgaactttttcttctaattggaaaattagctcatacctgtaatcccagcactttgggaggctgaggcaggcagattgcttgaggtcaggagttcgagaccagcctggccaacatggtgaaaccccatctctgctaaaaatacaaaaattagccggacgtggtggcgggcgcctgtaatcccagatactcaggaggctgaagaaggagaatctgttgagcctgggaggcagaggttgccatgagctgagatcacggcactgtactccagcctgggcgacaagagcaagaactctgtctcaaaa

SEQ ID NO: 114967 - DNA, 219 bp, Homo sapiens
aaaatcctggggaagaagaggagataacaaagaaggggactaatccctggactcttcaatgagaagtaaaatctgttctgtttcaatcttttgtcttctcaactgttaacactagtggttagagactgttggttttttttcactttggtaataccctaaagtagccaggatgacagttttggatatgaagacattatttatttcccccggctccatgaa

SEQ ID NO: 114968 - DNA, 526 bp, Homo sapiens
cttatgtgatcttctaaaccctgcaaatcaaaaggtaaggaacattctgccaagcaacgcaggccccacaacagcctttcttctaactttacgacacgatttcagccacacagaaacacaactgaggagagagccacggagcccgaacttggtcggggttgggcccacatgcacagggggaggcccacatgcacagcgggaggtgcacacggcaccctcgttacctccagccctggctcccgggcaggcgaggggagaagagaggagagaggagaggaggctcaggaccctgggaccagccctggctccccgggaggcgaggggagaagagaggagagaggagaggaggctcaggaccctgggaccagccctggctccccgggaggcgaggggagaagagaggagagaggagaggaggctcaggaccctgggaccagccctggctccccggcaggcaaggggagaagagaggagagaggagaggaggctcaggaccctgggaccactggggctagggtagacacag

SEQ ID NO: 114969 - DNA, 694 bp, Homo sapiens
agtgtctcttcttataagggcagtaatcccataggaccaggggcccactctcaagacctcatttaaccctcattacctcccaaagttctattttacagatgagaaaactgaggcattggggagatttaaataatttgcttagggctacctagagtagggtggcagagctcagaatagagaatatgagtaatatgagtcattgtaaataatcacacatctaccagcaaataataccttttttctccaatcaggtgaactccatcaaggtaggaaccatgcttttaatactattaatactattaatatttccaactagtaaaatactgaatgtgcagtgaatattacaaaatagtacagtaatagtcattgttatcagatctaataccttttggcattaactattagataaagtacaaaagtggtaaatacatggtctttttaattgtatgcaatttttcaaatgccgtctgagggaaggaatcattattatctgttagtttgaaagcagacaagtaaatcccacctttgattagttcacttgtttttaaaatttcatttcctactttgaagagaagacattgcaagcaaaagcatgttgctccagatttggattccagactggcagaggaaggacgaagctttgaaactctggtgctcttagtaacattcttctgtcatcttccacttgtgatat

SEQ ID NO: 114970 - DNA, 432 bp, Homo sapiens
atgggaggccaaaaggaagaggaaacccagccagaccctggcagaaagcttaggcttgggtggagggaagaattttataatggcaggtgggcggttggaggttgaggatgttgctgctatttggattgggaaagagagctaagctggctgagggatgcagacagctcccagagcccattggaggctgggagcaccatggatgctattaccagtatgcagtacagctgaagtgtgccagggtgcaatcatcagcccaggtgacaagccctcatcctccccttcctccacccagtcctcaccaggtaacatttcccagcttctcctctctccaaacatcctgcgtgggcacgatgcccaagcctgcgacgtgagccacctcttcctatgctgccgactcaggacctcagcctcctttcgcccatccttctgtct

SEQ ID NO: 114971 - DNA, 211 bp, Homo sapiens
tgttacttatggtttgggtgaaaaaactttgaaaagtaataccttacagggcaaaaataatctgttgacaagacaggactcaaaatgttgactttccacgtttctcagattcaaaacagcctcaggcccttgtgacctcattcaccagaagttcttgggctgctttcaattcccagagacttcattatagaatccagatattctggtgtgt

SEQ ID NO: 114972 - DNA, 593 bp, Homo sapiens
gatggttcttttaatttataaaggaaatattccaagagttcttttaatttataaaagaaatattccaagaaaaccaaaatgaagaattttaattttcttaatgaaaataagagtggtttatttaaaaatgatttgaaaaagtaactgattttttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatcctttgcccacttgttgatggggttgtttgtttttttcttgtaaatttgagtcctttgtagattctggatatttgccctttgtcagatgagtagatttcaaaaattttctcccattctataggttgcctgttcactctgatggtagtttcttttgctgtgcagaagctctttactttaattagatcccatttgtcaattttggcttttgttgccattgcttttggtgttttagacatgaagtccttgcccatgcctgtgtcctgaatggtattgcctaggttttcttctagagttt

SEQ ID NO: 114973 - DNA, 360 bp, Homo sapiens
ctgcccgctccctgcagtctctcagtggctaagggagggccttgtcctaatcatatgtgggtgtgtgtatgcatatgcatacgtatgcacttataatggaaatatataatttataccttacatattatatatacaaaatgtagaatctgccggtcgcggtggctcacgcctgtaatcccaagactttgggaggctgaggcgggcggatcacaaggtcaggagatcgagaccatcctggctaacacggtgaaaccctgtatctactaaaaatacaaaaaaattagccgggcatggtggcgggtgcctgtagtcccagctactcgggaggctgaggcaggagaatgacgtgaacccaggagg

SEQ ID NO: 114974 - DNA, 454 bp, Homo sapiens
cataggctcactgtctgaagatcatcttcctgagatcttcgaagtgggtaactctgtccattgggatgactaccttctaatatgcaaaaggtatgataagcgtgaacaaataatcttgtgattataactgctggtttgcagatctgctagttctaaatttcaaagctttgggaaaggcttttatgttttctctagagaagtggttagctcatggctaagagttataaagaacataagattgaagcaatacataatgtcacagaatgtcaaatgaaaaggcattaaagacatgtgaaattatttactttcattgagtcttaactacaaaagaaatctgctgaccagcaatgaaagctggagaggggcttctccacatttggtaggagtgatgagagcattcgaagggatttcaacatttcctttttaactaaggggaatttttcactttaaagtt

SEQ ID NO: 114975 - DNA, 138 bp, Homo sapiens
ttttttgcagatacggaaaaggtgatcctcaaatttatatggaattgcaagggtttctgaataaacaaaaaaaatcttgaaaataaagaacaaatttggtcagagcatggtggctcatgcctgtaatcccagccgagg

SEQ ID NO: 114976 - DNA, 598 bp, Homo sapiens
gtttaatattttgactttaaagtctcttgggacttccaggcatacaatcatatcatctgaaaatgatgattttatcccttttccctaattttttatatctctattttatttttcttttatatttgccttgggtaatataaattccatacatgctgagtttgcataaatatattatttttagacaaagttagctaatttttattattaagcttgctggggaaggatcaactggggatgactaggcaattggatatacaggctcgaggctcaagagagtaatatgggatctgataatttgaaatctgagagtcatcaatgtaggagcaatcactgaagccatgagagcagatgaaagggctccaggaggaacaatgtatagcaagaggagagaaaagagtctaggacagaacccgaagaaacatcaacatgtaggagactgactgaacaagtaatcctgtagcagagaagttgaaaaaacaaaagtgttttgcaatagaaggaaaaaaagatggcatttcaaaaagggggaaaggtctgcaagctcttgagaaagctaaggagtgtccttcggattgggcaatttgaaggctgttggtga

SEQ ID NO: 114977 - DNA, 641 bp, Homo sapiens
ctttggcaaaagtatgtatctatacttcaaaacatttctttataatggtttcttagaagtggaattactcttagagtggaattactcttaaatagataaaaccataattaaacttcttgatagatattggcaaactgctttccagaaagtttcacgtgatttacaatcatatcagcattgtgggagaaaacccaagtcactctctcaagttcccagtgttgtcacttgctaatctctgcaagtggcctgtaccattactgctttgtagagtttattgtgattttctttgtaatctttttgtaaatgtcccatggacaacagaagcatttttttttaattttgcagtttgctgagaaaagtgttatacccattaattaatcaactttaccaaataaaagtttcatcttctatgttatcatgcatctactttttctgcaatatactgaagaaggatctattttgggtttcttgatcagtagtagattaaaaatacattctaaaatccttcattagaattagtttctcctcatatttcagatgacttttgatttgtccatgtttatgctcttctaggtacatgaatgttgagtctcatgattgttgagtcttccttagaagttttaccctttagaaataaaaag

SEQ ID NO: 114978 - DNA, 352 bp, Homo sapiens
cagtttagataataataatgttagctcacatttatgaaacatttgctatattctagacattcttcaaagttctttagatgcggtaacatttaattttcaatatagcctattagggtaggtgcttttattatacttgtttttacagatgaggacattaaaacttagagaggttcattaactttctgccctaagttatagagctattgcaaggcagtgaagcccatgctcttaacacatgaatttggatctagagcctatgctttcagtcactataagatattgtcacaatattatgaaaatgctaccgaggctgtaaactgacaaagaggcacttggatttggtgatcataag

SEQ ID NO: 114979 - DNA, 777 bp, Homo sapiens
gactactgacctcgtaatccgcccgcctcagcatcccaaagtgctgggattacaggcatgagccaccgctcccggcccggcaggccccctagaagatgccaatcaaaataaactgcattcttgagacacagggcaagaaattaaagctatccacctcctcaaggcccaggactacgtggaagagacatcgagtcatgaatatggaatgacttcacctgacttcacttgaaattcacttaattttcaactctgttggctatgaggtctctcaaaacagaattttggcttttccagattggcaaatagctcttagttaaatgtggctttcaagtatgtgtttactcctttatgtttcaattttccttcaagttttgggactcagtctggctctctttgctcctcagcttgcagacgcctattgtgggaccttgtgattgtttgccacagccgcttcaaccttctgcaaccagcaagtcaatagtcatcaacatggtggccagaccatctaccaacaaaaagatcacaatttgctgaaggctccaagtctcactctgttgcccaggctggagtgcagtggcatgatctcggctcaccaccttaccacaacctccacctcccaggttcaagtgattctcctgcctcagcctcccgagtattacagctcattgggaggatgttgcgggagaatggcttgagcccgagaggtatggattacatgagacatgattgcaccactatgctccagcctaggtgacaaagtgagaccctgtctcaatt

SEQ ID NO: 114980 - DNA, 742 bp, Homo sapiens
gggtctggaagtgacaaaacaaactggaggctgaaacaaactgctggggtttcatgaatagccagaaaacaagaagaaggaaatcctttcttctctcctaatggaagaaattaattggagtccagcggtcaagggagaagcatagtttgcagagaccttgttctggcctcttatagctgaatatagacaagggggtttatgttatttttatgccagttttcttgtctccagaatagtaataaaagtaagaccaattgtttattttataataggatgacaagcatttctttaattaattttatttttttctcagaagcattaaaatataaggtctaattggctaaatattgctcaatatatatttgtgcattttgcattgcctcattaagtgcaaaaacctttatagactctcatcctgcttactcctgacaactttggtactttaccaaattaatataattctattctcaaagaattagtaaatcatatagctcctgagttttttccaggaacttttccagataagaagattaatcaatggcttcttctttgctactaaataaactaccatttttcaattagaatataagaaatttaaacaccattaatggattaaaatgctgggttctttaataactttgcattctgaatgaataatatattacttttaagaggatcatgaagtttcactaaataaaagaccttatattttaaatgtgtatttttgaatgtgaaaaaaaaa

SEQ ID NO: 114981 - DNA, 807 bp, Homo sapiens
gcggcagtaccgctgcccggagacccgccgcacgcgctctgccctgcctaccaggaaaaggaggaggtgggcagctgctggaatgactcgcgttggagccttttgtgccaggaggaggggacctggtttctggctggaatcagagactttcccagtggctgtctacgtccccgagccttcttccctctgcagactcatggcccatggatcagccatgtgactcggggagcctacctggaggaccagctagcctgggattggggccctgatggggaggagactgagacacagacttgtcccccacacacagagcatggtgcctgtggcctgcggctggaggctgctccagtgggggtcctgtggccctggctggcagaggtgcatgtggctggtgatcgagtctgcactgggatcctcctggccccaggctgggtcctggcagccactcactgtgtcctcaggccaggctctacaacagtgccttacattgaagtgtatctgggccgggcaggggccagctccctcccacagggccaccaggtatcccgcttggtcatcagcatccggctgccccagcacctgggactcaggccccccctggccctcctggagctgagctcccgggtggagccctccccatcagccctgcccatctgtctccacccggcgggtatccccccgggggccagctgctgggtgttgggctggaaagaaccccaggaccgagtccctgtggctgctgctgtctccatcttgacacaacgaatctgtgactgcctctatcagggcatcctgccccctggaacc

SEQ ID NO: 114982 - DNA, 313 bp, Homo sapiens
aaagctattctaaaccttctctaacaaagcttaaaaacatcctaagaaagactgtaaaggtcaaacatcctcaaagagattaatctccttccagaacaaagtacagagtattttaaaggaagacaggaatccagacattgaacaacagtggtgatgtcaaatatccaattaaaattactagacatgtggggaagcaagcaaatgtgaccctaccaagaaaaaaaaatcagttgatagaaacagagcagtgactttctagttaccaaagctaatgattttaatttagttgtgatcatcctatttgatccatttg

SEQ ID NO: 114983 - DNA, 478 bp, Homo sapiens
atccagcagggtgtctgctgtgctcctgatccagcgaggcgcccattgccactcctgatcggactgaaggcttgccattgttcctgcacggctaagagcctgggttcgtcctaatcgagctgaacactagtcactgggttccacggttctcttccgtgacccacggcttctaatagagctataacactcaccgcatggcccaagattccattccttggaatccgtgaggccaagaaccccaggtcagagaacacgaggcttgccaccgtcttggaagcagcctgccactatcgggagctctgggagtaaggacccccagtaacatttggtgaccacgaagggatctccaaagcaatgggaaacgttccccccaaggcagaaacgcccctgagatgtattctggagaattgggaccaactggactctcacatgctaagaaataaacgacttatattcttctgcagtaccacctggccac

SEQ ID NO: 114984 - DNA, 321 bp, Homo sapiens
taggtagtctcatccggtctcctgacttcagataccatttctgtgctgatgatgccccagttcattccacatgtgggtatcattctgacttaccccaccagtctctgctggggtgtctaattagcatctcaggtctgatgtgtcccagatccctggttcaccccttacctctaagcacacttcccccatagtcttccgccatccttccatctgcttggccaaaaatcttgaagtcatccttgatgcccatctttctcacgtgttgcctctaatctaccagtaaaaccttttggctcttcacttcaaaatgtcttcagaatc

SEQ ID NO: 114985 - DNA, 374 bp, Homo sapiens
caagattatgccgacatggctgttagaagacaagacaaattagcagactcatgctcatttctgtcattgaacaattcgtctcattccttcctcaaggcgctgccgttttcctgctctccgtccgtgggggtgtttgtttacacatctctcgcaagaaaagcgcttctctctggcttccctctgcctccccccctccttcctgccctctcccctgccttcccttcctccttccttctctccctccctccttttctccccgttcctttcttcccttctctctgtccttcccccttccttcctttactgatgtaacaaccttggtgtgccgtggctaagccacactccacccctgacctgcgggggatgagtcaaac

SEQ ID NO: 114986 - DNA, 290 bp, Homo sapiens
cagttaaaaccatagaaatgtagtcggatgaaagaatatagagaaaaataaagatacttgagtcaaaaaccaatacatcagaaattgtaaagagcttagaacaatgcctaatacaaagtaagcagtcagtaaatattaactattatttttattatgtcatttctagaagttctattttatttttttccacacatgctttgtttttcttcagtgtcccaattttaaacagaacaactatctccaattcactgagtacagattagtgagttacttcaacatcaaaactaaaa

SEQ ID NO: 114987 - DNA, 359 bp, Homo sapiens
ttcaaacccctgcctgttgtttcccgtgagtgcacggtgatcagagtaacacagagttaccttgttgagcccaggtagatcctccgtgactagcaggagtccgagataagcacgtctctgtgctctcggaggcagtgatcgtcacgtgatagtcgagagctgtctgtgatgcgtagggaggtgtccgctgagcacttggtaccagcatgaggttattcagcacttggcagacatttgctcataatcccccctgctggggacgcttgtcacaggcaggtcttacctggtcaacacctgcccaaggcccctgggctctcaggccttgcatctgattctttgcacttttcctcccagcacgg

SEQ ID NO: 114988 - DNA, 223 bp, Homo sapiens
cagtgaatgaatggaaaatagttaatataactatatcaaaaaaggcaaaagagaaggtgagaggatattacttagtgaaatcttttatcttctgaagccaattaatagtcactgtctaaagcttctgactcaaggatagctatatgacactgtttagtaatacagaggtaacaccactattattagtatagctaacacttattacatacttagcatgtgaaag

SEQ ID NO: 114989 - DNA, 410 bp, Homo sapiens
cctgctcgcccctctctgctgctccgcccctgctctggaggcccctccttcaggactcatcctggagctaaacatgcccccgaggcttcctcacctccctctctgtttctcaatcccactccacccctacggcacctgcaactctcccagacacagagttgccagagtgtcctgtgccctgctcccagcctggggtttccttgagggcagtggttctatccagtttgtgtctggaggcccggtgctgagctctggcctggtataaggctgacattggtaatggttcgttcaccactcacggatccctggcctgcaattttatgccaagcctgggtggcacgtgaggaaggagtggacagcatcccgtcttccagaagctcccgggctagctgcagagaggggcggagcag

SEQ ID NO: 114990 - DNA, 622 bp, Homo sapiens
tactttcatctcagtaaaacagtcagagtgatccttttaaaacataacctaagccattccccattacccttcaatgtttcctcatttcatggaaaataagaaccactatctgaggactagagattcaaggtgagcaaagtggattaagcacagctcttaaaatttctgtaatatgctattgtagccctctacttgtctttagataaagaagttgaaatttttgcctcaaagatgatggttgaactgagatctgaagaaaaagcaggaattaaataagaaaagggacagattaaaataactttcccagcaggggaaacagcaaacttaaaggttctaaggcacaagagagcatggcatatatgaagaaccaaaagagtggccagatatccagacatctagaaggtctagctaagtacttaggaagtagtataaacagaaaagaaaaaattgtggcctcttttttaaaaaaatgattttagttaattttaaagactggaagaagaagagattaaattagttatatttataaatacttggaatagtacctgacacgtagtaatcatcaatgtttggttaaataaatcctaataaatatattgcatctaccttttttgacttaaat

SEQ ID NO: 114991 - DNA, 678 bp, Homo sapiens
atctcctgactcgtgatctacccacctcggcctcccaaactcctgggattgcaggcgtgagccatcgcgctcagcctagaatactcatattattaacattcccataaatattatttagagaaggtttagcatcacttatcccttatttgaaaatgctttctataaatttaatatataaaataaggtggcttttccgttcagcttctgtttctcaagaggattactgagttcttggtgtagcccattcataaatagggccaaaaatgtatagtcttatgtatgttgaaaaaggtccttaggtaattccagtacttttagctgaaaatcattgatttagttttaagttctacctattgcaacaggagttctccatccttgttacgtgttagtagtgtcagggaagacttaaaaattaccagtgcctgggtccctctccagacctttgaactggaactaatgggtggggcttgagcatccacttttagaaatgtttccagtgattcaatgtgtagctctatttcccatcagatttctctgatttcttgtggcattcaattttttctattttggtatcatgattattttcaggtctcatttcctgtcttaggctttatgtctcctggggtagggaccttgccttcttcatttctgtatgttttttgaacacatgaactgatc

SEQ ID NO: 114992 - DNA, 660 bp, Homo sapiens
gtgatctacttttagtagcacagattgattcaaaattaaagaggcttttaaacactctgaattaattgctttaattttttatgtctgagtatagatgtgctatatccactgttgaatttcagtccctggtcatcatcctctgggcaggaaccctaagttcaaaggtactcaactggacagaaagaactatttttcgtgtaatgcataattatgataattatgtaaatgtatgcgttcctaaaagtttagtaagctgcaaaataagacaggattatgcaatggcaagtttatttacttgtctttctactttattaatctttcttatctaaatgaaaatatacagagaaaactgctgctccttgtttctcctcaaagttgtgttgaaagcaaacttttcattagaaatgctgaagttattttatttctcattgaggataatgaatacagaacttaaacggttactgcatagtgtaaaataagaataacttagcataatataaagttttgtcatttttatgacttctgggccattgatattaagatattactgctgaaacagtgactctgccttggagctaaaggacctgggttcatgactgaagaggttggaaggtcagaatagtctattatatatagtttttttcctgtttacttctcagg

SEQ ID NO: 114993 - DNA, 528 bp, Homo sapiens
tctatcttcagaatttaggctccatttgacttagttttcctgaaatatgtagaaaactaatggtgaaagaggacctaattcttgaattatctgcttgaactgtgttgctagttattccaagtagaatttgtaaaatggtccatcattctctaagcaaaatgagggaaataacaattattttctagaaatttcatatatattgaatattacaaaatcatgtaactagaaatgtttaaatggtcacactgggccaggcacggtggctcacgcctgtgatcccagcactttgggagaccaaggctggtggattacaagatcaggagtttgagaccatcctggccaatatgatgaaaccctatctctactaaaaatagaaaaattagctaggtgtggtggcgcatgcctgtagtcccagctgcttaggaggctgaggcaggagaatcgctggaacccgtgaagcggaggttgcagcgagccgagattgcaccactgcgctccagcctgggcaacagagcgagactccatctc

SEQ ID NO: 114994 - DNA, 461 bp, Homo sapiens
gcgccttttcttcggtgttccgtgcaggactgccggctgcttctgcccccgaaggtcccgtcggcggcggggcacagatcctgcgggcgctgcctcagggctcccatgttgggcactgcgagaacccagtgtctccctcacctcgctttgtcttggccctagaggctgggcctgttaccccattttgcagattgagaaggcgctcagggagctgggtgctttgcgcaaaaccaggcagcgaggacagaagtcccgccgtgtggccctcatcgaagccccgtggggcctccagagaccacacgggcctgagcccctgcacttctgtgtcgcaggagctgatttaatggagttcctgcctcagaccacaaggttcggagcgcccgcccacccctgcccctcctgggcaccctgcccaccaggtcacctgcacctgctctgaataaactgtgaagtcaagccac

SEQ ID NO: 114995 - DNA, 785 bp, Homo sapiens
gtgggtggagctcctcttcctctcaggctccgagacggccccagcagcgtccaccgctgtccatatgccaggagggtggctgggcaggctgctgtctaggccaggctaacccctgcggtgggcgtgggtgtcaccagggccgatggcgcttgtgcagaaacccacgtctctgagctgccagcagccaagctgtcctgatgacattcccgggtgggcgcacaagcctgcactgtccgtatagaatcggcccaggctgtgcagcaggggaacccggagcccggaccccgccacggaggccaggctgccgtgcaccatcctgggtgtcctcgtggtgctccgggcgcaggtggcagcagccatggaggagctggaccggcagaagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggtaagtgcagttgccctgtgatggcaggtggaacccggctgtgcacacagctaggccttattgttccccatgctgttccctgcactgttccccatgctgttccctgcactgttctctgtgctgttccctgcactggtccccagtgctgttccctgaactattccctgtgctgttccccatgttgttccctgcactgtccct

SEQ ID NO: 114996 - DNA, 693 bp, Homo sapiens
tcctcccgacatgtcgcagaagccctagggactgttccgcagctctagatggcccagtggggaggggctgccctgtgggcattgctgtctgatggcctgaaggcaccgcttggagggacacatgcctggggacagtgggctcacagatgtcttgctgctttgccaccgagcctcacagccatctgctgacctctcagagcccagcaggcccctgcccgggggttcgtggaatgcccctgggggtctcagacccactgctcagctcttggccaggctccgtatctctctagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggtaagtgcagttgccctgtgatggcaggtggaacccggctgtgcacacagctaggccttattgttccccatgctgttccctgcactgttccccatgctgttccctgcactgttctctgtgctgttccctgcactggtccccagtgctgttccctgaactattccctgtgctgttccccatgttgttccctgcactgtccct

SEQ ID NO: 114997 - DNA, 934 bp, Homo sapiens
gtgggtggagctcctcttcctctcaggctccgagacggccccagcagcgtccaccgctgtccatatgccaggagggtggctgggcaggctgctgtctaggccaggctaacccctgcggtgggcgtgggtgtcaccagggccgatggcgcttgtgcagaaacccacgtctctgagctgccagcagccaagctgtcctgatgacattcccgggtgggcgcacaagcctgcactgtccgtatagaatcggcccaggctgtgcagcaggggaacccggagcccggaccccgccacggaggccaggctgccgtgcaccatcctgggtgtcctcgtggtgctccgggcgcaggtggcagcagccatggaggagctggaccggcagaagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggccacagagagatccacgtgctggacaccgactacgagggctacgccatcctgcgggtgtccctgatgtggcggggcaggaactttcgcgtcctcaagtactttactcggagccttgaggacaaggaccggctggggttctggaagtttcgggagctgacagcagacactggtctctacctggcggcccggcctgggcggtgtgccgagctcctgaaggaggagctgatttaatggagttcctgcctcagaccacaaggttcggagcgcccgcccacccctgcccctcctgggcaccctgcccaccaggtcacctgcacctgctctgaataaactgtgaagtcaagccac

SEQ ID NO: 114998 - DNA, 1046 bp, Homo sapiens
gtgggtggagctcctcttcctctcaggctccgagacggccccagcagcgtccaccgctgtccatatgccaggagggtggctgggcaggctgctgtctaggccaggctaacccctgcggtgggcgtgggtgtcaccagggccgatggcgcttgtgcagaaacccacgtctctgagctgccagcagccaagctgtcctgatgacattcccgggtgggcgcacaagcctgcactgtccgtatagaatcggcccaggctgtgcagcaggggaacccggagcccggaccccgccacggaggccaggctgccgtgcaccatcctgggtgtcctcgtggtgctccgggcgcaggtggcagcagccatggaggagctggaccggcagaagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggccacagagagatccacgtgctggacaccgactacgagggctacgccatcctgcgggtgtccctgatgtggcggggcaggaactttcgcgtcctcaagtactttagtaagcttggccctggggggctctgcccagctgctgctctcccagggactgcccgcccagcccccctgtgccccacagctcggagccttgaggacaaggaccggctggggttctggaagtttcgggagctgacagcagacactggtctctacctggcggcccggcctggtgagcccaggggccttggggtggaggctgggctgggccctgtgggctgactctgcagctcctcatgctggcctatcctgcagggcggtgtgccgagctcctgaaggaggtgagcctgacccccgaccctggcctgtgctgaagttcccgggcccctggcccagtccctggccctgtcaggagcccccg

SEQ ID NO: 114999 - DNA, 521 bp, Homo sapiens
tgggcactttgctgcctttcagctcaggaagctgtgagatagagaagatcgtgggctcagaaatagacagtacgggaaaattcgcttttcctggccacagagagatccacgtgctggacaccgactacgagggctacgccatcctgcgggtgtccctgatgtggcggggcaggaactttcgcgtcctcaagtactttagtaagcttggccctggggggctctgcccagctgctgctctcccagggactgcccgcccagcccccctgtgccccacagctcggagccttgaggacaaggaccggctggggttctggaagtttcgggagctgacagcagacactggtctctacctggcggcccggcctgggcggtgtgccgagctcctgaaggaggagctgatttaatggagttcctgcctcagaccacaaggttcggagcgcccgcccacccctgcccctcctgggcaccctgcccaccaggtcacctgcacctgctctgaataaactgtgaagtcaagccac

SEQ ID NO: 115000 - DNA, 1087 bp, Homo sapiens
tcctcccgacatgtcgcagaagccctagggactgttccgcagctctagatggcccagtggggaggggctgccctgtgggcattgctgtctgatggcctgaaggcaccgcttggagggacacatgcctggggacagtgggctcacagatgtcttgctgctttgccaccgagcctcacagccatctgctgacctctcagagcccagcaggcccctgcccgggggttcgtggaatgcccctgggggtctcagacccactgctcagctcttggccaggctccgtatctctctagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctgcttctgtagtgtctccaaccactcaagtgctgggactgggtgggggcaggatggagttagaccctgcagaccctggccttcgaggtccgtccccctcagacgtctcccccaacgccatggccggctcttgaaggccacagagagatccacgtgctggacaccgactacgagggctacgccatcctgcgggtgtccctgatgtggcggggcaggaactttcgcgtcctcaagtactttagtaagcttggccctggggggctctgcccagctgctgctctcccagggactgcccgcccagcccccctgtgccccacagctcggagccttgaggacaaggaccggctggggttctggaagtttcgggagctgacagcagacactggtctctacctggcggcccggcctggtgagcccaggggccttggggtggaggctgggctgggccctgtgggctgactctgcagctcctcatgctggcctatcctgcagggcggtgtgccgagctcctgaaggaggtgagcctgacccccgaccctggcctgtgctgaagttcccgggcccctggcccagtccctggccctgtcaggagcccccg

SEQ ID NO: 115001 - DNA, 252 bp, Homo sapiens
tggtgctgcagacccatccttcccgatggctgcagtccagggccgggcgggagacactggggctgcccacattgatgggtgcacaggtgtgaggctcagaaggaaaacctgtcccagtggctggaacagggctgactcctgaaggctcatggttggggggtgcaggtgcgaggccccaggcagacaaggccaaggggctataccacagggaccacctggcagcaagggtgtctggctcctgggctaggagga

SEQ ID NO: 115002 - DNA, 539 bp, Homo sapiens
atcctgtctgtgctattcactagctgtttgctcacataaaagtcatgtaacttccctgagctgtgatttacacattagtgagtagaaatcatagttccacctcatatgggtgatgttaaagttgaatggaagagacgcataaggcaaggtatgggagagcagcaggtgcacggaccttccatgctctcttcagttaaaccgcattcccaacacctggaggtgttcatcaactctcttctctccaggctccagttccccctacccttccggaggtcagtgggtggggctaaaagttccagccctctaatcacttggtgtttctggtgaccagtcccatgttgagattatctaagggcccagctataaatcaccttattacaataaactcaggtgtactcttaagggggcttgttatgaataacaaaagacacctgatcactcaggcaactccaagggttttagaagctctaggccagaagctgcagacaaagatcaaaaatatttcttatggcagtagtttaatagattgttttttcaaa

SEQ ID NO: 115003 - DNA, 328 bp, Homo sapiens
ttctgttccaggattcagagtattgaaatttgttacctagaacacaaactttgctgggaaacaaagaatgtcacacttaacattctatgtaaataattttaatattccagagttacagatgtccttatatcatttctcatctgttgaagaaatttagtaaatacaattgacttttgtctttttggctaactaaccagaaggtactgttagttattaatacaacataagtttctctttttttttttaaatggtcgaactagtttggggtggaaccagtatcatagatgtaaattctatgttcttgagtaagaagaacccctcttacctt

SEQ ID NO: 115004 - DNA, 369 bp, Homo sapiens
taaatggaatcatagaatatgtggtcttctgtgtttggcatttttcactcagcaggttcatccatgttgtggcatgagtcattttcccaggttcatccgtgttgcagctcgattcagtgtcagtgtctgtgcttctcctgtgggtggaactgagacttggattggttttagtgttgggagtggtcagagaggttttgctcacctctgtcacatggttgaatctgtggctgtgtgctatcttgaaggtttttaggtttgcttgtgttttcttcctattgaaaaggttgaagtttattttaacccgtattatttgaaggaccacatcaaatccttgctattgaaatcctttagttgataatcttatgaaca

SEQ ID NO: 115005 - DNA, 535 bp, Homo sapiens
ggtcattaacccctccctagggtgactataatggattccaacctatgtcaggaaagtcctgtgaaaactgataagttgagacttttaagtgccttgagatcttagaagagataaacaaacaatatccctgtgttttgtgagcatgttatgggctgcccttgaaatctgattctccatgcactggccatgctctgtcctttgcttggtgaccaggtgtagaacacacttaggagtagcaataaaaacagctaacatctattaaactgttactgtgtgctgggcactgtagtttaacgctcacagcaacattctaaggtacaaatgacgaaacagagaggttaagtaacttcccaaagttgcacagttgataagccagagccagtatctgcactccgggctccagagtccaggctctgctcttacccgagataagaagcagataagccgggcgcgttggctcacgcctgtaatcccagcactttgggatcacgaggtcaggagattgagaccatcctggctaaagtggtgaaaccct

SEQ ID NO: 115006 - DNA, 435 bp, Homo sapiens
tgtaattcagaaggaccagaaactcacatttcctgtggcctcaactatttggtttgaagaaaggcagcgtacacagtgtgcaggaggctagttttgccccaccccctataccattccagaagcccactgggaactctcacagggccctgaacgcccctgctctgccttagctctgtcttagaagtccctacagctgcctgcaccactccccacgcctacctgcttaggctcctggtgcctgtcaccttcctaccagtaggaggctctgctttttgccatggccctgagagctctgtgggagggcagaagctggggctttgagtccctgaggacccagctgacttacctgctggagctggctgcctggactctcagctgctttgtgcagagagaccctcctgccttgggcagcccagctttccctgccagccttcc

SEQ ID NO: 115007 - DNA, 374 bp, Homo sapiens
gaaggccaggatgtttcttactcctccgtttcactgtcatttgtggaatcggtctgctgcaggctgggcattgggcctagggctacacacatcacctcacccggcagctctgtgtggatggctgtagatgacccaagggggccttatgaggaaatcagggctcagagaggttaaggaacttgttctaggtcacacagacagaatgtggcagggcggggactagaaccgaggctggtttgatccacctgaaacccagactcgtaactgactctcacaggtgtctgaagtgtttgtgttctggtctccatattagaaagtgaaccttggtcaatccttaacatttagttttcctataaacagggtcagttcttagc

SEQ ID NO: 115008 - DNA, 577 bp, Homo sapiens
aggcgtgcaggtattttgatgaaggacatgggagctgcccgtttggagggaacggtttttataagcatgtgtaccctgatggccgtagagaggagccacagagacagaaggtgggaacatcaagcagatacccggcccaatgaaggaaccacttctgggaactcattgaggaaagagagaacagcagcccctttgacaacgatgaagaagaggttgtcacctttgagctgggtgagttgttgcttatgcttttggctgcagttggggacgatgaactaacagactctgaagatgagagcgacttgtttcatgaggagctggaagatttttatgacttggatctatagcaaccttgtgtggcgtgtgaactggtctgctgaccccagacagcagctgttccctgtggtggtgtggcagtgcctgtgttctctcctaggcaggcctgtcaactccaggtgctggcataagaatttttacccagggcctgtcttttcaacccctcacctttccccaaggagtgtgttgttttccctcttgaaaaaaagttagaaaaataaatcttaaagttagttttctg

SEQ ID NO: 115009 - DNA, 579 bp, Homo sapiens
ggaaaaaaaattaaggaaagtagatccaggaggaaagctggtatttgtctcactaaggtgacaacaaaactttctagtacagaggttatatctagcagttgaaaatacaaaactggagcagttcatgtgactaaacttgattctttacttaagcaaagttaaatcagtaaaactacttttaaaattaatgccttttaaaaccaaatacaggattctcagccaggcatggtagctcatgcctgtaatcctaacactttgggaggctgagccaggcaggatcacttgagctcaggagttcaagaccagcctaggcaacatggtgaaaccccgtctctctctcttttttttttttctgagacggagtctcgctctgtcgcccagactggagtgcagtggcgcgatctcggctcaccacaacctctgccccccaggttcaagcgattctcctgcctcagcctcccgagtagctgggattacaggcatgtgccaccacgcctggctaattttgtatttttagtagagacagggtttctccatgttggtcaggctggtctggaactcctgacctcaagatccacc

SEQ ID NO: 115010 - DNA, 618 bp, Homo sapiens
ataatagattatgggtaaaaagcgagattttgtgtccacgttgttttttgtcattggaagttcaaggattgacaaggtttgatgaatatggcctgcaatgcccatgccttacattctttttccagttacttttatgtaactttagaatattgtttaaaaaaatccctaatagagagtgaaagttgctttatgccttagcaagtattttagttcattactcaaagtcaagattcgtatccacactttgcttaccacagtgtgaggatctaaaccatatgtcagtgatggggagttaccttcatgtgccaattttggttgtgagggatggggttggctattgggggcctctttttggaacacgacttgacaatatgtattaagagtcttgaaaatgtttgcactccctgatccaataattctattcctaaaaatgtcctaagggcataattagaagagtggtttaagatttatggacaaaatattcatagagtgttatctagaatagcaaaaaagtaacatatatatatatatacacacacacacatacatatacacatatataaaaatgtagcctaactatccaaaagagaatggttaagtagactaaaatacaagaca

SEQ ID NO: 115011 - DNA, 493 bp, Homo sapiens
ggtcctgggggaggcgcctgcgcgcggtgaggtagtttttgcgtttggctttgccgccgcggtgtagtccgcgggggcgtctcgcgcgggcagactgccgcccctcaagcgtggttcctgccgggaatgactggggttggtcctgaagagaccacctggccaaccaagccgaggcaggctcagagcgccgcggggagcgcaaagccgcgcgcgcctctgagctccgggcagccgctgttcctcccggcggccgaacggtccgcgcgcagggcggtgtttcggcagccggagaccgcgcggtagccgcgcctgtattcccagcgctttgggaggccgaggctggagggtcgcttgagcccaggaattccagactagcctgggcaacagagcgagaccccatcacttttgtttcttttcttttttttttttttcctttttttgagacggagtctccctctgtcgcccaggctggagtgcagtggcgcgatctcgg

SEQ ID NO: 115012 - DNA, 358 bp, Homo sapiens
tgtttatagatttcgaacaagtggagatgataagagactcagaaagcctcaatgaaatggagctggctcactcttccttctctgaaatgcagacagctgtgagtgacatgggcctctggagaatgcaagtctttgccatggcacggctccgtttcttaaagttaaaacgtcaaactaaagtgttattgaccctattattggtatttggaatcgcaatattccctttgattgttgaaaatataatgtatgctatgttaaatgaaaagatcgattgggaatttaaaaacgaattgtattttctctctcctggacaacttccccaggaaccccgtaccagcctgttgatcatcaataacac

SEQ ID NO: 115013 - DNA, 568 bp, Homo sapiens
gactatgataatacctcatgggcaggtctaaatcaatatgcttagcaaacccgaagtttaccagcgtagtggaattagctgggaaaacagcccctgtctaagaggttttaaaattgcttcattccttctattcaaagttcaaccctcatcctggggaaggaaatggattctcatttttgtgtcttagttgatacttaatacgttccaggcccctcttctttgaagtgtgtgctctgtgtgtgtgtgtgtgtgtgtgcatacatgcatgaatacccgtttgcgtgcacagatctgtagcagcaaaactctttgtacaccacattcacaggagaagccaaggctcccaaacgtacccttttgcctggtcaagatgagctcaggagctgtgctgtgctgaggctgtggtaggcaaaggcttttaacacctggaatgaagctgagcaagagatggcagaagccaacacctgcggtcagagccagagctgtgtgtgtgccacagccctgtcagttacaggattctgccctggaagactgttttctagtttagtgtgagagaaggttggggata

SEQ ID NO: 115014 - DNA, 252 bp, Homo sapiens
ctggaggcctcacacttcctcatttcaaaaacatactacaggaaacgtagtgtaatcctgattacaaaacattactggagtaatcaaaatagcatggtactggcataaagacaaacatatagaccaaagaaacagagcagacagccagaaataaacatgcatgtatatggtcaaatgatctttgacaagagtgcaaagaatacatgatgtggaaaggatagtctcttcaacagatggggctgggaaaactgg

SEQ ID NO: 115015 - DNA, 636 bp, Homo sapiens
cccgggtgtggtgagtctaggggtcctggcgctgtgggccggggtgggcacttggggaggagtgcgatggggtagacggacatcttccctccaggctgctcgggcagggctggaggggagtgggcttcaatctcagcgtcctcacactgcttctgtccagagctttgcgcaccggtctcctaccccgccggcagccgcaagggatcgcagaaggtccctagggaattcaggccgaagagcaaactctggtgccctgaagtgtccgttgccccctcgcgggacctcctggatcacctggcggcgctgccactttctgtatcctgttcctcaggccttctctttgtttaactctgtgtgcccagggttgcccttggggtccttctccttgagctgggacttgattaagcgactactttttttttttttttgaagaaaaaaatcagttggcttaaaaggcacattaggatctactcctctatcacaacttcaggctgcgtcgcctgcctccttgccctttgtttatgctcttcccgttacctggattgtccttttttcctccttttaagactcctactcttcactatcgaggtttcacctcttctgggaaaactttctgagaccgccacccagaattga

SEQ ID NO: 115016 - DNA, 288 bp, Homo sapiens
acacaattatgaaacgtttgcccgagtcgcacaggccactgtcccctttgtgctctttacattttttgttgctatctttaaagtcctagactgtaatcttttctacagttctccatgctaccctctagtgagggtaaaaagggactgcagataccttcttgtgaaatttgagtttgttctgcaaaaccctcgcaaacactgttcccccatcccttcacaaatgcccttccctcctccttgcccagctaactcctgtcctctagatctcactgtaactgtcatttcttc

SEQ ID NO: 115017 - DNA, 415 bp, Homo sapiens
gtgaataagaaatggagtggagtgagggctgggggaggtggcatttccaggtagtcagtgtgtccaggcagcttcctccccagcactcctctcccccagcacccgccactgggcgggaagccacagcacctcccctcctggtgtccagaggccaaggtcacaccagagccctgtgtgccttcacctcctctggggccagtggtgtttgtcactggggcaatgtgtggctgtgcccggctctggcagtgctggggtgacattcatgccgtgtgagctgtgacgcctctgcaggcagagggacggcaccacccaggctggtgacagtgatgggggaggggtgaggtgggctgtcacctgtccaaggcagccggggaggtgacatgttgtgtacccatcccacagtctgcagggagga

SEQ ID NO: 115018 - DNA, 139 bp, Homo sapiens
accctcacagacacacacagaatattgtttgaccagctatctgggcatcccatggcccagtgaagctgacacataacgttaaccatcacaagtagggacccctgtttttattctcttcttaataggcttggggagaggt

SEQ ID NO: 115019 - DNA, 382 bp, Homo sapiens
ctgtctcccaaatgatcacagactttttcctccacttttgtcactgccactgcccttagcattactctgcctttagagaaagtctcttaattggtttggttgcttccttcagtctttattatacagaccactacacgcacatctgacagagacttttcacctttttatggttgaatgactgaaattcccagaataaaattaaaaccaccccacccatctctactaaaaatacaaacattagctgagcatgggggcgggatcctgtaatcccagctacttgggaggcttaggcacttgaatgagaatcacttggacccaggaggtggaggttgcagtgagcaatgattgtgccactgcctgggcaacagagtgagactctgtc

SEQ ID NO: 115020 - DNA, 647 bp, Homo sapiens
cagagatagtgcttggggaggcaggaatgctggtcttctaagagcatgctgggctttttctctttccttcctaaagccagtggcctgctcaccgcccttctttctgagcagctctctcaaggccaggctaaggacaaggcatagatgtggagctgaaaggttaagctccctaccctccacccctgctggtctccagaaggggacaattggaattcaaatatccagtgtcatgaagccaaggagagaggtggcataggagtctataaagccagcccactagcttctctctcctgggaactccctggtttatgagctgccaacccgagcttcatgggtgaaaaaagcacccagacttccagaaaattgtctgagaatgacagccttccagctctgccttcagtctccatcccccatgtcctgcatcctggatctagcaacaatattctgatgcacaccatctcttttctttggcttctctccctccatgacacaaaggccagagtatgatagcctgcctagaaatcaagaccatgataactaattaaagtcatagacttccagactgttaaatcttagtgtggcattagacatgatctaatctaacatccccattttatagacggggaaactaaggcccagagagaaag

SEQ ID NO: 115021 - DNA, 269 bp, Homo sapiens
gggaaatgacacaaattaaacaaaaataaacataaaagccaaaagaaatgtaaaactattctatgttcttgaaacactcttgacgtgtatcagtgatttctttcatgtaagccactaaggtttaagatctattacttgtaacaggaagctggagtatatgtctctgtaataattggccacatcatcattttgacttgatttctaagtggatgcacatccatttctaagtggatgtatctccatagtgaaaataataccacttgccatag

SEQ ID NO: 115022 - DNA, 167 bp, Homo sapiens
gatgaagggtcagctcaggggtggtttccttctcggtcttctttcctgtagtggataatgacataacagggaggggaacaggagcaatagttcttctttggtggatcagtccttacagcgcttgttgacctctaagagtttttaatttaaaatactcattatatcat

SEQ ID NO: 115023 - DNA, 721 bp, Homo sapiens
gtcactaaaattttctgctgtcaatatttggactcatttcctccaagtctttgaataggagaatttagttggttggtcagctgggtacaattgtttgtacccacaaaaactctctagggcccattttttcctgacaatgaattgggtatttagatagagaattgcattcatgcatgtaggggactttcaggcttaggcacaccctgaagcaataatgtcttaaatcaggaatcacttaatttccacagtggcatccggtacttccatgggaagtaagctgagaattattatgcaggttactgtcccctcctcaatatctttccttggtagtgacactaccttattctgcttccacacattcctgtccatcattggagagactcactggaagttgaagggaaatggcattccaagtgagtgatgtgggctgacatacctgggatgtccctgaggctgccactctcagcatgcctcggtactttggatgccatggtagttaccacacctgccagtgttgggtttaggccctggttacaagtgtctctgtattttgttttttaatgtgttttggacccaaaggcccttctttaacttctttccatcttagcaaaggagtaaaaaagttatggctgaatggggaaagctaagttaaaagttggcttctgggaaccctcaccctaagcttttgctgcctggacaacttccccttactttctgaaga

SEQ ID NO: 115024 - DNA, 441 bp, Homo sapiens
cagcacatctatgatgctttagtcaagcattttagttgcaaataacagaaacctatgtcaaactttaagaaaaagaggacatttcattatcatcaacatcagcatctcatgaaacccaaaggcaactggcctccaaaaaggctggaacagggacctggaaggccaggaagtaccaaggtcagtatttttgttttttgttctacttttctatgtgcacctgattcattgtacccaaatttgccatcaaaccttcctaatttacttctcctgtcatcaagtgaccagcccagctgaattatcgttactcagtttcaattccaaattaccaggagaatgtagctctgatcaccccaatttgaaaagttatcttttcctagttctattgtctttggccagcagggcggagccatctaccacaaaaatggctgccatggctcacct

SEQ ID NO: 115025 - DNA, 369 bp, Homo sapiens
ctgctggaggcggccagggaggcaggggtgtgggcgacactgggaatgcagccatcgtagctgaggagtccaagtgggcccatgactggaagtctcctgcttctactaagaattttttttttcaagacaggagttttgctcttgtcgcccaggctggagtgcagtggcccacctcgacctcccaaagtgctgggattacagacatgagccacctggccgtatccagttatctgttgatatcagtatggatttggggacatttattttatgctgttataaaccaatgctatggccattgactcattccaggtttggcccctgggatctccctcaggctggcccctgggttctttcaacaattccccatct

SEQ ID NO: 115026 - DNA, 625 bp, Homo sapiens
ggaccacagccagagatactggccgtgagctggaagcatccagtttgatgtcagttgctctattttcatttcaccaaatacaccaacaattggggaagccatttgtgtattcactcatagagagtgcagctaacttaaataaacattgctcaattcagcagaagatctggaggcacactattcctgtattggacacaattaaaattgtttaaagattttattaagtttctgctttagaaaacaaggatattcctttgtgaagaacaaaacccagtgtgttccagctgtaattcaatgttttgaaagctatttccacaaacttttcccagcagccacactcatccctagagatgatccacattcagaagaaaatgacagatgatgcacgttcagaggagaatactatgtgtcttcattgcacaaagataaaccttgcctaatcctcacattcagcacatggggcatttttgaaggtactaggtcagtatttgttctctgtttcagcgttgtacagataaactcaatgataaccattttggtattgtttccttcatatttattaaataaacaatattaatatctaatctaattggtggaagatttggctattacatctctaataatg

SEQ ID NO: 115027 - DNA, 694 bp, Homo sapiens
ctctatcctatacctaggagatcatccaacctaagttatcaagttttctgaagatggcttttttcctgtattatattgagtacctgcaccatgatggatataatcagacccccactcatcaacaatgctgcaagtgccaaccttggagaatttttaattggtttagaaatgatgtgagtttatctgtacgacaaagacctagaagcagaactgctgaggcaaagggaatgaggtgacggcataacagcatactaagagtgtccccattccacacaagccgtttctgacttccacttcagagatgagggttaactgtccttggatttcaaataaatggaatcataaaataggtactctattgtgtctagcttctttcatttaacaatggttttgaaattcatctacagtgtttttttattgccagatggtattcaattgcgtgactatatcgcactttgcccattcttatgttgagagatttaagttgtttcaagtttttggctataatgaacaagcctgctataaacatttttgtacaagtgtttttataaacataaaaagagtcttccaaagtagttaaaccatttatacttttattagaaatttatggagttctagttattccatattcttgccaaccgtaagttgttccgcggagacactacgtttagtgagggagaatctgtatatgtga

SEQ ID NO: 115028 - DNA, 746 bp, Homo sapiens
gacttcctgacctgcagtccccccaccccaacacatctctctctctcacacacacacacacacacactccacacgcacatgcgtgcacatctagagagcgtctggagttcagcgtgatcaagacccagcttcctgtgcctctgcgaagggcactgccccctcctttccttccacctgactagcggagacctgcgggttgtccttgtccctcttcaccggcagtctgtaaccaaggtcctcccactttcacctcctataactttctctgatctctgtctacttctcaccaccactagatccgaaaccattcctgcctgctccccgctgaactgctgtgatggtgtctttaagaggcccttaggttttctctctgggcagccgggggagagcttatggcacagtactgcgcacccttgacataactaactccatcttagaaaaagacttcattttatatttcatagggtgctttgccaacaagggcaagatgttttgtttaataaaaaatagaaggtcaggcgctgtggctcatgcctgtaatcccagcacgttgggaggctgaggtgggtggatcacgaggtcaggagttcgagaccagcctggccaatatagtgaaaccccgtgtctactaaaaatacaaaaattagctgggcgtggtggcaccgtgcctataatctcagctactcaggaggctgaggcacaagaatcgcttgaacccgggaggcataggttgcagtgagccaaaa

SEQ ID NO: 115029 - DNA, 427 bp, Homo sapiens
tcactttaccctatcttgttcctcatttctccctactttatattaattctaaagagatacggagtaaaatatgtgtcgtatttggaagcagtacttccacagaattttagagcacaaaaattaatttcaggcatcagtcctctatcttatattaacatattatcttattaagataaattttattaggaggctgaggcgggtggatcacctgaggtcaggagttcaagaccagcctgactaacatggtgaaaccccatctctgctaaaaatagaaaaattagccggacgtggtggcgtgtgcgtgtaatcccagctacttgggaggctgaggcaggagaatcgcttgaacctgggaggtggaggttgcggtgagccgagatcgtgccattgcgctccagcctgagcaacaagagtgaaactccatctc

SEQ ID NO: 115030 - DNA, 212 bp, Homo sapiens
actattccacttaacatttctactacaagtagaaatgctccctgccagcggttgattctagagatgtcttagcctccaccatccctgtttaatgaagtctaataacaggcctctctttacccctcacatctctccttagattgaaatgtcactgtgcctcctcacagtgcacggcaaaagcatctccccacccaccccccatgcttatccag

SEQ ID NO: 115031 - DNA, 372 bp, Homo sapiens
aaagagggcttatggaagatgaatgctggaaaggttagtgaaggccagaaatagcaagttggtaagtttgacgtttatattttgtcagaaagcttaaagctgtatgttaggaagttcacatttcatctcgaagagttatttagaatttagggacctggattgccagtcatctttgtgattccgaatgtatttctcaggtcttaaactttaagcatttaaagcctgcatgattatgcagaaaagtaaaaatcttcatctatatttcatagattattgagattattgttaagtaacttgtaggtaattaattcatgacttagcaatggaggttctctttgtgtcagcttgagttactaatatcttttgatgatg

SEQ ID NO: 115032 - DNA, 807 bp, Homo sapiens
aaatgttcataacagcaacagtcacaagaaccaaacaggggaatcgacccaagtatccatcaacagatgaattaataaagtatcatatatccacacaatggaaaattattcagccttgaaaagtaatgaaattctgatatatgccacaacatggatcttgaaagtattatgctaagtgaaacaagccagacacaaacaaaacaaatattatatgattccacttatatgaggtaccttgaataggccaatttataaagggataaagtagaacagaggttgccacaggctgcaggggcaggtggggagggtggagagggtagaaggaatagggagctattattaaatgggtacagagtttctatttgggatgatgaaaagttctggaaagggatacgtggtgatggttacacaacgttgtgaatgtgcttaatgttgctgaatcatacacttaaaaaactgtgaaaacggcaaattttgttatgtacattttattacaataagaaaggttaacaactcaacacttgaggctgggcacagtggctcacccctgtaatcccagtactttgggaggctgaggtgggtggatcacctgaggtcaagagttcaagaccagcctggctaacatggtgaaaccccatctctactaaaaatgcaaaaattagccaggtgtggtggcgtgcgcctgtaatcccagctactcaggaggctgggacatgagaatcgcttggactttggtagcagaggttgcagcgagctgagattgtgccactgcactccagcctgggcaacaagggcaaaactcagacc

SEQ ID NO: 115033 - DNA, 295 bp, Homo sapiens
aaagacttgaacagacacttcatcaaagaagctgtacagataataagcacatgaaaagatgttcagcatcattattaatagggaagtgcaaattataacaagataccattgaacacctattagaatagctggtaataacacatgctgagatatgcagagccactttcagacattttgtctgaaattggaaattttacatttccaccacaggtttagctacctgggaggtggaggttgcagtgagctgagatcacgccactatactccagcctgggtgacagaacgaggctgtctc

SEQ ID NO: 115034 - DNA, 209 bp, Homo sapiens
attctatgagatcagcattaccataataccaaagccagaaaaaaaatcacaagaaaattacagtgcaatgtatcttatgaatatagacacaaaaatctttcagtaaaatactagcaacccaaatctaaccatatattaacgtcattatacactatgaccaggtgggatttatcccaggaatgcaaagttcatttaacgtaataaaatcg

SEQ ID NO: 115035 - DNA, 797 bp, Homo sapiens
tccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaactaataatggcagataaggaggttggtaacaaggaagatgctgagacaggcaacgtagcctatatctaccttctcatccagtaaccaggtatcctgcccgctatgtgacccatgctttccacccacaagagattgaacgaacatgccatgtactgaaatggtctgatggaggaagatacagtcatgactcggagaacaaaaagcaggccaagaacaagaagtgacactgggaacagctggcccaaacttctctagacgtgacaagaatcgggaagtgtaagctcggctaattcctggtcccatcaacaaagaac

SEQ ID NO: 115036 - DNA, 354 bp, Homo sapiens
catcttcatgaagagctacaggacaaggcttctgactttttttaggttagcttagtgtcattgtctgttggtgactgaaggaagctagctggcgcagcccccatgtgtgcaaggcccccgagtacacctgatagagccctatctggtgtatatgggtgcatgtcgctggcatcagcaccctgccggggtgagggtagttcctggagctactgggatgaaatgcagagctcccaacctggaggagtgcatggcccagtggaggagacagggcagtgaccaagtacagtggactgtgcagtagctgacccaggaagaggggcctcagccagggcagtgggcggacggccacacggg

SEQ ID NO: 115037 - DNA, 1627 bp, Homo sapiens
agcgaggtgtggctgtggaaaaagacagggttaagcaatttttttaaagcactacatatttattgatagaatatctctccaggcagtattcacatgctttaaactgaagctcgtagcttggcagtgcagtttaagcaaataaactcaggctgttgaacacaatgattaacaggaagcaggggaggggacatagttactagactctggccgggacaagaggctgaggttaaggtcttagagccgatgacttgcagaatggtcacctcacccacttgcaatttcatggtgggaacaggtggaccccctggaatcagaacctctctgaggacatctgtttttgtgtagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtatgtacgtctcttaacttttatttttacgaataaacactgcatggtcaatactaaataagttgctttgaaaaga

SEQ ID NO: 115038 - DNA, 1569 bp, Homo sapiens
gagatcgtgccattgcactccagcctgggcaacgagagcgaaactccgtttcaataaataaataaaataaaataaaaagttgcttgtctactacatacagacaatgctaggagccagaaacatgaggaatacatgagctcggcgccaatggaacatgctttcacaccgggtgcagctaaccaccacatcatacaaaactcgtcgctgacgttttagatgtataatctgattggcatggactcacagaggagggagtaagggaagagtaagaagatttcaaaggagagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtatgtacgtctcttaacttttatttttacgaataaacactgcatggtcaatactaaataagttgctttgaaaaga

SEQ ID NO: 115039 - DNA, 1521 bp, Homo sapiens
gttcactgctggacgcctctgggcaatcttaccctcctgggaactgagagagacaatgctaggagccagaaacatgaggaatacatgagctcggcgccaatggaacatgctttcacaccgggtgcagctaaccaccacatcatacaaaactcgtcgctgacgttttagatgtataatctgattggcatggactcacagaggagggagtaagggaagagtaagaagatttcaaaggagagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtatgtacgtctcttaacttttatttttacgaataaacactgcatggtcaatactaaataagttgctttgaaaaga

SEQ ID NO: 115040 - DNA, 1265 bp, Homo sapiens
  misc_feature (1226)..(1226): n is a, c, g, or t
agcgaggtgtggctgtggaaaaagacagggttaagcaatttttttaaagcactacatatttattgatagaatatctctccaggcagtattcacatgctttaaactgaagctcgtagcttggcagtgcagtttaagcaaataaactcaggctgttgaacacaatgattaacaggaagcaggggaggggacatagttactagactctggccgggacaagaggctgaggttaaggtcttagagccgatgacttgcagaatggtcacctcacccacttgcaatttcatggtgggaacaggtggaccccctggaatcagaacctctctgaggacatctgtttttgtgtagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttccctcaaggtttgtnttttcttgtattaactgacacgttgccttttgtttcggt

SEQ ID NO: 115041 - DNA, 827 bp, Homo sapiens
agcgggatgaagcaagaaggcacattggaaaggtctatgtttccagtataagacagggagctgaggatgtctccccactgcccaataatcaggaattgaaggcagcctctcacagacagtcagcaagaatctgaggccttcagcccaacaagccagaaggaaatgaattcgctaacaaccacatgacactggaagcagacctttctccaattgagaagagaccacagtcctggtcaacatctaggttgcagctttcaaatgagaccctgagccagaggacccaacaaagccatgcgcagactcctgacccacggaagtgaaacatgactcctacagtcaccacggagtgtttgagtgacacgaagtctccatgtcatggatggccaggcagctgctgaatgaggcatgctcacgttctgattccccagattaatcaacctcactcctgccatctattccatccctctgcaatctcctactcacttgaatatcataagtctacgtttttttgtccacaaggagaaaataattcttataactttagtccctagactgttacttttcaaagtattctttagggaacagaaagagaatgcatcaaatcatgtctgcagctactgtccctactgaaatgtggcacatcttgtgtgccattagcccccatggctttatattcttttccacaaaaccattactcatgttttaattttctgccctgtttccctcagactgagttgcatttttaaaaatgatatctcaagatctttaagacaccgtacagtgggttacccttttattatcctcctgttcaagccttggcatgaaaa

SEQ ID NO: 115042 - DNA, 680 bp, Homo sapiens
catcacttaatttgtgtggattcaatgtagtacttagcacatggcaaattcaagttttgctttttgcaactttgtacaatttttttatttttccaaatatttttgatccgtggttggttgactttgcagatgcattaactcatggatatggaggactgattttactctgaaggaacccaacccagtctgtgttgagtggggtggggctgaggcctagggaataggctattcagaaaaggcttccctgaggaaatgatgcctggagctataatttaaagaaggagttaaatttggcttggcaaagaaggaaagttccagagaaatgaagagctcctacttataggaaattaaagctcctcccatctgccttcaagtttccctaaggaaagtctggatcttcagcaagaagtttcacccttataggagaaaaagttgtatttaagatccagggcatttatcttaaggatggagttgcattcaaaagtggtatctcacgtcatctgaaatcttagtctcttatttttgtgttttttcctacttccagtggaattaatgataaacactgagattacttctaatgggaatgggtattctctgcaaaggatttttcctctttcccagggctactgtagatgaagacttttggcaggctgcattgattggcattgggctatattact

SEQ ID NO: 115043 - DNA, 200 bp, Homo sapiens
ctgggtttggggtttcgtagcagcaaaggcagcaagagcttgaagcagagctcaccatgaggccattaggcattgctgagcggcctggggaccagggagctcccgggagctctctcccaccccccacagaccccagagaatcaggcagctcttccctgagcccccggcagcaatgtgctattgaaacttctaaaactagg

SEQ ID NO: 115044 - DNA, 129 bp, Homo sapiens
cataggcctcctacctggtctctctgctccagctctcaccgccctacactctattcacaacccttctgagttgtgcactgatccttccaaaacatcaatcacacaattttactcctctgcttaaaactc

SEQ ID NO: 115045 - DNA, 232 bp, Homo sapiens
tctcccagaagacgggcattctccctgcccctggccttgagacgtccccaccgtaaaacaaatcttaaaaaaaaacaaaaaaaccccaaagaactattgtctgaattttgccatctgaacataaccttagcagagagcttttccatagcatggtagagttgctacaccacaagaagacttcctcaacctgacaaaattgacaaaaccttcaacacaaaacctctgctaactt

SEQ ID NO: 115046 - DNA, 429 bp, Homo sapiens
acaaaggccatgaaagataatttaacagaggaaatttaatgaaggaaatagtcacaaagatgttgaggaggtgaaaagccaccagggtatggaaagaagcccagagtttaacagcagcattagctgttttgtaccagcatcagttgaagtaaacttccaaacattcgcactctttctttcatagacctaaggacattaaagaagaaaaaaatcctccctaaacatttggagtattcttcgtaagttgcttaatatcagtaagattaaaaggtaagtagtgtggctcacgcctgtaatcccagcacttgggaggtcaaggcgggtggatcacgaggtcaggagttacagaccatcctgaccaacatggtgaaaccccatctctactaaaatacaaaaaaattagctgggcgtggtgcacgtgtctgtagt

SEQ ID NO: 115047 - DNA, 442 bp, Homo sapiens
aaaaaaaaaacaacgcaaactactaaaaagtgtcattaaaaaataaaataaccaaatacaatgtatgaaccttcacacactagattaaattagatactgaatcaaaaagcaaaagttatgaaagacattttaagaacaattagggaagttgaaatacagactgtatattaaataatattattgaattagtgttaattttcctagatatgataatggtattgtgattataaagaagaacattcttattcttaagaaatgcttgctaaagtgtcatgatgtctgcaacttaccttcaaatggttctaaaaaaaaaaagagggagagagaaagaaggtacagtcaatgtggcaaacattaacagccggaaaatctacatgaaggggataaggatacttcctgtactgctcttttaactcttctgtaggtttgaactttaaaaaaa

SEQ ID NO: 115048 - DNA, 541 bp, Homo sapiens
caacgttcccagccacagttctgtgagctatggttcagactgaagtcttttgcttattttggtgataaaagctgaacatggtttgtgctgaagttccagctggttatcggagtggctgaccaggtcagtctgctttgtgaaggggaatccaggcccctcttgccctcattttgcagcctgaacacatgctcactttccactcccacgtgtgaagcatgaacacacgcacacctccgcccagttatgcagtcgggctcacggctaaaaaccgattttccaaatgatcgggcaggatcacgcatggatgacggaagctctggctctgcccccacactaattgccgtgcgatcccgtgcaggtttctttacttctctgggcgtgtttcctcaccggcaaaatgggaacacttaacgaggaaactttgcagagagcattcagctttcaaactctgactccccaagcgtgtgacatattttttaataactcctttctcattatttcccttttacctccttgctttgaatcttgagacacaacagaa

SEQ ID NO: 115049 - DNA, 263 bp, Homo sapiens
tggggggctcttttccgaaaaactgcccacccagcatttctgtttttttaatgggaaacaaagataagtagaaagtgttgttaatgcctttgattatagaatcagtttacaaaatgtagaagaaatcacagcattagggaattagaattttacaaataccattgtcgtaacagattcaggcaaacaccagtggatgctgagagcattgagtgaaaggtttttggggaactggctagtcacacaatctggaagtatcagcccac

SEQ ID NO: 115050 - DNA, 321 bp, Homo sapiens
tagggaagtggggagtagtgttgtcacgggagccctgggggcctgtcatgggcattaggagtctgagcaggcttgcaggggaaaggagaattggaaattctcccgtgcctcacagatatataaataaagcacaataaggactataatgaggaaataaatgtcataaaaatgtttgatagcagatggaacatacaaacacaaaaagatgccaatagcctccagccaagagaaataagggaaggagctcggtctaggtgaccccgaagctctgttttagcttgcatattctgtaatttctatgctttgatttattgaatttca

SEQ ID NO: 115051 - DNA, 299 bp, Homo sapiens
gaggaactcaaacacatcaccttcaaataagattaatcatagaccctcatagaactcttaagagtattaaacgtggtaatgcatgtaagtgctttgcagagttcacaacatttagtagatgttagctgtttgtaatcatcgtcatcattatatatccttatgatttgtccttgggaaaaactacttttgatctaagtggattattatctatctcccagctctgctggccaggtttttatttagttgtgtaatcttggacaagttacctaacttttttgagtctgaatatatttaatctg

SEQ ID NO: 115052 - DNA, 209 bp, Homo sapiens
cttcccaataataagcaaagctctgaggaataattttgtacacaagtttttgcataggtccatactattcctctggaatacattcctggaagtagacttgatgagctattggatgtggattgttctccagccatggtgagccaaggaatattccatagatagaaggagagagcctatcactcctaacctccccaatgcttggtggccat

SEQ ID NO: 115053 - DNA, 120 bp, Homo sapiens
tttgtatatggtggctttggagaaagaacaggacttgggtagaagtggtcagagcccagcttgaatgggggtgacttgaagttggaggaagagtaggacaggtctggaaaggccaggagc

SEQ ID NO: 115054 - DNA, 244 bp, Homo sapiens
accttgccccaaccgcttccgaatcacctgttatttgtcaaaaatgcagattcctgcccccaactctgatttgttgaattaggatgaggaagaggggacagcgcccagaaatctgcactctcggctggcaccccagccatcacttatgcacctgaatgcttgagaaattctgtcgcagaacatggactttggagtgtcacagacctgggttccagtcccagctctgccacaaagtagctgcgtg

SEQ ID NO: 115055 - DNA, 940 bp, Homo sapiens
agcggagttgaagtggtaggaaatttttacataggagagtatggtgatcatatttgcattttagaaaataatggatagcagtttgttaggggaacaaaggacagagacagggagactatttaaaacattaataaaaaataccagtgacagatgatgaggcgtctgcctgatgggaatggagaagaggagatggattcagaaactacttaggagaggcaggcagtccaaggctgatgcccaaagaagccatcaagacccgtgctacttccagctccttctgtcctcataatcatagatgattgctccacatccagagtctcgctcagtttccaggctggagtgtaatggcgtgatcttggctcactgcaacctctgcctcccagcttcaagtgattcccctgctttagcctcccaagcagctgggactacaggcatgcaccagcatggccggctaatttttttttgtattttagtacagatggggtttaaccatgttggccaggagttcaagaccagcctggacaagatggtgaaacggggtctctactaaaaatacaaaaaaatcagcggggtgcggtgggcaggcgcctgtaatcccagctagtcgggaggctgagcacgagaatcgttgaagccgggcggcagtttgcagcgagcggagatcgccgccagtgcactccaggcctgaggcgacagacttcgtctcaaaaaggaaaacaacagtgcgagagaaacgaaacacagggagcagggcaggtgggccaggaaaaaggtaaacacccgggcccgggacatttacctctaaaagttgagatcccaaaaagtcgcagactccaagtcttaaaacaggaattcgtacacagggggtctgggaagttgtgagagcgagagtacgcagggagacaagatggcaacaaaacgtccaagaaaaggggaggaa

SEQ ID NO: 115056 - DNA, 653 bp, Homo sapiens
caacaaaagaagtgctttatcttcatggcctcgttggagctgggaacattctggacctcagtgctggagcctgctttcacttcctctactaccacagtctcagacttggcctgacagggcacttcagaccttctcctgaccaaccagtccaggtccgactggttttcccaaaagtgctcactgcatcgcatagagactgtagtgcacattaaaatgaattacgtccggagaatacaagatgatcagatatgaaccgttttgactccaacaattataatggctctgtgctgtgtgtcaggggctatgaaacaggcgttaaaaagaatgaggtgactggctgggcacggtggatcacgcctgtaatcccagcactgtggaaggctagggcggatcacttgaggtcaaaagttcgagaccagcctggccaacatggggaaaccctgtctctaccaaaaatacaaaaattagccaggcatggtggcgtgtgcctgtagtcccagctactcaggaggctgaggcaggagaatcacttgaacctgggagacagaggttgcagtgagctgagatcctgtcattgcactccagcctaggtgacagagcaagactccatctcaaaaaaaaaaaaaatgaggtgacttatgtgtgtccagcat

SEQ ID NO: 115057 - DNA, 545 bp, Homo sapiens
gagcaggtttctcgggacaccccaggccgtgacgtcgcagcgtcacagccaccgtcatcgattttgcagcagttcccctcctcctgtcccttccccatcagactggtaaaggctggagagagtgggagcacggtgcctccgttcctcatgttgccacgctgtggggagacgtgtgggcagggacaggcgatggccgagccccattcctcttgttgccatgctgtggggagctgtatgggcagggacaggtgatggccaagttcctgcccgcctgccagccggggcgcccaaaaagccacggggatcccaggggtccctccaggacagacagcgcccaagcctttgtcttgtttgaggaagaagaaagggtggtgagggtggccacgtccccacctggccatggttcggttcgttttccgtcattgccgaaaggctgatgagcatggggatgatgcttccccagtgaggtgaggtgtccagtggccaggacaagaggcaggtgtgggtgtggaggaaaggtgggcctggccctgagagagccgaga

SEQ ID NO: 115058 - DNA, 359 bp, Homo sapiens
gcgtgattcaaactgatcagagcagtgccatatattgagcacaacatgataaatagagccaggtttcacacttgctctgtaatgaatgcacagtcccactgctaatcggctatctgattctgatcatgtaccaaataagtttcagtttcttcatctataaacttagaataaaaaccaatgccttgatgcaaataagttttataaagtataaattgatatgcaaatgtcaggtcatgactaaatgctgataacttatcaaaaatgttaaaaatgaggctgggagcggtggctcatgcctgtaatcccagcactttgggaggctgaaggggggtggattgcttgagcccagcattttgaga

SEQ ID NO: 115059 - DNA, 786 bp, Homo sapiens
agtatatcaaatccaaatacaatttacttggcaatacctactcttttagattacatgtaccgtctttttgtacaaatattgaagtatgacatggactggtaacaagactactctgtagcctctaaaatatcttacaattgtttctaattttttaatataaaagaccctttagttaagaccaataagaaagaatgctttcttcaagactcaaatacggtctgggtatggcagctcacgcctgtaatcccagcactctgggaggccgaggcatgagccaccgcacctggtctgttttaggtgttttatatatcatttcaattaatccaataatttcatgaaggaggtactatccacattttacatttaaagaaactaaattccaagaggttaagtaacttttccaggttataaaattactttctgacaaagctattaattcaaagttaagtatatgtgactcgaaagtctcgtgtaccacatgaattttcaatctatatgttacatcaataaaagaatgggtagcatgcccacccatgtaaaaatctgttttaatagtaaaaacaaaacagaaaaataaaaagacttagtaacatattaatgtcagtgagtattccaaaaaaaaaaaaatactgactgggtacagaggaatacgactcacaaaagtgagctctggaagataagactaggaaaaaaaggtggggcagggaggagaaagaacacagaaagccaagaatgttaggctatagaatatggatttagaaattaggaaaccataaaaggtgaggt

SEQ ID NO: 115060 - DNA, 235 bp, Homo sapiens
agttaacaatttgataattgtgctcttcttctaaggtgaggtttttactcccaaccaccatataggagaatgattagaaaacaatcatttttaaagaacaaaaagaaaaatccactagcattttgttttatattgtgttttgttacaagatacatcgtactctaggccaggcgcggtggctcacacctgtaatctcagcactctgggagaccaaggcagactgatcacttgaggt

SEQ ID NO: 115061 - DNA, 413 bp, Homo sapiens
tgagggagttgtttgtataatggaaagtgattaactgtgattttctcttgttagggctctcctccctagaattcttctattcccccaggggtttctcagtgctaaatgttgctgatacagactagagtcaggcctttctcttgttacacataatctagagaaagtaactcatgttcccaaataaatatgtccaaaataaggagacaaatgagcgcaagcacctcaaaaggcaagtaaaagataacaaactgtgtgtatgtgtgtgttttcttgttttatgttgttaatatctttgtgtatatagtagaagcaaaggcagatggaataaaaagaaaagtctaataaattttctaaaagatattaacaacatgaaacaagaacaaaaacttacttaataggaccaaaggaaaata

SEQ ID NO: 115062 - DNA, 498 bp, Homo sapiens
ctccgagcgttttctattgcggaggttggtgtggcttgggcggttggctgggaggaaagtaactaaagagcagaggagtgtagggtttgccgtcgcttcggtcccctcctcaatctcctgccttcaagccggtcttcctcagaggttctcgtgtttagatcagcttgtctctaaacttctccgctccttcctgggacagagacctggctgtcccgagaatgttgcgtcccttgaaactttctcacatgaattagtattctcaggtctcagtttgcagaggtcgggattatgtgccaggtgctgtcacctcttgtaaaaacacttgcttcttcagcccttccccttagactctgtcacctacttcaccccgtttggagataatctgccgatctgtgtatccagctccttgtctgtctcccgtctgaccatctttgataatttcagagcctatgtggccaacccattcaacatcgggcctcgtctttagcgacccttata

SEQ ID NO: 115063 - DNA, 108 bp, Homo sapiens
atctaaactgtacctaaaattgcccacacaacaaagtacataagaatactattcttggccgggcgcagaggctcatgcctgtaatcccagcactttgggaggccgagg

SEQ ID NO: 115064 - DNA, 735 bp, Homo sapiens
agcggaagaagtataatgcctaatgcctaatttttgtcacctggaaataattccagcttcactaacatttatcatatgactgaataatcccagtgccttcacatgtccttatgtcagcaagacacttgtccttataagccactaaaggaaaagaggaaatgtttccatgagggtggggctcctcatttactcacctgagcacagctggtaccttgtgctgtttacaggtaaccagtaaatggaggtatagattatgcgatctggctttaagaaaaccaacccttacaaagtaggtaactgcaaagaaaacatggattggagataatactaatgatacaagcacatgccacaaaagtaaatggtcagccaaccctttccatacccttaggcaagacacctaaccagccacatcacacccccaaaaacatatcttgatcagatgggacaagttgcagccaagtgaatgaggaagaacctggttttcaacagaaactggtaccgtagagaaagtgctttgaaaacaaatgtttggaaaatatttctattgtttagtgtttttgttgctaaaaatgatgtaactaggtcatctacaaaagctctcatatctgcagacttttaaaatccggaaacagaactgtaaagattcatttgaaaaaaaacatgaacatttcagtggattttgaacccatttgttaaaaatataaaaatgcaacacttgattagtttgcatgaaaa

SEQ ID NO: 115065 - DNA, 322 bp, Homo sapiens
ctcccccccgcacccccgcctagcgtccttcccccaatcccctcaggctcggctgcgcccggggccgcgggccggtacctgaggtggcccaggcgccctccgcccgcggcgccgcccgggccgctcctccccgcgcaacctggaacaactttaaccaaggtctatgctgtacattatcttctgaaccctctctgtgcttagctcaatcactgagtgctaaccctaagttggcagtcatgtatttataatcaaatactgatatatgttctgaaggctgcataaacagaagacatatcatacttcagtatcatataattaccac

SEQ ID NO: 115066 - DNA, 490 bp, Homo sapiens
ggatgcagtggtgagcagtgagtcatttctgatttaatgatccacaacatatggaccgtttccgtccaaggaagtgcaaatcctttttcgaagtagcagagtacaacttagaaagaaataattctttcatttcattaagatcagtgatgaaagaatacttttaaatttcccctaggtagaaatgagaatattctgtctcctaaaatccaatgtctgtattatatttttccactatattgtactttgcctaaattaacctttttttcttttttttctgttttttttgtttgtttgtttgtttgtttgtttgagacagagtttcgctcttgttgcccaggctggagtgcagtggcacgatcttgactcatcgcaacctccacctcccgggttcaagcgattctcctgcctcagcctcctgagcagctgggactacaagcatgcaccaccacgcccagctaattttgtacttttagtagagatggggtatctc

SEQ ID NO: 115067 - DNA, 573 bp, Homo sapiens
aatgaggaaaacacataagtcattcttaccataattttataacatatattttggaatgctaagaaacacagcatatataaaacaaattggccagtcatggtagctcacacctgtaatcccagcactttgggaggccgaagtggacagatcacctgaggtcaggagtttgataccagcctagccaatgtggtgaaaccccgtctctactaaaaatacagaaaaaattagctgggtgtggtggcacatgcctgtagtcacagctactcgggaggctgagactggagaattgcttgaaaccaggaggtggagggcgcagtgggccaagatcatgccactgcattccagcctgggtgacagagcgagactccatctcaaaaaaataaaaaaaatagataaataaaaatacaacaaattaggaggacaatgatggaagttgtttgcagatgatatgcttttttaagaataacttaaaagattcaaccattaactaccatgatttataaatattttgaataactcactcaaatataatgtcagtccaaaaaattgtataggtcaatggtatatatttag

SEQ ID NO: 115068 - DNA, 476 bp, Homo sapiens
ttctaggggattctcagtcttggtgcaaagagatggggaaattctttgaggaattgaggggtccatggagccgtgaactgaggagagatggtggaaggggtggggagctcttgagtagtgaagaggggtgcgtgggaaactggtgacttctggaaggagttgcaggatgacgggtttgctcctgaaatccaggggactgggggacaggtggagatgtttggtgtgctaaatctttcaagtacaagatgagccatcgttgaagctcaaggttccaagtaagcatcacaggacattttctccccaaagaggagagataggatgggtgtgtgtgtgtgtgtgcgtgtgcgtgtgtgcacagaatttacagtgaaactgctttcctggagggagggccagaagccctacgagtgggagatggtcaaagtgcgatcgctgacaaagtggcaagagctctctgcacacctgcctggctgccg

SEQ ID NO: 115069 - DNA, 189 bp, Homo sapiens
ctttttcttctacacatttggtaattaatgaatggttgaacaaagttcaaaatttttgactgttttcaatctcttatttttaaaactgcagactgtcaacacataaaaaaactgatgttgacagtttctgggttacaaaaaacttatttttcccaaacagaacaagacataatgataactcagtaacaa

SEQ ID NO: 115070 - DNA, 203 bp, Homo sapiens
acacacatacacacactctctctctctctttaaaaagtatgaaaactattcttagctcacagggactttacaaaaacaagaccttgggctagatttggcccacaggcatagtcctcttggtctagatacaagtcctctctgaggtgtactgcaaatatattctcccagtttgtagcctgcctttttgtaatggcatctaccga

SEQ ID NO: 115071 - DNA, 555 bp, Homo sapiens
cacaactctgtggagacagatgagaaggtggcaaaacgaggcaggagatatccaggtgaaaggtgatggtatcttacacgtttatagacagggtcccagtgggctccacttttgagggaggaatagttctgacaccttattttctgtggaaagtaactgggcagatggtgatctcattgaagaggtaagtatggttggggtaaatcaaccaagagtttgattttggatatgtagaaatgtcaagtaggcagttgactattaccagtctggggctcagagaagaggcctgggcttgagatgtaaatttggaaaccttcagcatatcaacagtgactcaaagctgtagaagttgttaaggtcatttagggagagaatatgaaaagagccaggaccaggcttaggtggctccaacattaaagaggagggattcctaaatgtaaaattatttgagaagagatcatacattcatagactgttttaaaagtcaggtgagctaagatccaaatccggtcttagcacaaaagctgcccctagaagagggagatgtcatgtgtg

SEQ ID NO: 115072 - DNA, 5099 bp, Homo sapiens
gaattaggggaactcagaaatccatcccccaccccacggccctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcataaaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccaaagcctggctcggcggcaggggcctgggggaggggcccccgcagcctcccggggctcctggtcctctgctcccacgtcacgggcatcttcgccgcccccccagccccagccaccacctcccgcagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggatattgctccatctagctttcccgctccatctacccatcttccaatccatcatctcacgtatctgccttgcttatccaactgtc

SEQ ID NO: 115073 - DNA, 5178 bp, Homo sapiens
gaattaggggaactcagaaatccatcccccaccccacggccctacctagaagacttaggaatgtgggtccccagcgccgccatctgagactccagagtcgaggctcctagcatcccctacgtagaacactgagaaattccgactgcgggaccccagtctccgagagaccccagattctattcctggagcctgagagcccgaagttcacgcccctgagtctgggctccgcacctccctggggaccgcgtcggggtcgcgcaggagccgggctgcctcgagccggggctggaggctccccgggaggactctgctgggccgctcagccatgcctgagggagcccaaggactgagcctctccaaacctagcccaagcctcgggtgtggccgaagaggtgaagtgtgtgactgtggcaccgtgtgtgagactcggacagctcctgcagcccccaccatggcctccccccgaggttctgggagctccacatccctgagcacagtgggctctgagggggatccagcccctgggcccactccagcctgctcagcctccaggccagagccccttccagggcctcccatccgcctacatctctctccggtggggatcccaggttcagccagaccctcaaggctggagcgtgtggcccgggagatcgtggagacagaacgggcctatgtcagggacctccgcagcatcgtggaggactacctgggccctctgctggacggcggggtcctggggctgagcgtggagcaggtgggcacgctgtttgccaacattgaggacatctacgagttcagcagcgagctcctggaggacttggagaacagcagcagcgccgggggtattgccgagtgcttcgtgcagaggagcgaggattttgacatctacacattgtactgcatgaactacccgagctccctggccctgctccgggagctgtcgttgtctccgccagcagccctgtggctgcaggagcgccaggcccagcttcgccactcgctgcccctgcagagcttcctgctgaaacctgtccagcgcattctcaagtaccatctgctgctgcaggaactagggaagcactgggcggagggcccaggcactgggggtcgcgagatggtggaggaagctattgtgtccatgacagcggttgcctggtacatcaacgacatgaagcgcaagcaggagcatgcagcgcgcctccaggaagtgcagcggcggctgggtggctggaccggaccagagctcagtgcttttggggaactggtgttggagggcgcgttccgaggaggcggagggggtggcccccggctacgagggggtgagcggctgctcttcctgttctctcggatgctgctggtggccaagcgcagggggctggagtacacctacaaaggccacatcttctgctgcaacctgagcgtgagcgagagtccccgagaccctctagggttcaaggtgtctgatctgaccattcccaagcacagacacctgctccaggccaagaaccaagaagagaagaggctgtggattcactgtctccagcgcctcttctttgagaaccaccctgcctccatccctgccaaggcaaagcaagttctccttgaaaacagcctgcattgtgcccccaaaagtaagcctgtcctagagcccctgacacccccacttgggtctcctcgacctcgagatgctagaagttttacccctgggcgaaggaacacagctccatctcctgggccctctgtgattcgccgaggccgcaggcagtctgagccggtgaaggacccttatgtcatgttcccacagaacgctaagcctggattcaagcacgctggcagcgaaggggaactctaccctccagaatctcagccaccagtttcaggctctgcaccccctgaggacctggaggatgctggacccccaacactggacccctctgggacctcaatcactgaagaaatcctggaactgctgaatcagcgaggccttcgagatccagggccgtccacccatgacattcccaagttccccggagactcccaggtgcctggcgacagcgaaaccctcacattccaagccctgcccagccgggactcttcagaagaggaggaggaggaagaggaagggctggagatggatgaacgggggccttccccactccacgtcctggaagggctcgaaagttccattgcagctgaaatgcccagcattccctgccttaccaaaattcctgacgtgcccaaccttcctgaaattcccagccgctgtgaaattcccgaaggttctcgccttcctagtctctctgacatttccgatgtttttgagatgccctgccttccagccatacctagtgtccccaacacccccagtctgtctagcactcccaccctctcctgtgactcctggctccaagggcctctgcaggaaccagctgaggctccagccaccaggagagaactgttttctgggagcaatcctgggaaactgggagagccgccttcaggaggcaaggcagggccagaggaggatgaagaaggggtatcattcacagacttccagccccaggatgtcacccaacatcagggattcccagatgagctggcattccgctcttgctcagaaatccggagcgcctggcaggcattggaacagggacagctggcccggccaggcttcccagagccactgctgatcctggaggattcggatctgggtggagacagcgggagcgggaaggcaggagccccgagttcagaaaggacggcgtcccgagtgcgagagctggcccggctttacagcgagcggatccagcagatgcagcgggcggagactcgggcatcagccaatgccccgcgccgccggcctcgggttctggcccaaccccagccatccccctgtctgccccaggagcaggcagagccaggtgaggtccgggtatgtggttggcagaggtggtccccgctggagtagtggtcctgactcgatcctcttttcgcattcagggctcctgcctgcctttggacacgtgctggtatgtgagctggccttcccactgacatgtgcccaggagtctgtccccctgggtcctgctgtctgggttcaagctgccatacctttgtcaaagcagggaggcagcccggatggccagggtctacatgtttccaatttgcctaagcaagaccttccgggcatccacgtttcagctgctacccttttgcctgagcaaggaggttcccggcatgtccaggctccagccgccacacctttgcccaagcaagaaggccccctgcacctccaggtgccggctcttacaactttctctgatcaaggccacccagaaatccaagttccagccaccactcctttgcctgagcataaaagtcacatggttataccagctccatccaccgccttttgtcctgagcagggacactgtgcggacatccacgttcccaccactccagctttgcccaaggagatttgttctgatttcacagtttcagtcaccacccctgtgcccaagcaagaaggtcacctagacagcgagagcccaaccaatatcccactgacaaagcaaggaggttccagggatgttcagggcccagaccctgtctgcagtcaacccatccagcctttgtcttggcatggaagcagcctggatccccagggcccaggcgacaccctaccacccttgccatgtcacctcccagaccttcagattccaggtacctcacctttgcctgcacatggaagccacctggaccatcggatcccagccaacgccccactgtctttgtcccaggagctcccagacactcaggttccagctaccacacctttgcccctgccacaagtcctcacagacatctgggtccaagccctcccaacttcacccaagcagggaagcctcccagacatccagggtccagcggctgcacctccacttccggagccaagccttacagatacacaggtccaaaaactcacaccttcgttggagcagaagagcctcatagatgcccatgttccagctgccacacctttacctgagagaggaggctctctagacattcagggcctctcacccaccccagttcagaccaccatggttttgtccaaaccaggaggctccttagcctctcacgttgccaggttggagtcttcagacttgacgccacctcatagtcccccaccttccagccgtcagctcctgggccccaatgcagctgccctctccagatacctggcagcctcatatatcagccaaagcctggctcggcggcaggggcctgggggaggggcccccgcagcctcccggggctcctggtcctctgctcccacgtcacgggcatcttcgccgcccccccagccccagccaccacctcccgcagccaggcggctcagctatgccacgacggttaacatccacgtgggcgggggtgggcggctgcggccagccaaggcccaggtccggttgaaccaccctgctctcttggcctccacacaggaatctatgggccttcacagggcccagggggctcctgatgcccccttccacatgtgagccaggacatgaggcttccctgaagcaaggatttcagccagatgccatagaccctcagaacttgacctggaagtccagacactgaacgcaggcctcaaaactgctgcggccttccaactcctggtatctgcatcggcgaatggcccttcttgccttgatccacagggatggggaagggaatgtcattaatgttttgttaatactgattctttcatgcaatgatgtgtattttcccattctggaggctgtgggagatgacaagacaatgaatgggaaggtctgacacagaacaaatcagcggttctgaaagcttggggaatctcagactcctttgagaattattggaaaatggacccactataacttggcgtgtgtgtgaactgcttgatgcccatccaggaaagccaagttaagaagctttgcttcaagtagacactagaaatccattcccttggcaatttatacagttcacgtctcccaccatccgttcatctcacccaccctgccatctctccacctatccatctggatattgctccatctagctttcccgctccatctacccatcttccaatccatcatctcacgtatctgccttgcttatccaactgtc

SEQ ID NO: 115074 - DNA, 284 bp, Homo sapiens
tgttaaatccaactctgagacactgaatttctggttccttctttttcttactggctgttccattctttgcagatatggatgcaggtaactattcattttcttcatggcagcgcttgtcttgttttggagagagaggaaaggcaccactttgtactgtagcgttcccttccctccttgttctgtgtaccatcctgttttgtttcattttatctttttcttcagttgaacattccaccctgttttgtcccttagttgtctttttagcagtagtcccaagcagcttc

SEQ ID NO: 115075 - DNA, 421 bp, Homo sapiens
gctgggccgcactggcgcactctttatttcttctttttagggtgactcttttcttgtattttcctttctgattcttctttctctgaccagctcttagagtcctgtcttcattctacatgtctttgtcctctctgtgtatggtttcacttacacttaagacttaattataacatataaaatgactgtcaaatctattttcaacccctaacctctttcttgagaactctagaaacaaattttcagctagatactgaactctctacaggcatcagaaatgcaacttatcccaaattaaactcatttctccagaggaaggagagatatatttcacttcaatatccttcagtccttcatttaatgacacctccatctatccagtcactcaagtcagaaaaacataatgctccacaaggcatcttta

SEQ ID NO: 115076 - DNA, 287 bp, Homo sapiens
gtactctaaggatcctcatgcctcatccagtggggcagacaccggccacacggatggctctgtcctgtccagctggcctttcctgttcaggctgtgagtgtgtcagtgactctgggtcccaggcaggggtctgctgcagaggggagcagcacccagggatgcgagacctcaaatcccagggcaggtggcggcctgccaggagccggagcccgggaagccagacagcaggggtaggaacctcatgtcactgagcacctgcctcattccagccacttggcctccatacc

SEQ ID NO: 115077 - DNA, 383 bp, Homo sapiens
ttctctggaacatgagaataaaaactgtacctctccctagatgctgcggtaaggagttcatgagtgaatgcatgaaaagtgcataggaagcactcactacatatttattcttcttcttcttctctataaagcaaaaagaaataaaaggagaatacaaaacagcacgtacatattgcttagagcagtgctttcagatatgaatcatttctagaatggattatagaaggatgggagcttttagtatttagtagtttcctttcttctccctaagtttacaatccattttaaaaaatgaatgaattaagtatctccgaaacaaactggcaattgctctgaagacaagtttagcaatttccgtgaaataattctctggcttcggccaa

SEQ ID NO: 115078 - DNA, 394 bp, Homo sapiens
tattttattttgaaaataatttaaaaacaaagaagagtaactattttactaataaaagaatatttaaagtattaaaggactctaaattctctttactctcttttgaaattgcctttttttaaaatttaaaaacagcacatattcattataaaaatgtagaaaacacaggaagggacaatgatgaaaataagcatcacctttaattatactaattgttaggattttgttgtatagatttctgatattcttcttagaatattaacaaatatgtatcttttaaacagtgactatactccattttgataactatttaaaaaatttaatattatgaggagtattttctacatgtcattaaatattttcctataatgatattaaatgtattcctgctgtt

SEQ ID NO: 115079 - DNA, 494 bp, Homo sapiens
tggcacaatcagagctcactgcagccactaactcctgggctcatgtaatcctcctaccttagtcttccaagtagctgggattataggtaggtagaagccactgcacccagctccagaaatgtttctttttaaagtacagactctgcattgaattgtaaattttctttcaatagtataatgcacactgtacagaggcttttgggacacaggtttttaaaaccaccaaggagagttagcaaatataaatgacaattatgtacttaagtaacagaaacttaatttcatatatatatattatttatgatatatattaaataacctgggcttctgaagtatacacattggataaaggaatataatggaaaaatattgacccaggaattaggagacatgagttctcatgcacaaactcattgtgcaaccttgggtaaattagttaacctttatggactttcacactgtcctctgcaaaatgaggctattggagctgataa

SEQ ID NO: 115080 - DNA, 638 bp, Homo sapiens
taaaagtctatactttctcgagaatatgtataatgaggcacaatactcttcactgtctgtattgtactctacttatcaagcctagaaatgggctaaatgttaaatatgtatgtttcaggttatacagaactcaataatgtcagttaatcgagaaatttccttactttgtccttttaattcattgaaataaaactcatgctttgcttatctggaggttttaaaagttagattgtgcaaaactcattgtcttagtctattcctgttgctattgcaaaatacttgagactgggtgatatataataacagaaacctacttctcacagtttttgaggctgggaagtccaagattaaggttctgacagatttggtgtctggtgaggacttgctctctgcttccaagaccatgtctgttgctgcttcttctggaggtgacagatgctatgttctcacgtggtagaagagagaagaggtgcaaggaccaagcagctctctgaagcctgttttataaggatatttatcccattcacgaatgcagatcccccatggcctaatcacctcctgaagtccctacctcttaataccatcaccttggggtttacattccaacatgtgaaccttggaggggacgcatatattta

SEQ ID NO: 115081 - DNA, 480 bp, Homo sapiens
cggacctaacagggaagatgcagagggagcaggtatctgcatgtgaaggcgcaaccttgttggtgttgatggagttggtgtttgtcttgcaggcactggaaagccgttgacggatttagtgagtgccactggtgacaagctcttattaagacatccgagctgaggtgcaaaagatgggttggagttggcaaggcccaaagtgaggctaaaaagagagttgaggggagtgttccacacagaggaaggaacgtgtacgaaaacttggaggcaagagcggcatggcacttttgaggaactgcgagaagtagagtgtggccagggataatgctctggtcgggagatgtgtccattgaggctgcagaggaagcaggtatctgcatgtgaaggcggcaaaccttgttggtgttgatggagttggtgtttgtcttgcaggcactggaaagccattgacggatttagtgagtgccactggtgacaagc

SEQ ID NO: 115082 - DNA, 326 bp, Homo sapiens
  misc_feature (308)..(308): n is a, c, g, or t
ctaaaatagaagttcaatagcatttttcaaaataccagttgagacaacagatttggagttaagtttatgaaatatttactgagaaaaactacatcacacaaacacaaggtggcaagactttggtaaagaaggtacaagacttttaaaagacttttgtaagtatttaacattgccacaataactatgtactggttcctttataaacgtaaacaccactgattgtacatacaaaaaaaagagagaaaaaatcaaatatacttgtacacaaatgtttaaattattatgtccttctaccagtgtgtgctatngaaacttctaaaactagg

SEQ ID NO: 115083 - DNA, 285 bp, Homo sapiens
ttaatatgtaatgggtttattgttatttctaaatgatttagtaaatatttttaatgtttcagattgtgatttcaaatatagtaaatattgatagacataacccgcataaacagaagctctctgttgtccttgataagctctaagactgtgaagagttcccaagaccaaaaggtctgagaatctctgggctaggtcctgcttgataacaaaccacctcaaaaatccccctggcttaagcaacagtttatttcttgctcatgctacatattcagtgaaggtcagcat

SEQ ID NO: 115084 - DNA, 238 bp, Homo sapiens
aagaatgtcttcagctcccctgccccaggccccccggccacttcagtcagagccattccaggtggtctctgtctgattgggatgcgcaccctctgcccgtttaagaggctcagtcagttgcctccaaacatttgcagcagtcctgccagaaatcccctctggctcccggctagagtagaaatggaagaatttggagtcatgtaaacttggattccaatacagattttgcccaatttta

SEQ ID NO: 115085 - DNA, 756 bp, Homo sapiens
gagacggagatttactcttgttgcccaggctggagtgcaatggtacgatctcagctcacagcatcctccgcctcccaggttcaagtgattctcctgcctcagcctcccaagtagctgggattacaggcatgtgccactgcgcccggctaattttgtatttttagtagaggtggggtttcaccgtgttgcccaggctgatctccaactcctgacctcaggtgatccgcctgcctctgcctcccaaagtcctgggattacaagtgtgagccactgcgcctggcctaagcataactttttagacaaaaataaaaaaatctagtaatattttactacttggtgctgttaaagttggtgtctgaagccctgcaatcatttattcactttcagtacatcctttgttccttttgaaaaggtgtaagtcagtgcacttagaatcaggaaacttaatttttagattttgtttgcctgctataaatgacagcaaactcaaaaaccaaacctcttaacagtagtgagccagttttgtttcaacatgacttcagtatcccagccctattaaaaaatgcaaaatgcatacacacaccgcaaacagcatagacagacattatttaaacgttttttaaaatgtgagtaatgaagatgtcctccaagctccagaatgcttgtgaaagatccctgagcacggccccactaaggcatctctacaaaggcacaaagctgtagagacatttgggcattttactgactacatccaag

SEQ ID NO: 115086 - DNA, 472 bp, Homo sapiens
caggtttccaagattcttcatatgctgcctaatttttcaaaaatttgaaaaagagaagaaacatttctgtaaaaaatagttctttcacgtaaaaagagtagaagaaaaatgtcagagataaggggagggaaagaatgaaaagtctgtgagcaagatgtctgtctcgtatgtttgtgagtcagaggaagaattgggaaaaaaaaaaacctatggggagagagaaggaaacagattgggagactaatttaaagcagaatcaactaaaaggaagttgaagatttgaaaaaataagacagcagcatcaagaagagaaagtctgttgaaaagagaagcaataagaaaaacttgtagcaattcatgtatatgacaaattcaacccacgtttaaataaaaatgcaaagatttcaaaaacaccaaagaaggatttaatgaaaggttctcatcacccacaaataataaagattttttccct

SEQ ID NO: 115087 - DNA, 602 bp, Homo sapiens
atttcagttatttaccaggctgtatttattggtctccccctgccccactccaagtaaaaaatcagttcaagacaagacagaaccattttggccattttacagcaccctctcccctcaacagtcagcacagaagaaattatagctgtggccaggtgaggtggctcatgcctgtaatcccagcactcagagaggctgaggcaggaggatggcttgagcccaggagcttgaggccagcctgggcaacacagactgtcgtctgtattattttttaaataataaatatacatttttttaaaaaaagaaattatagctcacagtagtaaaaaaaaaaaaaaaaagaccattattcctcacccttaatacaaccagtcattaaatttagataagctatcatatttgaagagtgactgggaagaggtgggccctggaaaactttactacaacctgcttgaattgaccaacctttcatgcagctttacagtgaacactcagctcctttttcccattatacttccaaatatgaggaaaggggggtgggggcatggaggtcaatactcaggccttactcagccagctaacaggacactattaacacaaaggga

SEQ ID NO: 115088 - DNA, 360 bp, Homo sapiens
ccagggttgcaggtcaagggtgtgcagagctggatttaggccagactctgagctcctgatgcctgtggtgttggacatactgcttgtgcctttgcagtttggtgtgtataggagggtgttacacgggagctcctaccccatccgagccagagccaggtctcccctctgttgggtctcagtccccctgttacagaggagctcacctccaggatgctctgcttggcctctgcctctgggagcctgggagtggattctggagtggattccaggacctcttcatctgcacctgccccaggctttggagctggtgccttaatcctgatccaagccagtctatactctgtcttctagaattcttca

SEQ ID NO: 115089 - DNA, 345 bp, Homo sapiens
ttctcggcactctctgcaagtctgcgcctagacgcttcccacgggagaaaagaccaccaagtcgggcactgaccatgcccgaggtcacagagccaggccggccagctcacactcccaatcctggtgagggaggccgggcgagatctcagaggcaagaacaggtcactccagcagcccagagctgcgtcctctgacacctcctgctctgccagaggctatcctggctccagcccctccccacggcagggccaaccattaacccctggagtttggagaaagttgtgtgggaggaagtgctgtctgtcctggaacttggcagtgagtgtggtttcgccagcgtcattt

SEQ ID NO: 115090 - DNA, 176 bp, Homo sapiens
ctgcgccctctctgatcactgaattcttgatttctctgccagttcttctcctagcagtaaccaaccagcccagtcaccccaggcctcactgcctgctcagccaccaacatcctcccacatgtgcaacctggttcaaatgaacaagcacagcctgggagaggaaaggatgccacaaa

SEQ ID NO: 115091 - DNA, 207 bp, Homo sapiens
tgtcaacccatgaggccatcaaagcccttagagccaaagtggcttccatgactaacttattcttcctgcttccagttttcactaagatcttgacaggccgacttctctcctccctcttccaactctttcatgccttcaagaagatgtttaagaacatattttattcaggacgcttacttattttcagtgcagagctgacctgaataa

SEQ ID NO: 115092 - DNA, 339 bp, Homo sapiens
tgaaagtataagattggataaaattaaaagctaataattttacagtatttatgaacataattacttattagaagttgattgacatgtaggcggttttcaaattacattaataaagttcagggaatacattaataggcttgtcagtcaattcaagtactaaataaatgtcataaaaagtcaaccccacttaagctacatttcttctcaatgaacaaaagtaaactgatgtgtacacctcttcagtccctaaatttgtgagattgtctgatgctcaggggtatcagcatagttttgaagcatatgctctttgcctaacaatctgacaatcctttattcacc

SEQ ID NO: 115093 - DNA, 346 bp, Homo sapiens
agctttcttaaagcaacatacacctgtcctaagctgccctgtggaaaagggaaacccatatatattttagatggagtagggtttttaacacccttctagcctgaaatgccctctgaaggctaatgtaagctaaagaatcttctggctatagggttgaacagagagtcctacttcacatgcaattggtacagaaaatccagtattctttcttctatcaaagtagagtttgtaagccagggacacaaatttgtgatttccttatgctgtagcagataatccttaaaagaataaacactgaatgaatgaatgaatgaataaatggaaaatagaactgtttaagtgatct

SEQ ID NO: 115094 - DNA, 372 bp, Homo sapiens
ccaagctggaccagtgattggatcctcggtgtggtctggatttctgagtccaccccttacccaggagtctgaatactgttcattcatttatttcatcccatatacctggaagtgaagcctggaacgcaaataacatgcaaatttgtggctctttggcactttaaaaaaccaaacctgtctgtggaggctgccaaagaactttcctgaggccaaacacaccaatcaggacttccaacccaccctgctaactgtggccttctgttcttgctcctctcctgcacccctttcttctcacaatataacttcgaagtgaagtgcttgccacttttctacctgtaaaactcacactcatgacagtaaaacataagaaag

SEQ ID NO: 115095 - DNA, 336 bp, Homo sapiens
ctaaagttgtgtttttttaactgcctgctttttattgcaggtatatgaaattgttgtgcatatttcaaagaagaatagaatgcagggtaactctcaaacttgttatttggaattaggtcagataattttgtaaatactgttatcagtatatcacaatgtcattagtgtcccttcaagttaagggcatggaaataaagatggtctaatgtgccaggccaaagaggaaaacttttcagcttagcaaagtgacttcaaatacatggggagaattgaagcagtcatttcaaatgcaaacaaaaagttgtatttttatggattacaatatccttagctaaa

SEQ ID NO: 115096 - DNA, 608 bp, Homo sapiens
agtcgactctgtaggatccccaagcagttaatacagactcacacacacacaatttattattacccatccttggtgcttggcccagctgcagcacttattggggttattaacaaagacaaggcctagattttaacctgatatcaacctgaaagctgggtcaagatctcagagaaagagagaaaattgagcgggaaggagaatgcctctttttcttgtggaaagtccttgaggagttgcaattaaagacctagtgtacttgaaagtatctcttccaatctgaaaataaattgaacttcctgaactgcttttggaaaaccaaagcctggaagattttttgactttcatccttcctgcgtcagcttttggaagagaaacagggaacaatgaacaattaaaagaaacccactgcattaacaatcagtagatttgggggtcggggagacagaaaggctaatgattctaactttttaattgtgtgaagcctaaagaattatggaattacctagaacttaagcttttcatcttttttcatttgatctctagccaagtaactactgtagaataatttaatattctctgagtcgtcaataataaggcttgcaatgtga

SEQ ID NO: 115097 - DNA, 382 bp, Homo sapiens
ctgcacagaaaggggtggattattatcagagggctttggtacaaatctcacctatatgcctttaggtaagtcactgagacttgttctctgtgtgttaggaaagttctctaacacttgctttcttccttagaaaaacagaaatgctagtgggctctaaggaggttcaacatctcaatggatgcccatcatagacccatcagcagttgttaatttgcaggaataactttatggtaccagattaggatgaaaaccctgcaatttcatgcccagtcacttaccttgagccccctccctgagcagagaagctgtaggctgtgtgagggtctccagtcctctctgtgcatctctgagccattgtgtaaccaccccaatgctgacaggg

SEQ ID NO: 115098 - DNA, 466 bp, Homo sapiens
tctggctactggacttctcctggccttctttaaggagaacgggacaaaactgctactcttaagacaaatattccttggttcaaatgcaataccaacagttcccatcctgtggaccaaggagaccaggaatccatttgtgcatcaagctctgcctgtagaatgaataatgtctctaaatatatcaaccatttactactactaaattgacaagtactaaattcgtaactgtttttaattatatactttccaattcagataataaaagtgcagaaatatggtatatgtactaatagcaggcgggggaaagggacttacataatggaacattttttatactgtcatgtttaatatttgtgaagcattactaaacactgtacaagaattatatttatattgaagtcaattcctcaaaattgtagctacactacaaatttccccaaccacctactaaacaatcatagagaac

SEQ ID NO: 115099 - DNA, 279 bp, Homo sapiens
catccccaaccccaacccgaactccaaccccattctctacagaacctttcttaatgtctctactggtcttttgtgctatgactggtccctgtgctatgacttcatctagttcttggcctcctcaaggccttggggtgtttgatactttgtggctctttgtctgaaccctttctcccttggtctgaatgatgttgacctctccttgtcctcataccacaatgactgttttcttctttgttgtatccttccctggctaagctcccataaatcatgcttgga

SEQ ID NO: 115100 - DNA, 337 bp, Homo sapiens
aaaaaaaaatatatatatatatatatatgtataaacacaccctacagtatgaatttgtgaaggaagaccatctgatttatgtgtataaaacattaggtctgttctaaaactggtagttctttcttttaatcactccctcctattatgctatatgagaggcttatcatgttcatgttttatgttccatattacacaaggccatttgggattctttgtctttggaaaaattgataaagagtattttattaaaatattcagttgtcactttgggaggccaaggtgggaggctctcttgagcccaggagttcgagaccagcttgggcaacatagtgagacc

SEQ ID NO: 115101 - DNA, 243 bp, Homo sapiens
tgtgctgctggtcgctctagagatccccctggcagctgggtgcaggtctggctggctgggtcgggctgcgtaattcagtaatcatgaatccatggacggtgctcacaggaacaggaaggctgaacacagggtttttctttcatttctcagaggattgctctgtgcaaaaggaagaatgggaaactcagagtacacgtgttagttttgtttttttgttcacgacagggtctcactctgtcaccc

SEQ ID NO: 115102 - DNA, 122 bp, Homo sapiens
aagttatggactgcatgttcacgtccccccaaaattcacaggaaatcttactatccaatgcgatgatatttggagacgggacctttgggaggtcgttgggttcaggtgaggtcatgagggtg

SEQ ID NO: 115103 - DNA, 1064 bp, Homo sapiens
acccgcaggtgagctgcagaggcgcgcgtggtccctgccccacccgcgcggagccagagaggaggcggttgtcaaggcgacgtggaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccgtcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacaggggtggcctacacttcagaatgcttcccctgcaaacctggcacgtatgcagacaagcagggctcctctttctgcaaactttgcccagccaactcttattcaaataaaggagaaacttcttgcca

SEQ ID NO: 115104 - DNA, 431 bp, Homo sapiens
tcggatgcaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatcttgggtggcctacacttcagaatgcttcccctgcaaacctggcacgtatgcagacaagcagggctcctctttctgcaaactttgcccagccaactcttattcaaataaaggagaaacttcttgcca

SEQ ID NO: 115105 - DNA, 1202 bp, Homo sapiens
acccgcaggtgagctgcagaggcgcgcgtggtccctgccccacccgcgcggagccagagaggaggcggttgtcaaggcgacgtgggtaggaggagaggacagagggaggaggaaggatgggcggtgttggcgtagccgcagggaggtgactgaagcgagcctggcctcttgcatcctccgcctgtgtacctccctcccctttttttccgccttctgccagcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccgtcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacaggggtggcctacacttcagaatgcttcccctgcaaacctggcacgtatgcagacaagcagggctcctctttctgcaaactttgcccagccaactcttattcaaataaaggagaaacttcttgcca

SEQ ID NO: 115106 - DNA, 375 bp, Homo sapiens
aattgttatttgattttttctgtggttttctggctaactttgatgctctttacaagcaagaaataaagataaaagtggagttataacttttagggtgaatgttaaaggcatgccaccaacaaacatacagagcccctaggcaaagactgggagacttactggttccaggcatctctaaggaagtttatttccaaacaatggctggcctctaagataactaagcagagacttcaggtggccatacacaacaaataatatggactttacagaattagttcagaaaggttatcaaacaaaaaataaatattgacgaggggagataatctggtttccagaattttcacattatgttattttaaatgtccagtttgcaac

SEQ ID NO: 115107 - DNA, 762 bp, Homo sapiens
agacatggtggtgagtgcctgtagtcccagctacttagggggctgaggtgaaaggatcactcgagcccaggaggttgaggctgcagtgagccaagatcacaccactgactccagcctgggtgacaaagtgagaccttgtctcaaaaaaaaaaaaaaatcttttcttttttaattaactaagttagtaaataagaccaagtaatatccaaagacctcttaaaacagattcctgagtatcctagatgtataagaaaaatgagatctataacctaaactttaatgactaatgaaagaatacacatttaggatttgtacatttaatatgttgaaaatcaaaacataaagccaaaatgaacatctgcatagttcctctgtacctacaagctaccctcaaggataccaaaaacctcgttttaacaaatccatgccatcccttgtccatttctggctgccaatgtattgaatgctttttaaggtccaactacaatgcaccaagttaaaatgtttttttaattcctacctttctgtaattcagatcacatgttacactgccctgctctaaaccaccattttacttgatttaaaactattatgtgaactctaagtgctttgcttgagttgtcatggtttgtgaaatgtgttaagtcatggtagttaagcggcagagctctgagctctggagcagactgcttgcgtgcaaatcagagctctgctgctgtgcttaactctccatgcctctttgctcatctgtaaaagggggta

SEQ ID NO: 115108 - DNA, 1194 bp, Homo sapiens
gccgtggtggctggttccctgtctcttcagtagagagtctagaccccacccagtcttcatgtacggccgaccgcaggctgagatggaacaggaggctggggagctgagccggtggcaggcggcgcaccaggctgcccaggataacgagaactcagcgcccatcttgaacatgtcttcatcttctggaagctctggagtgcacacctcttggaaccaaggcctaccaaccattcagcactttcctcacagcgcagagatgctggggtcccctttggtgtctgttgaggcgccggggcagaatgtgaatgaaggggggccacagttcagtatgccactgcctgagcgtggtatgagctactgcccccaagcgactctcactccttcccggatgatttactgtcagagaatgtctccccctcagcaagagatgacgattttcagtgggccccaactaatgcccgtaggagagcccaatattccaagggtagccaggcccttcggtgggaatctaaggatgccccccaatgggctgccagtctcggcttccactggaatcccaataatgtcccacactgggaaccctccagtgccttaccctggcctctcgacagtaccttctgacgaaacattgttgggcccgactgtgccttccactgaggcccaggcagtgctcccctccatggctcagatgttgcccccgcaagatgcccatgaccttgggatgcccccagctgagtcccagtcattgctggttttaggatctcaggactctcttgtcagtcagccagactctcaagaaggcccatttctaccagagcagcccggacctgctccacagacagtagagaagaactccaggcctcaggaagggactggtagaaggggctcctcagaggcaaggccttactgctgcaactacgagaactgcggaaaagcttataccaaacgctcccacctcgtgagccaccagcgcaagcacacaggtgagaggccatattcttgcaactgggaaagttgttcatggtctttcttccgttctgatgagcttagacgacatatgcgggtacacaccagatatcgaccatataaatgtgatcagtgcagccgggagttcatgaggtctgaccatctcaagcaacaccagaagactcatcggccgggaccctcagacccacaggccaacaacaacaatgg

SEQ ID NO: 115109 - DNA, 721 bp, Homo sapiens
gccgtggtggctggttccctgtctcttcagtagagagtctagaccccacccagtcttcatgtacggccgaccgcaggctgagatggaacaggaggctggggagctgagccggtggcaggcggcgcaccaggctgcccaggataacgagaactcagcgcccatcttgaacatgtcttcatcttctggaagctctggagtgcacacctcttggaaccaaggcctaccaaccattcagcactttcctcacagcgcagagatgctggggtcccctttggtgtctgttgaggcgccggggcagaatgtgaatgaaggggggccacagttcagtatgccactgcctgagcgtgcccggacctgctccacagacagtagagaagaactccaggcctcaggaagggactggtagaaggggctcctcagaggcaaggccttactgctgcaactacgagaactgcggaaaagcttataccaaacgctcccacctcgtgagccaccagcgcaagcacacaggtgagaggccatattcttgcaactgggaaagttgttcatggtctttcttccgttctgatgagcttagacgacatatgcgggtacacaccagatatcgaccatataaatgtgatcagtgcagccgggagttcatgaggtctgaccatctcaagcaacaccagaagactcatcggccgggaccctcagacccacaggccaacaacaacaatgg

SEQ ID NO: 115110 - DNA, 595 bp, Homo sapiens
taagcagcctgaagtaatctgtgaaaatggttcgctattcacttgacccggagaaccccatgaaatcatgcaaatcaagaggttccaatcttcgtgttcactttaaggacactcgtgaaactgctcaggccatcaagggtatgcatatacgaaaagccacgaagtatcttaaagatgtcactttacagaaacagtgcataccattccgacgttacaatggtggagttggcaagtgtgcgcaggccaagcagtggggctggacacaaggtcggtggcccaaaaagagtgctgaatttttgctgcacatgtttaaaaacgcagagggtaatactgaacttaagggtttagatgtagattctctggtcattgagtatatccaagtgaacaaagcacctaagatgctccgccggacctacagagctcatggtcggattaactcatacatgagctctccctggcacattgagatgatccttactgaaaaggaacagattgttcctaaaccagaaaaggaggttgcccagaagaaaaagatatcccagaagaaactgaagaaacaaaaacttatggcccggaagtaaattcagcattaaaa

SEQ ID NO: 115111 - DNA, 453 bp, Homo sapiens
gccctggttaaggctgttcactaactatgcagtaacactttgcctacagtggggagcctggacatcattggaggacatcataaatcatgctggctgtacgcacttcagatcatgccagacaatcatactacatactcttcctgccgaattccctctccccctctctgagatgactattccacagcgcttcctgccctcaaaccttccactcactcccacactgttgcacacttcacagagacagatgaggcagtgactcatcttcccaccagtgtttaccaacttctctgtatctgtgcccatgtcctctgcccccttccggtctcagtggaagcagcgtgcccttccccttgtccccgtcaacaccgccacttgtttcctagatcacatctctctttacctactcgaaagcttccttcccgcagttactccctttctcttctgcagcctcca

SEQ ID NO: 115112 - DNA, 713 bp, Homo sapiens
acaaaacagctggaggcagaacagcactcagctggagcattggtggttcagtggtagaattctcgcctgccacgcgggaggcccgggttcgattcccggccaatgcagcagctgaaagctttttggcagctcctggaaaaagaaaacttggagaaataagttaacttggagggataagctagtgcgggccttcaaagggaggagctttttttactgggagaaactagaagactcggggatacatattttgtgacctctcactgaaatatgagtgtttgatttttgttttctaattctaattttagaaaatttggaaagtagagaaaaatgcaaagaaacaagactatccccaagaggcaatgaatgttcaaattttgatgtattttttccagtttttaatatatatacgtagttaagatcatagaacttaacacagcttcaccttctgctctgtttgtttgaagttcacagtgcctcttaatccatagtcagaaaatagagtaacagttgcctgggtttgaagaaaaggagaattgggactgactgcttacagatgcccggtttctttttggggttatggagatgttctagaattaaatagaggtgatgggtgcacaactttgtgaatgtactaaaaactacctagttgaacactttgaaaatggtgaaatttttgttatgtgaaatgttatatgaattatatctcaatttaa

SEQ ID NO: 115113 - DNA, 1503 bp, Homo sapiens
  misc_feature (620)..(620): n is a, c, g, or t
  misc_feature (1087)..(1087): n is a, c, g, or t
  misc_feature (1231)..(1231): n is a, c, g, or t
  misc_feature (1254)..(1254): n is a, c, g, or t
gtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcagagagcagctctaaattgggaagcaatgccggaaacaagtctcttaaaatcaacttggattaacctttcagttacatctgagtgaactgcagctatttcaagctgaaaggaatatttctggatgtaaacatgtcgaaaaacctatcaacaacaattccttagtttcaccacttcaaaaaatttattctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagccttgctaacnatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcaccttgcaaatcatcacagaatccacactggagagaaaccttacaaatgtaatgagtgtggcaaggtcttcaacagaaatgcacaccttgcacgacatcagaaaattcatagtggagagaaaccttacaaatgtaaggaatgtggcaaagcattttcagggggttcaggccttactgctcatcttgtaattcacactggagagaaactttacaaatgtaataaatgnggcaaggtcttcaatcgaaatgcacaccttaccagacatcaaagaatccatactggagagaaaccttatgaatgtaaagaatgtggcaaggtcttcaggcacaagttttgtctaaccaatcatcatagaatgcacacgggagancaaccttacaaatgtaatgaatntgggaggccgaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagttcggcctgggcgacagagcgagactccgtctc

SEQ ID NO: 115114 - DNA, 1561 bp, Homo sapiens
  misc_feature (148)..(148): n is a, c, g, or t
  misc_feature (678)..(678): n is a, c, g, or t
  misc_feature (1145)..(1145): n is a, c, g, or t
  misc_feature (1289)..(1289): n is a, c, g, or t
  misc_feature (1312)..(1312): n is a, c, g, or t
tgggcctcgaatagagtaaggtgatacagtgggtcgatgagcatgatttgcctagtgcaggagtccatggtgtccactgacctagatgcctctgcgatgtcagtcagcgagataatgataacgcccgcgtgggtcaagcaggagacgnttcatgaagcgaaatccgagtagtgggagttcatgtaggtcgattactggtatctatcgaagaggtagtccatgcggagctcgatattaatttacgcgtcggactgaaggagagatccccggaatctgcagagtgaagtgaaaatagcaaacaatccaggtggcagggagtgcatcaaaggtgtgaacgcagagagcagctctaaattgggaagcaatgccggaaacaagtctcttaaaatcaacttggattaacctttcagttacatctgagtgaactgcagctatttcaagctgaaaggaatatttctggatgtaaacatgtcgaaaaacctatcaacaacaattccttagtttcaccacttcaaaaaatttattctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagccttgctaacnatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcaccttgcaaatcatcacagaatccacactggagagaaaccttacaaatgtaatgagtgtggcaaggtcttcaacagaaatgcacaccttgcacgacatcagaaaattcatagtggagagaaaccttacaaatgtaaggaatgtggcaaagcattttcagggggttcaggccttactgctcatcttgtaattcacactggagagaaactttacaaatgtaataaatgnggcaaggtcttcaatcgaaatgcacaccttaccagacatcaaagaatccatactggagagaaaccttatgaatgtaaagaatgtggcaaggtcttcaggcacaagttttgtctaaccaatcatcatagaatgcacacgggagancaaccttacaaatgtaatgaatntgggaggccgaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagttcggcctgggcgacagagcgagactccgtctc

SEQ ID NO: 115115 - DNA, 433 bp, Homo sapiens
agtagagatggggtttcaccatgttagctaggatggtctccaactcctgagctccagtgatctgcccgcctcagcctcccaaaagtgctgggattacaggcgtgagccaccacacctggcccatactctgcatttctaacaagctaacaagatggtgccaatgctgctgatccacagaccacactaagtagcaagagtctagagctgtgctgcccaaattggtagccaccagccacatgtggctatttaaattaatgaaaattaagtagcgttataaattacttcttcagtttccctagccacccttcaaatgctcaagagtcatgtgtggctagctaccctaccgaatagcacatcatcacagaaaagtccgctgcatggcagtggtatagagaattgacccatagtaactctcctacagctgatttttaga

SEQ ID NO: 115116 - DNA, 433 bp, Homo sapiens
agtcgaattaatttttctgaatttcagcttcttcatctgtaaactgaagaaaatacttgcatggattagtagaggagagtttatgagactatgcaggtgaaggtctccagtaagggacagctattagtaccacagttatttagatcatctttcccactagtccattaacagtatcttgccgcatcttaccctccttagtgttttctgaattgaatggaagcagcccaaattgacagcatctgctgcctggctcttactgagctattagtttttcaacatctgttttgaatttcagaaagaaatttccatttttaggcaacagaagcattttcctgttgtatttcaatatgtctcaatcctgaaatgattagaacttctgcttgattgaatccaagtcagcaaagccatggagaacagcccagcccacgaatat

SEQ ID NO: 115117 - DNA, 734 bp, Homo sapiens
caaaagcagcacctgcttctctaaaactaagatggatcacttgcattcacttaacctactaaaattaaagttgtgtccaagtagcaattatgagacattactctagtgatagtcaatctttttttgaatttctgtttacctcatattttctgtgaccaagagttgtttcttaaatatgtctaattttcagttctacatttgaaaatcaatatgattatttatgttctttatcttcataatttaaaagaggcttgtgttagtgttatttgtttctttctctaccacagctaataatttttctgccgcagtttatactagaaaaaattcttatgatcagcattgtgtaataaaaaaacatgcaggctttggatttagtagatttaggtttaaaatctctgcttccccgctttctagctatctgactttggacatataataacttctctgtgcctgtaaaaagcctcaaaataatgtctatagcataagaaaatctataaaaataataaaaaccataggaacagtaatttctacctttccagttttcagaatgaagatgaagattagcattgatgggatgtaataagtagtcaacaaaagggagccattattgaattgaatttttcttcctcctttgcaatgactcctggcctacttacatattaatataattatgttccatgaattaatttaaaaggtagtgagaagtccagtaaaaaccaagaaagtctaatatg

SEQ ID NO: 115118 - DNA, 764 bp, Homo sapiens
agcatagcaacagcagcgtagctgaacatcttacggatggcccaggctccaaaggctcgtttcctaagtgagagagagcctggctgaagctgtattaccattcattctccagcctccgaagtctcaaagcatcacttccaccatactctaactgtcaagacaaacacaaaggcccagagaaggggtctcactatgttgtctggagtgctgtggtggagtggagtggctattcacagagcctgttctgctgggacacagaatcacttgctccatctcatacattgatgatgattaatttgtatgtgtaccttccaaaaaagatggttgtgtttgaatggaggccttctggacaggaaaattgcaaagtacaattaacatttgagtctgtctgagtcatgaagaaatggagattactgaaaataattcattttggtatcttcttacatcctgagagactaatctttccaagttcatctgaggctcctcttctccatgacaacctcatccagggatttcttcctgtcctggtgttttatgacatgtggaaggggactgtagcaggtgatctccaaagtctctggagacttactaatgtgcatcctcatctcgcttgtaaggataatagccttcctccaaacctcacacacttttggaggagatcactttttttaaagtgcatggaaatgttttgaaacagtgaaatctataatgataggtttcataattctaacatccacaccatatggtaaggacaaataacacta

SEQ ID NO: 115119 - DNA, 821 bp, Homo sapiens
agcatagcaacagcagcgtagctgaacatcttacggatggcccaggctccaaaggctcgtttcctaagtgagagagagcctggctgaagctgtattaccattcattctccagcctccgaagtctcaaagcatcacttccaccatactctaactgtcaagacaaacacaaaggcccagaaactgccagactgtcttctgaagtggctataatatttacactcccatcagcagtgtagaaggggtctcactatgttgtctggagtgctgtggtggagtggagtggctattcacagagcctgttctgctgggacacagaatcacttgctccatctcatacattgatgatgattaatttgtatgtgtaccttccaaaaaagatggttgtgtttgaatggaggccttctggacaggaaaattgcaaagtacaattaacatttgagtctgtctgagtcatgaagaaatggagattactgaaaataattcattttggtatcttcttacatcctgagagactaatctttccaagttcatctgaggctcctcttctccatgacaacctcatccagggatttcttcctgtcctggtgttttatgacatgtggaaggggactgtagcaggtgatctccaaagtctctggagacttactaatgtgcatcctcatctcgcttgtaaggataatagccttcctccaaacctcacacacttttggaggagatcactttttttaaagtgcatggaaatgttttgaaacagtgaaatctataatgataggtttcataattctaacatccacaccatatggtaaggacaaataacacta

SEQ ID NO: 115120 - DNA, 577 bp, Homo sapiens
agcatagcaacagcagcgtagctgaacatcttacggatggcccaggctccaaaggctcgtttcctaagtgagagagagcctggctgaagctgtattaccattcattctccagcctccgaagtctcaaagcatcacttccaccatactctaactgtcaagacaaacacaaaggcccagaaactgccagactgtcttctgaagtggctataatatttacactcccatcagcagtgtagaaggggtctcactatgttgtctggagtgctgtggtggagtggagtggctattcacagagcctgttctgctgggacacagaatcacttgctccatctcatacattgatgatgattaatttgtatgtgtaccttccaaaaaagatggttgtgtttgaatggaggccttctggacaggaaaataatcacatccttcctgagataatgagcacacaattgcctggatacctgaaggaatggagacagcggcagaaaacactgcagagaggtggaaacatccgttaatatctcaacaatcccattactgctaccaacaataataatggatgcatagaacatcgatc

SEQ ID NO: 115121 - DNA, 921 bp, Homo sapiens
agcatagcaacagcagcgtagctgaacatcttacggatggcccaggctccaaaggctcgtttcctaagtgagagagagcctggctgaagctgtattaccattcattctccagcctccgaagtctcaaagcatcacttccaccatactctaactgtcaagacaaacacaaaggcccagaaactgccagactgtcttctgaagtggctataatatttacactcccatcagcagtgtagaaggggtctcactatgttgtctggagtgctgtggtggagtggagtggctattcacagagcctgttctgctgggacacagaatcacttgctccatctcatacattgatgatgattaatttgtatgtgtaccttccaaaaaagatggttgtgtttgaatggaggccttctggacaggaaaatatggagagtgcgtgctttggattcaagactgggaatgaggggaccagaaacctattctgtggctgtttcttgttaggactttcctaagcctctggaaaagtgcaaagtacaattaacatttgagtctgtctgagtcatgaagaaatggagattactgaaaataattcattttggtatcttcttacatcctgagagactaatctttccaagttcatctgaggctcctcttctccatgacaacctcatccagggatttcttcctgtcctggtgttttatgacatgtggaaggggactgtagcaggtgatctccaaagtctctggagacttactaatgtgcatcctcatctcgcttgtaaggataatagccttcctccaaacctcacacacttttggaggagatcactttttttaaagtgcatggaaatgttttgaaacagtgaaatctataatgataggtttcataattctaacatccacaccatatggtaaggacaaataacacta

SEQ ID NO: 115122 - DNA, 962 bp, Homo sapiens
agcatagcaacagcagcgtagctgaacatcttacggatggcccaggctccaaaggctcgtttcctaagtgagagagagcctggctgaagctgtattaccattcattctccagcctccgaagtctcaaagcatcacttccaccatactctaactgtcaagacaaacacaaaggcccagaaactgccagactgtcttctgaagtggctataatatttacactcccatcagcagtgtagaaggggtctcactatgttgtctggagtgctgtggtggagtggagtggctattcacagagcctgttctgctgggacacagaatcacttgctccatctcatacattgatgatgattaatttgtatgtgtaccttccaaaaaagatggttgtgtttgaatggaggccttctggacaggaaaatatggagagtgcgtgctttggattcaagactgggaatgaggggaccagaaacctattctgtggctgtttcttgttaggactttcctaagcctctggaaaaggttcaatcctgctgatgctctccatggagatggtcagcaagtgcaaagtacaattaacatttgagtctgtctgagtcatgaagaaatggagattactgaaaataattcattttggtatcttcttacatcctgagagactaatctttccaagttcatctgaggctcctcttctccatgacaacctcatccagggatttcttcctgtcctggtgttttatgacatgtggaaggggactgtagcaggtgatctccaaagtctctggagacttactaatgtgcatcctcatctcgcttgtaaggataatagccttcctccaaacctcacacacttttggaggagatcactttttttaaagtgcatggaaatgttttgaaacagtgaaatctataatgataggtttcataattctaacatccacaccatatggtaaggacaaataacacta

SEQ ID NO: 115123 - DNA, 436 bp, Homo sapiens
gtgcctggacataggtcttcccagagccagatctggaattctctctccatccttgtcccgcccctggatgtgctaaagtagcagaaagaacactgagccaggagtcaggaaagcaactctctctgcttatctcctagtgccgctagacctctgtggctttaggtgataaaaaatggggtcacacaggcttccatttagtaaacccacttgccctgggctttcacaccttcgtctcattctcccttgataccaacgaggaggtaggcagggttggttttgtgatgtcattccctagttgaggaaaccaagacaccgtgagtctatgtgagtggtgtgaagtcaccagcaagtttgaacgatgaggttttggtacagccattttgatatggtcatgaggacattttgatgtcacctaaaaagcaaactatccaactta

SEQ ID NO: 115124 - DNA, 928 bp, Homo sapiens
gttctgggaatcaggacatggatatctttggagcccgctattgcttctacctacaactggtgttacaggacttggcccacttaatcttgcaaattctttctgcccctctcctgtgcttaatgagatctgttctctatgaatgttcaggacctcaggagtagggaccccaaaggctgggggcaaagtagatgtgacaggtgccaagcataggatgtgtgaccagattcggtcatgtgattacattgtgaagtgacccaggcattttcattaagaaggaaagtggttgtaggaggaggaaattgaacacaacccacacatgggtggttggaaaatctgagacctctcgtgggcatgctcatccatttcactcaccggtacaggggaaattcttagacctgtcagtgcaactatttgaaataaacatccaagaaaggcagcaaacttcaggtaggatgaagtcagaagtccaccctgaagcacagtaaaagccacaagacagaagtgactgatcccatcccagggatcctaaagaagattatcatcagacttctcattggaaactttggaagtcggaaggcagtaggctgataaattcaaaatgctaaaaaagaaaaccaatgaaaacatgctaaccaagaaaaaaaaatgctacatggctgaagaaatcatgcagaaatcttagcaacattttaaatgatccaacaaggtctgttgcccattgcgcaaatatgggcaaacatgagctggtatagcttatttttatgggtgcagggagcatgcagttatctccactagcatgtttttgtttgtttgctttgagatggattctcactccagcctgggcaacaagagggcaactccatctcaaaaaaataaataaataaaataaatgaatacataaataaaaggcataataagcaaattgcta

SEQ ID NO: 115125 - DNA, 394 bp, Homo sapiens
ttagaaatgcagcaggcagccgggtgtctgaggtagaagggcctgtggtgttgggggtcaacggcaagggctgagcagtcaagcattcctgggttcaaatcccagctcatcctccttgtgagtttcccggggctgccgtaaccatgatcgcaaatgtggtggcgtaaaaccagaaatgtattctctcacagttctggatgccagaagttcaaaattgaggtgtggccagggccgtgctccctgggaagggagaagcccttccttgcctgtccagcccataaaggctgtcagcagtcctgggccttccagggctggtggccacatcatgctgtcgtcgacactctgctttgcctccgtctttacgtgaccttccgccctctgacttctcatcttc

SEQ ID NO: 115126 - DNA, 794 bp, Homo sapiens
gggtttcaccatattggccaggctggtcttgaacttctgacctcaagtgatccgcccacctcgacctcccaaagtgctcggattgcaggcgtgagccagcaggcccagccggcaaactttttcgaagagacagggtcttgctatgttgcccaggctggactcaaactcctgagctcaagcaatcctcctgcctcaacctcccaagtagctggtactgtggtcgaaggctgctgtgactggcatgtcaaacttttattgtgcttactttgtacacagaagtgtccaaggtgcaaagatgcctgaattatatgctggaacttgtgagtaaaaataaatgcagtaaagggaaataggcttgttataccaggcagaatattatactgaagaggtaccaagaaactgttgtaggaatgtagaggaggaagtgattaaatgagataatggatgtgaaagtgctttgtaaaccatgaaacagtatacccagtagaaaagatgattattattgttacaagtgcgctgatgttcctggaagaaaaataaagaataaattcaatcacaatgatgggaggttggcagggagccctgtggggcctgactccctgagcgagctcaacctgtccccaagtggcaaggctgatagagtccttggctagggaaagaagccattgtaaacatgaagacaagctgttcccagagcaccttctgtgcacctgtgtcatagtacttaccacatcctgcaagtgtctgaggcagtccaggtggacaataaacacttggactttggtggttggcag

SEQ ID NO: 115127 - DNA, 336 bp, Homo sapiens
gtaaggggttgggggagtggttttttaaattgaaaagtgatatctaatttgcttttttattttttctgacttttctggctgcagagtagagagggagaattgtggggtgggggatgagggcaataatcaaagcagggagaccagttagaaggatgccgccaagattcagaccaaatcaacaatggtgggaatagaaatggaaagatggggttggatcaggacaggttttggaagcagagctcttggaatatggatttgggagggtgaaggaaagagaaaaaacaggactgactcctcggctttgggcatgaacaacaggatggatgggcatgctgt

SEQ ID NO: 115128 - DNA, 248 bp, Homo sapiens
tgtttcctttgtcattctcatctgtaattccagattttctattagaactgtaaaacccctttacttctgtccttccgtccttccatccatccatccgtctgtccgtccttccatccatccatccgtctgtccgtccttccttccttcctttcactttttttttttttttttttttgggaaaaaggtcccctttttgccccccgggttggaagtgcggtgcctctaatctccggcctcagtgaaccccc

SEQ ID NO: 115129 - DNA, 177 bp, Homo sapiens
acaaggggtgtgattctctggacttaatcgtaacgagtaaggatgaaatagaagttatggaaatcatttcaaaaggatgtgccaatgccattttagagttcatagtaataaaaggagaatatgttagccacatttagatatgtaaacattgacaatgcttagaaaacagactttttt

SEQ ID NO: 115130 - DNA, 648 bp, Homo sapiens
ctgtaggagggtttgtgtcttgacctaacatatctttttggctcattatcatgtattatttgtgtggttttctctttgccttgtgttgtgtggtttcctcagccactcagtcaactggaatgcaggctcagtgtcacggccccagttctgtaccttgtgctccccaagcctggttcagggctgtgtgtacctagaaaagtttcagtaaatccttcttgagtccatttagtgtctacttaaggttgtggaacccttggcagtttgagaagcatcttgaccttctttttctcattctagaccagctgtatcatttgcagggctcagtgcaagcccccttgttcagaaattattaaaaatttcaaggctggggcccagcgtggtggctcatgcctataatcccagcactttgggagactgaggcgggcggatcacctgaggtcaggagtttgaaactagcctggccaacatggtgaaatccgtctctacttaaaatacaaaaaatagccgggtgtggtggcgggcatctgtaatcccagctactcgggaggctgagggaagagaatggcttgaacctgggaggcggaggttgcagtgagctgagatcgtgccattacactccagcctgggcaataagagagaaactccatt

SEQ ID NO: 115131 - DNA, 667 bp, Homo sapiens
ggactataatttgttcaaaatcacttatctaataaaggttaaagccaaaatttaaacatatatctgccagatttcaaagtctctgctctccccataatgatatgctgcttcccttctgaaaatatatctaatgaccaggcttttgccatatcagggattcagttaaattatgaaaagagttatctgaatttcagagaaaaagatgtaatatttttcacggtgccaaataaattgactatcctatggacaataatggcagctgtaccacaggacaaaaatattaaaatatttataatacaaggtttaataaccattatttttagtagcaagtatatttaaaaatgacttgagtgtcacccacctttctgatgtatttatcgtatataatcacacaatgtgaaaaacattatttggtttggggaaaacagaatacaaatgtttaaaacatttttaccttcttttaaaccctaatccatttggaaaaagtatcttcaatataattgtgtcattaaatcacaaaaatggaaattacgttaacagcaggatgttatcttttattgagggcaaatagcagggttgctgctaatgagaacatcatcaatttatcagcaaaaggtcagcctaaagagctctttacctaacttctccctaagtagttattttcccc

SEQ ID NO: 115132 - DNA, 666 bp, Homo sapiens
gtttgaaagtagttaggtgtatgtaggcagaacatgattaaaccaagtttatttgttttgtcctaaaacagttttagttaatgttggtaatcttccaattgactaattattttataatatttcatttgtatgtaataggcacacagcaagtacctgttgaatgagtcagtgaatttacatttgtcatttgttgacattaaatattcatcttggaaactatataagcttaaaagaatgcaaataatagagtttcatccaatatagtttgagtttttgtttggggattcctatttatgctgctactcacccaacacattttaaatatttgtttggggactagtatttacgtttctattctgatgaaaacgtgaagaaacaagaggaccaaatgatctctaaggaccattctaactctaaactcattttcagagaacaaagtagaccaggtgaataccaattcctgataaaaggtagaagataattatcaaaactaacagcagccattgcttttattggcaattcattagaagcattctcttcaaaacgtagaaaaagtcaagagtgcttaatattactgataatattcaacatcatttttatagacctaccactctagcaataaggcaacgaaaatgagatataaatgctgaaaaggagaagctacaa

SEQ ID NO: 115133 - DNA, 308 bp, Homo sapiens
ccaggagagcagaggggagctggcggccgaggtggggtcggtggtggggtgagcctgcggcgttgtggctccaaggcctgctggcctgaagtcacccccgggatgtgccccgtgtgggaccgtgcgggatgcagggaggagcgtggctctgggtgtggaggtggcgggctgctggcatcctgtcaccgaaccctccttccacaggaacgggggaatgagtgggagagcagtgggagagtgtgccctctcccccagactcctctctccctgtggcatgagaagggtgggatctggcttaccaggtgagt

SEQ ID NO: 115134 - DNA, 395 bp, Homo sapiens
gaccccatccctacaaaaaaaagtatatattttttacttcattatacaaaaatattaaagaattagctgggcgtggttgtgtgcgcctgtagtcccagctactagggaggttgaggtgggaggattgcttgcttgagcctgggaatttgaggctgcagtgagctataattgtgccactgcactctagtctgggtgacagagcaagacctgtctctaaaatcaaccgataaatcaataaaaataaataaaaaataaaatgatagcatggtgttttagggaactactttattttttattttcatttatttaatggtgtttgattaatcacttaaatattaaaaatcagttgtaaaaattttgatattgtccagacaaaatagactaagtcacagaac

SEQ ID NO: 115135 - DNA, 95 bp, Homo sapiens
agaagtcctgaaattaatgttgaaagcaaggcagtgggatgccactaaggaagcaaaagcagaggccgggtgcagtggctcatgactataatacc

SEQ ID NO: 115136 - DNA, 116 bp, Homo sapiens
agaacttggttctatttctgacttcaccactaatttgccataggctctggtgaatccctttccctctaccgaccttgccttcctctactgtgaaataaagtgttgtgatttgaatt

SEQ ID NO: 115137 - DNA, 667 bp, Homo sapiens
ctgactactgcggaaggtgagactattcaggcattaagcaactgccaccctaaggtggggactaagggagaacttagtgttacaggagctcaggaggcagggctgttcattgggatctgtagaagctggggctatgggggaggtgctgccactgggccagagccattgcccagagcagagaaagaagagaaatgcccaggagttgcctctcttcctgcccttctatctcctcccagtgccttccattggccaaacccacccagaagccagtttcccagcaaagaagccctgaaaaggtggtttgggagaatctaccccgtgactgaaggcagagtagaggaagggcacctagactagactagactagatttgaggcaaacgagcagatgacctgtgccatctatctctgacttggggttgtgttgaagcaggctgagctgacactgtgggcttccacgtagtatacaatcagtaaatggtaaatgttctttttttctttttacatctccatcctcattttttaccattcgtccccaaattcagacatattgatgtctttttagtttctaaaggtcactatgaactctatgactttgggacctgtggatatttaactccctctgagtccacatcgacagggatcctctaggcagccggccgatcactc

SEQ ID NO: 115138 - DNA, 737 bp, Homo sapiens
gaagattgcttattggatatatgtgtcagaaaccatgctcattgtttaggtctaaatttgatttgtagtttttagaatttaaatgttctttgaattttcaaagtatcaggggcttaactttgagctctgtctctggctagtccttgggactccattcaatatcttccatctgttatatataatttgttcacataattgttgcaggaatatcagaaatctaaatcatgggagtaattttatagggtcctatatgataataaaaatagtaactatcattacagaaaaactctagaatatgcaacaaattttacatgcagaaattctaagtattactacaaccgtgcaagttaggtgttttgggtggtatattttgaggcattatcatgttttaaaatctgtgtattctccccctcccctcccacttcccaatcctgccatttcatatgagtaaatggtcagacttgtgcttgttttgagtgagttttgaaacaaggtagaatgcagaaggctcttgcaagtctttttaaactctagagacatgagaagattgagacatagataaaatatcttaaccataaacacaaaggcagaaggatttcactgaaactagaaagttttcccagcttgacatgaagggagatggtgacattggagatggggatttcaaagcacaagtgacatgtcctcagcttccagcagagaagccaaaaggccagcgatattccagaggggaaatg

SEQ ID NO: 115139 - DNA, 679 bp, Homo sapiens
aaattgcagaagaataaacagcaagagctaaagttctcatttatttgtatgttacctgctcctggattacctatcgcaaattaggatgtttttggttaactttgatgggttttgagattgtcacttctttccatttaatctttgtatgcttagaaactgccagtttagtatggtattaggtgaaaagaaaatggttagaaatataaataaaatctttagtggatagtattgtaccaatgttaattttttagtttagaaacttatattatggctataaaaggtattaaccttagaggaagctgggtaaagggtatatgggaactgaactattttcacagttcttctgttatctgaaaattatttcaaaataagctaaaaaatgattagactaactctacagctacaaagttattagtgtatattgcaaaaccagagacaagtgatttgtgtgtgtctagggaatggacagagattctcttctatttggatggttgaaatccttgttcattttcattgacctgaaaaattgagagttgttgctgtatctcatgaggatgaagatgctgttagagtatgtttagtaaatgcagacttctttttctttttctgtgttatgaatatatgcataaatacacgacagataccaatttgcaaacatacatgcagtgtgtgcttctaa

SEQ ID NO: 115140 - DNA, 593 bp, Homo sapiens
tggtggccatcctttgggcactgtctcctttgcctgtgactctgtggcattcctcagtgcaggataactacagccttgaaacgatggctgtgaagtttcatttttatttcaaactctgtccattgctcttgtataagatcggacataagttcccaaaagaggaaaaattcattgtaagacagagagcatgtacaaaataagacagtgggaggagaggaaggaaccagagacagggcattctgagagctggaaggggctggagaaccacagcctgacctggcttggcctgggcagattgattgggtcccacgtgtggaagggaccctggcgagtgtactgtccagggcaggtgcaggtaggcctgcccctgtctgtccaggcccccactcttggtcaggcccaggtcagcagaacaccgaggaccttgtggacagcccttcgttatgtttgggctgctctgtctactgtcaacaccatcaacttgaacttctgcaccatgctgagcttgaactctcagaggggcaggagcctggcagctaaaagccctgctgttccactccctcacagtgggacttctaagcctttgtgtcccc

SEQ ID NO: 115141 - DNA, 362 bp, Homo sapiens
aagacaagcatgttcccctaactctcaccacccgggcgtgacgggaggtagaatgtgtatgtgtgtacgtgtgtctgcacacattgatctgcctgtgtacggtctacattttctttcattcactcattcactcatcaactcattccttccatggtttaggctccactcacttcacaaaacctggaaggcagaataagaagatgaaaggatgcggccaggcacggtgactcctgcctgtaattccagcactttgggaggccgaggtgggcagatcacctgagctcaggagttcgagaccagcctggccaacatggtgaaaccccatctctactaaaaatacaaaaattagccaggcttagtgg

SEQ ID NO: 115142 - DNA, 726 bp, Homo sapiens
tactttccaaactggcttaactgtctttattaactgttgttaacacatgaaaaatgttattgattgacttttagcagaatgatgaattaaacttagcttttctcattgtttctcaatataatactggtgttgttaccctcttttaaatgtctgatcagcatctacagatattcaaccccttaagtggggattagaaaagtcaatacacccataattaatcctaaacagctgatgtccatcattggtggacattggtcaatgaactgttgtcataattaatgttaaatgtataagagagaataatttggctttatactgttcatgttaaggcagctagacagaaaaaaatatataaaatcttccagaaaaatcttgaaatagatacattttagagtttcatatgccttagcattctacttgtttaagatactcatagggagttgtgaaaatgtgtcatattttgttctgattagtttcaggttttataaatttctatgtatcaaataaactgaatttattaagacataattaacctattttcacattttaatcatttaaggcatatataactgtaatcaaagcttcagatcaggatgatattcaatgttatcaaactgaattaatttaactctaatcaaaagcaaaaataccatgacattctggttaattcatgcacttttattttgggaaatgtgcaaagtctgttgaacttcttgaaaaaatgaa

SEQ ID NO: 115143 - DNA, 177 bp, Homo sapiens
ctcaccttctacccttcagattcactacagaaacttccttcttggcctgcatacatacctgcaaacaacctctcctctctcccagcggcgaacactagacttagagcctcaggggcgtgaactctccttgttgacctctgtagccttgtgaccgtattgtgaatatgcggctaacca

SEQ ID NO: 115144 - DNA, 281 bp, Homo sapiens
ctcgccttggcctcccaaagtgctgggattacaggcgtggggcaccgcgcctggccactttccatcttttctaagcatatttttaatacttgggatcattctctctatactgtttcttattcaacattaagttatcattttccctgtgttgaataatattcttaggaaaatgattgttagctcttgatagttatattagtgtatgatttcccttgctaattatttcaattgtttccagctatttgttattataaatcaagattttgtataaatcttcatac

SEQ ID NO: 115145 - DNA, 241 bp, Homo sapiens
attaagagtgaagatcatttgcacagttcactgatctagtttggtgtgtcctcttatccgttagtggaagtagaatggaaagagtgctctttaaacaatgagggagttcagtgtttatggttttgtactctgaattctaagttgttgagatacagttgttatataagtggcattactgtttgtcagaaatcatgaggaggaacaatttaatccagcatgaacgtgggtgcttgtgtttgag

SEQ ID NO: 115146 - DNA, 273 bp, Homo sapiens
tggtgtgtgtgaatgtgagcatttgagtgtgcatgtgtgtgtgtgcatgtggtacatgaatgaatgagaatgtgtatgtgtgtattgggaaagtgagtgtgattgtgtatgtgtgagtgtatgtgagcatatgtgagtgcaagtatatgtgcaggtgttcatgtatgtgtgtgtgtgtgcatgtgaatgcatatgtgtatgttggtgaacatcagcccgagagtgtggacaccagagtgagtgagagtgtgtatgagtgagtgcaggcgtgag

SEQ ID NO: 115147 - DNA, 396 bp, Homo sapiens
ctgggtctcttcaaagggcctcggtggcagaagttccaagtattctgaataggtgaggatcacattaggctttctagaatctcaactgccctgccctaaacccaaactgatatgcataaaacttaagaagttctgcccacaggctcttctgggtgtgtgtgagatacaactcatgtgagctgggacagtgcaggggtgaagagcctggactccactgccagatggcctgggtttaaatcctagttctggccacttgctagctatgtgaccttgggcaagttattttacctctcggtcccttagtttccttatctcctaagttcagagccagggtgtgtggcacctcccccggcccttgctcctattcttgccataaggaatctgcccccatgatcc

SEQ ID NO: 115148 - DNA, 677 bp, Homo sapiens
gttgtgtaaagttttgagctctctgttaattaatattagagaaaatctattcttcgaaatcttgctatgcttgcacttctctcagtagaggttatgtcatgtgatttagtttacaacttcaatgaatataattttcaaaatcgctacaactgcagaatgcccatatatttgtttctttttccttaccacctgatctggaaacatgaagaatgtatctttatacattaacaatgtgaagccactaccttgtacaagcaaaataatagctgtgcccttgatttatgatcattgtaccacatatgtgaagaattagacacaaatataaaatgtgcttgtgcaaagtatggatttgcatttttcttattacttaatagagcatcagaaatagatttttaaaataaaattattcataattaaatattaccaaaacaacaacaaaactgtggcattttggtagcctcttggagtaaggttccaaaatttcattttattatttattttttaatggtagcatagcagtgggcattaaaaaaatctaaggtccgtatttaaagctcttaaaaactgttagtgtgtgtacctttcatacatattattcttaagatatttcttattaccactttgatgtctatattttcaggtttattgtgctgtttctctactaacatagtattgga

SEQ ID NO: 115149 - DNA, 181 bp, Homo sapiens
gtgccttggttggaggcttctcagggtcctcaggggttcctgagtggctgccagagcaagtggtggctccctctggccttaagagggagtgtagcccagctgccaccaggccctcctgctgcccaggctgcccagccagccctgcttggagccttcagagggtgtgccctggctgcagtag

SEQ ID NO: 115150 - DNA, 305 bp, Homo sapiens
atgttgcagacagcagggaagggagtttagaatgagaaactttggaataaacataagccatctatctagcccttgcagtttatcttcatgcctttattgattattctcatttgccatctggctgaattagttattaaaaagtttctttgggattataaaacctagttatctaccttatacttggtacaataaaagagtttttagggaactcctataggggttataaaaaaaataactgatgggtcacacctgtaatcccagcactttggtaggctgaggtgggcagatcactggaggtcaggagt

SEQ ID NO: 115151 - DNA, 861 bp, Homo sapiens
ctcacctcagggtctgtgccttcttcataggagtgaatgctgaaagccatgccatcaaacgtgtggtccccccgcagcacagccaaagccagcccggccaccgtcagatttgctatctgcccagaaaactccatcttgtgaccagtacgctcaattatcctcagaattctgcaagaaaccacagatggagaagagcatcctaccttttaaaagtaaaacccatcctccttgcaagatttccttattgcaagacttttctttgagttttaatcactatctttatatcatttaggaattattaaataagagcactggctttggaatcagacaagttgacacctaaatcttagcttctctaatttctaactgtgtgggcaaataaagtaatctcacttagcttcagtttcctcacctgaaagtcaaaagtaatattacactcatctctaaagattgtcgtgaaaattaatgaaattgttacatgtaagccagaccctgcagggcctcgtaggactttataagacatttggattttattctacgtgtaatggaaagccactgagtggttttaaaagcaaagtaaggacatgacctgatatatacattaaaagattactccgggtgctatgtagaagatgacccatagagggtcaagaacggaggcagagagaccatttaggaggttattgtagacagtctggtgagagaaatggggctaggaataggatggtagtggtggagatggagagaagtaaaagaattccaccaaaatatttaagggattttaaaaatggatgtacagtgccgcatacaagagttagttattaattggctgtgagttagaaggagttaactagtactgtt

SEQ ID NO: 115152 - DNA, 398 bp, Homo sapiens
gtgaaggaaaacaactttaaaacactctttggtccttctcccctctttaaactcaaaagggtataatcatccccgggagagagcactccttttaaatggggctactcatcctggcttggctaatggtgaacctaccttgtgggttttaaatcaaccgtgacatcaggtggtattgggtgcctgagctggcattttgtgtaagtccaggagcccttgatagtgtgcgtcactggggttattgatcgtgggaagaagacagcttggctggcatctcaccttttcctctgagtggagaagctgacttgctttaagtgcccaaagcaaaattctgagtaagggtagatttgctctgttattgttttttggaatcttaaggcaagagagtgtctacttgttgg

SEQ ID NO: 115153 - DNA, 908 bp, Homo sapiens
aaccaaaaaaacaaggtatacaggcaacaaatagcatgatgaatagagtggtacctcacatctcaatactaacattgaatataaatggcctaaatgctccacttaaaagatacagaattgcagaataggtaagaattcaccaaccaactatctgtcgccttcaagagtctcacctaacacataaggactcacataaacttaaggtaaagggatggaccaagacatttcatgcaaacggacaccaaatgtgagcaggagtagccattcttatattagacaaaacaaactttaaagaaatagcagtttaaaaagacaaagagggacattatataatgaaaaaaaggccttgtccaacaggaaagtatcacaatcctaaacatatgcacctaacactggagctcccaaatttataaaagaattactaatagacctaaaaaattagacagacagcaacacaataatagtgagggattttaatactccactgacagcactgcacaggtcatcaagacagaaagtcaacaaagaaacagtggatttaaactataccttggaacaaatggagttaaaagatatatacagaatattccatccaacaaccacagaatatacgttctgttcaacagcacatgaactttctgtaagatagaccatatgatagccaacaaaatgagcctcaataaattttaagaaaattaaaattatatcaagcactctctcagaccacagtggaataaaactggaaatcaactccaaaaggaaccttcaaaaccatgcagatacatggaataacctgctcctgaatgatcattgggtcaaagatgaaatcaagatggaaatgtaaaagttcctcaaactgaatgacaataatgacacaacctatcaacctctgggatacagcaaaggtg

SEQ ID NO: 115154 - DNA, 384 bp, Homo sapiens
ccacagtgctgaattttcacaaattgcgaattaggaaattgttgctcattttacaatttggtttccctcaggattccttttaagtagccagctaccccagtacttttgaaatatgacttgcttataaaaatttgataggcttggcacggtggctcacacctgtaatcccagcactttgggaggccgatgtggggtggatcacgaggtcaggagttcaagaccaacatggtgaaaccctgtccctactaaaaatacaaaaactagccaggcatggtggcacatgcctgtaattccagctgctcgggaggccaggcagctaggcaggagaatcacttgaacccaggagatggaggttgcagtgagccaagatcatgccactgcact

SEQ ID NO: 115155 - DNA, 1282 bp, Homo sapiens
aaaaattagcaaggtgtggtggcacgcacctgtagtcctatctacttgggaggctgaggcggaagatcgcttgagcccaggagttgaggctgaagtgaaccatgatcatgacactgcactccagcctggacaacagagcaagactctgtctcttaaaaataatcatataataatgattttttaaaagaatggggatgtgtgaaggccaagctaaagagtttggtaacaagaagccagcagaaactttcaaccaagagaatgatgcagttggggtcgcataggttgggttaggggcaggggaagtgagggctggataaaaggaaaagtatttagaggattgcttcagttgcaaggcttgaagcattcaatgtagatggattcaagagatattgccaggtcttgttgatctttctttatatacacacacttactgggttgaattgggaggtgtggtctctgaagaaaacaggaaaggaatgatgagagaagttctcagaagacaatggaatagagcatctaaagggaggagtaaggagtttcaacagtgtaagaaagaatgaagatttgtcatttttaaagttgtgggaccctctgaaaatctgatagaagcagaagccagcacacagtttcaaaagtaaacagaagaggccaggtacggtggctcacacctgtaatcccaacactttgggaggccaaggtcggcggatcttttggggccaggagttcgagaccagcatggccgacatggtgaaaccctgtctctactaaaaatacaaaaattaatgctcctgtagtcccagctgaggcacaaggctgaggcaaaagaatcgcttgaactcaggaggtggagattgcagtgagccaagatcgtgccactgcactctagcctgggtgacagagcgagactccatctaaaaaaaaaaaaaaaaagtaaacagaagaatagagtgtaggagctagagaggcatgcagtttttaaatgatgatgatagaaagttagtatttattgagcatatcttacaggccaggctctgttctaagcactgtaaagaatttaatcttcaacaaccctataaggttgagttctggtattttcgcactgtacaggatgaggaatctgacacagaagttaaacagctaacccaaggccacatagcaaataaatggtggagttagaattagagccaaggattttttttttttgctccacaatagagatgacaagaagagggtagagagagattccagatactagaaagaaaaagtgaaactgaagggcacc

SEQ ID NO: 115156 - DNA, 558 bp, Homo sapiens
ggttaaaaccctgtctcctactaaaaatacaaaaaattaaccccggtatggtggtgtgtgcccagttagtccccagcctactcaggaggctgaggcaaaagaatcgcttgaactcaggaggtggagattgcagtgagccaagatcgtgccactgcactctagcctgggtgacagagcgagactccatctaaaaaaaaaaaaaaaaagtaaacagaagaatagagtgtaggagctagagaggcatgcagtttttaaatgatgatgatagaaagttagtatttattgagcatatcttacaggccaggctctgttctaagcactgtaaagaatttaatcttcaacaaccctataaggttgagttctggtattttcgcactgtacaggatgaggaatctgacacagaagttaaacagctaacccaaggccacatagcaaataaatggtggagttagaattagagccaaggattttttttttttgctccacaatagagatgacaagaagagggtagagagagattccagatactagaaagaaaaagtgaaactgaagggcacc

SEQ ID NO: 115157 - DNA, 295 bp, Homo sapiens
ccgatatttattatttttaatagagacaaggtttcgctgtgttgcccaggctgctctcgatttcctgggctcaggtgatcctcccaccttggcctcccaaagtggtgggattacaggtgtgagccaccacacccagcccatttgattttctagttcacagtaattacagagatgaggctaacagtgtgtcccatagagcaagaaactccaccatctagtccagtgactataccagcatctagtgcagagctgacagcagcaagcagtaacagctttacattgtgaaataagacag

SEQ ID NO: 115158 - DNA, 219 bp, Homo sapiens
tttacagtcaggaatggacaatgatgtctaatattattttaattcaatattgtaatagcctagacaaagaagaaagacatataaataaatgatttagaatctgtaaaggaagaactataactattattattatataagatgataatatagaaaaccaaaagtatttacagatgaattactggcattaatgaaagtaataaggtagaaggatataaaatt

SEQ ID NO: 115159 - DNA, 322 bp, Homo sapiens
  misc_feature (50)..(50): n is a, c, g, or t
  misc_feature (62)..(62): n is a, c, g, or t
  misc_feature (75)..(75): n is a, c, g, or t
  misc_feature (158)..(158): n is a, c, g, or t
agcagcttgtaagaaacagattatagtgtaaagaagagtatctaaaaaanctatttttaatntcttcagaggaanatagatactgcatccataaaacaagtatagaatgctataaaaaggaacactcaaaaacaacagagtgagactccatctcaaanaaacaaaaacaaccatgcccggttattttttttcacatttttagtagagacggggtttcaccgtgttagccaagatggtctccatctcctgaccttgtgatccccccacctcacccttccaaagcgctgggattacaggcgtgagccactgtgcccggccttgc

SEQ ID NO: 115160 - DNA, 1267 bp, Homo sapiens
ctttaaaactgggaaggaggaagacgaggccaggagccggagggtcaccaaggtagatttccagcagcgctagtccagctgaacactttccagccttgtttttcagcagctttgaggaaaagtatagtgatccgtatgtgaaactttcattgtacgtagcggatgagaatagagaacttgcttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggattttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagcttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggaccatctaccactgccagtgccccagctgggagagcgcgttcatcaaactgtcacgggtggtgaggaaccaacgccatcagtggcctatgtacataccacgccgggtctgccttcaggctgggacagaagacaagatgctaggggcgcacatactatgtcatcataacaatcgaaccaaatggactcgacctatcatgcagctgcagaagatt

SEQ ID NO: 115161 - DNA, 170 bp, Homo sapiens
accaaccttgcctcccatgggtaaagccaatttattgtggtggattagtttttcgatgtgctcctagattcattttgctaatattttgttgaagattattgtatgcatgttcatcaagaatgctagcctgaagttttattttctgtgtgtttgccaggtgtttttttttt

SEQ ID NO: 115162 - DNA, 537 bp, Homo sapiens
tctgtctcaaaaaataaaaataaataaatcaataaataaatggctgggtgaatgttcgctgattgtgttgtgccctaataggcagtgggtcgctaacaactttaatgcctaaaagtgaactttgactaaagtgtctcttcctgactttgattcatgctgtgcttgttgctacccacctgctcttgctatttgtgacttaataaaataacataaagaacagacccagatgggagtggggaagaaatagacatattaggggtctgagaaagcagtgagaggtatacattttgtaattcacatttcagtagaatgaaatcaacaccctggaatagtgattctcaaccaggggacatttggcaacatctggagacatttttggttgtaacaactgggggattgcttttagcatctagtgggtagaggccaaggatgctgctaaacatcctaactaagcacagggcagcccctgacaacaaagaatcatctccctgaaaatgtcaatggtgccaacattgataaatcctgctcgaaaaccat

SEQ ID NO: 115163 - DNA, 771 bp, Homo sapiens
agggacttgacaatgagaggaagcctaggacgccagcaccacctccacctcgccaccacggcaggtgctcctgatgggtctcagggcgagcgcaccctctgccagtgacaggtcaggtgtgggctgtgaccagtctcagccaatgagacatcagggagggcccgcaggtggcctcgggcccggccagcctggatgctgaggccgacctacgaggctgactcgaggtggggaagagcagaacaggcaaacggccagtgctcaccctgctccctgccaggcagcactgtggatgggcttgtggcccacgtgagactgagcagggatttctgtcacttgcggcagaaaacctcccactggctagcaagcacctggtccatcccaagggacagactgacaggctatggcttgtccccatcatggaacacagcagagcgccgaaaagaaagagggggtatcctcccgtcctgaaaaggaaccagcgacgagagatgtcatctgttctcaaccaggggtaattttgctccctaggtaggttgccaggttaaggaaataaaaatgcagggcagccagttcaagctgaatttcagaccgtgcatgttaactagatgtcctgtatttactgtggcaaccttacccccaggggacatttggcaatgtctggaggcagttttggttgtcactggggatggttaggtgctaccagcatctggtgggaaggcaccgggggtgcttttaaacatttcacaatgcataggacagctgaggccaaaa

SEQ ID NO: 115164 - DNA, 481 bp, Homo sapiens
tggtggtgcgtgcctgtagacccagctcctccggaggctgaggcatgagaattgcctgaaccccagagacggaggttgcagtgagccgagatcctgccactgcacttcagcctgggcaactgagcgagactctgtctcaaaaaataaaatgaataaatacataaaatagattgtgatgacagatgcagaactctgtgaacatactaagaaccattgaattggatgctgtcaaagggtgagttgtgtggtatgataattctatctcaataaagcagttacaaagagaggaagagatggaataagaactggaagcacagtggcaatgggacagaattttaaggaatggtttgagactgagtggcaggaagactggggggtaaagctaagagaaccctaaaggaaaggggaccagcttgccccgtaagtggtgtggggctaggttaatagattgcctaatgcccaggagatgtcagtgtgccca

SEQ ID NO: 115165 - DNA, 602 bp, Homo sapiens
tgatcgcccctctctgtataatgatcgggctgccccgatggtgtctgtgagggatgtctgttggaggacgctggcaactgagtgactcaactgggtggggaggatctgccctccatgtgggcaggcaccatccagtcagccgggggcctggaagaagggtgaatcctggctctctgtcccggagctgggatgctcttctcctgcgcttggatgtcagaactccaggttctctggcctttggactctgggactcgtacgagtggtctccggagtctttgacctgggactgggaatgaccacgttccccaccatcctgaagcagctgacttgaaagaagggcagtagagtcttttgaagttgcaattacaatgccagctaggtgacaatactttgtagggctgggtcaggggtcttcaaaaggctctatgtactctgtatcagcatccaatatatggtgctggtttctcccgtagccaggattcacgggtccaggaatcaaggggaggaaatgggagtggcactgcgcatcatatcccctagggacccgctagcgaaattgttgcttcctgttcctgtgactttatgctctgctgggctggagg

SEQ ID NO: 115166 - DNA, 492 bp, Homo sapiens
tgcgctcggcctgttttttctttttaaactttttagggttaaaactttcaagcatgcagaaaagtagagaaacaatataattagcacctatatatccatcacctaaacacttaacattttgctatatttgcttcttctattttttatgaagtattttaaaataaataacatgccaggtgcagtggctcatgcctgtaatcttagcactttgggaggccgaggcaggtggatcacctgaggttaggaatttgagaccagcctggccaacatgtctctaccaaaaatacaaaaattagctgggcgtggtggcgcaggcctgtaatctcatctacttgggagcctgaggttgcagtgagctgagatcgccccactgcactccagcctaggtgtcagagcgagactccatctcaaacaaacaaacaaagtaaattacagacatcataatactgtaccccctaaatactcactatgcatctctaaacaataaagtct

SEQ ID NO: 115167 - DNA, 464 bp, Homo sapiens
gaaagcaacataagacaaaagggaaggtttctatatctatctctgcctcaccttccccaaaatgccccctctctctgtgatgttccataactgatgcaaaagaaaccagtaacaatgtatttttctccaccaaaaggcttgtagcaggtgtcaggactcagaggttaggaagcacacagggcttctaggagggagagtatgaggagaggaaccccactttaggtttctaactaactctgtgagttcctgaacagcacccaggctgcagacacagtactaagggagtgtcatttcatagaaatggaagtcctgataggggcacacaaaagcggaacagagtctcatttaaaatagccacttccttcagcatttaaagtacagatgatttcgtcaactcgcatgaaatgcataaggacaagggaacgtacacttcaacagactcttgatcacgtttgcagggattt

SEQ ID NO: 115168 - DNA, 379 bp, Homo sapiens
catcggttgggttttaagtaactggtttattacagcttgttgtcatacagtaattgcactaaataagacctctaaaattattcgtgctgctttaatttgggaatgggggaaactgtttcctgctagagattctaattttagtatacatgctgtggaagtgagtaccctgctagagattcttaaaatgtcacaattaagcaaatgcctttaaaaattctgcataaaatgtcgcatgcttatgtattgccccgtctactcaactaccagatcatctacagaattatttccttttctttgccttcttaggaaatcagcctttcatgcgcgagatgaccctgcattgattaactgagttactgtgagtggtatgactagggct

SEQ ID NO: 115169 - DNA, 652 bp, Homo sapiens
ggactcctttttagtttgcagtgctgcacgatgcattgtaaaactagtctgtgtgcatacacatgcgttatttctgcttacctctcatatgtgggaagctgaacattttagggattaagaaatctgcctccattgttgtttagaagcctctgctccttgcctggcactactggctgttgggaatgtgaagataaataagagtgactacccttgactggttcacagtttgttccagagacagataatgaggcaacagttccagtacagtgtgaatcctgctgcgataggaacacaaatgcagctttgagctcctgcagcttgtacttcttcaggggcttattctcttgtcctgtaagtagtacacttttgaggtaaggtgaagacaacagcactgttgcttgctcggtttgtgttttgtttgtttcttttgcgattggcataacggaacaaagaaataaaagatgtagttctgaggttatgcagttgagtggcccggctgggagcagccctctccaaccaaatcaggcctttctttcctcaaacaagataatctcaaaacataacctggtggttttatatgtcttcactgtggagatgttttgtgctgttcctctttttgtttataacctatttttcctttcaatagacttgg

SEQ ID NO: 115170 - DNA, 125 bp, Homo sapiens
tctactgcaccattcagaaaaaaaaaaaaaaatacatagaaaacaagtacatgaaaaagacaaggtaattattaactataagaaagacaaaactgagcctgggcgacagcacgagattccatctc

SEQ ID NO: 115171 - DNA, 440 bp, Homo sapiens
gggactacaggtgcctgccaccacgcccggctaattttttgtatttttagtagagacggggtttcatcgtgttagccaggatggtctcgatctctcacctcatgatctgcccgcctcggcctcccaaagtgctgggattacaggcatgagccacagcgcccggcctggatttattcttaactattttaatcttcctacctagctcttccaggggaagatgggaagcctgaataaaacagtggatgattagattaagctatgatattcaaaaatcaaccaagttccttctctaacattaactttcagctctatgattctgcatgcaatttgtaattgacatgtccagaaggcttgtgtgctgagcaatcatatctggtcaagatcaaatcctattcttagtatcaggtgctcaacaataatttgttgtctattgtcatgca

SEQ ID NO: 115172 - DNA, 532 bp, Homo sapiens
aaggaaggcacctttcaggggaattgtttactgttttaatttctgggcttttggtgattagggagatggaaaaggagctatcaggagagacaaggttgatgactaggaggaagccaagaagagtgtagaaaacaaataccttctgctttagctttggcacatttatattgacttaatttaccacttctagatacaagactagattgatgggaattgggaattagaaaaggtggagacaggccgggggttgtggctcacacctgtaatcccagcactttgggaggtcaaggcgggcggatcacgaggtcaagagatagagaccatcctggccaacatggtgaaaccctgtctctactaaaaatacaaaaatcagctgggcgtggtggtgcgcgcctgtagttccagctacttggaaggctgaggtgggagaatagcttgaacccgggaggcagaggttgcagtgagccgagatcgtgccactgcactccagcctgggtgacagagcaagactccatctcaaaaaaaaaaaaaa

SEQ ID NO: 115173 - DNA, 465 bp, Homo sapiens
aaaatcctatccaggctttctgtacatgactgctttgtcatttttcttttttcctaacaaggctcaagttttgtcaagatttccttttctaaaatagaactactttacagcacaagtagttttgtatttttcttttacctatccatatcattattttgatgtaaacaatgtttaaaaggacacagaaaatgtcctaggcttagaaaaagtctcggttgtgtgtaatcaaagagtagctctaaaagactggaaattgtgacaggcatagtattggtcatcagcagaagcagatgaaagacggatattttactgcttgatgaagtcactggaatgtccaggcgccctctgctctggagtttgtggtgtccgttcttgcagtttacaagagtcaacctctagcagcccctgggctttgtttgttggtttgtttatctgttttagactgagagttttttgctttgtttt

SEQ ID NO: 115174 - DNA, 212 bp, Homo sapiens
tgctgagattacaggcatgagccaccgcacctggccccaaattccttttagttcctcaatctgtaacgatggccaggaaaccctagctcagagtggggaaggaggccctctggagatagagtacctctgggagtactctggcatagagatactggttcagaagccagctggtcagctttgtagtcccaagaatgtagatttttctttttggg

SEQ ID NO: 115175 - DNA, 437 bp, Homo sapiens
atggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttatta

SEQ ID NO: 115176 - DNA, 331 bp, Homo sapiens
taaggaggggccatgcttcagattctcccatccttcaaggctccattctccatagtctggttctgccggggtgtcctctgtagccctgatcctcaaacgtcatcgagcctcctgagcaatgccaacccgatgtctcactgattctctttcactcttctctcatgcaggaaaatccgtcttgaaggcagctcctctctgtgccgggggtgggtgatccagcctaagctagaatggcggcaagctcaaggcagctgtggccctcaggagagcgtctggagtccacagcacagtgggaagcgcaacggcagctagtctgagggtctggacgatg

SEQ ID NO: 115177 - DNA, 266 bp, Homo sapiens
attaaccattgcttaagttgttacaggtgagacagccaaaattgcctgagcgtgcacagtggaaaaaagctttaacgttttaattgttaccaccacgagcctggcaggccgactgcattggcatcacctaggactagataggaatgccataaaagcttgacccacttccagatcagggagacatttgagcattgcttcctgtctctgtgccaattgactttttttgggggcggggggtggagtttcactctgtcgccaggctggag

SEQ ID NO: 115178 - DNA, 710 bp, Homo sapiens
catcgtttttaatataatagaagaaatgaaatacaaagtcgaaaaatgagactggaaaagcccaggcactggcattttgtgttgtgctaagtgttccctcgtcaccttgcagtccgctggcagaagtgtggagcggacacaggagaaggctgggatggtgcttggaggctggggaacaggctgcactggcatttccagtgaagtgacttgggacacacttcctctttctgcctgaaaaggactgagggtgaggggccaccttgtcccgccctgggttgatccctcccagatgcccacatctccagggctgtgtcttcagcccagctctcgctcctgcctctgggcatgctggctcctggacaccccacatggattccctggatatctccaactcctctgctctataatgcccctgagcgtcttactcctcccccttggccgtgcctgtcttcgcagccccacaaaatatttttttctaccagtgtctcttacctgaatcagtacttcaagctgcccactcattttggccagaaacctgaattgcccttgagtctttctactacctcacctctgcaccacatcaatcataaatctcatgtactctctttcctaggtgtcttggtgtttcggaggtttctctgcaatgctgcttgcctagcctcagccactactatggctccttattgcacccatgttcactctgctgcccc

SEQ ID NO: 115179 - DNA, 327 bp, Homo sapiens
ttaaactctgttggacaagaggagctttccacagcttgggctgagaagccttgccctagaagtgctgttctgactagattgtatgaagggagtgggtgcaggagacaaaatggctaaaatgaaaatgggagccactggtgcccatctgcagctacagctcaagatgcctacagatgtggtcagtgtgacatgtgcaggagggaggggcagggggacgcgatgggcagggagggtgctcctggggacagtagcctgcccgctggcctttacttcttggccttaccctgggcagccacagcttccatggctttacgcatggtctcttca

SEQ ID NO: 115180 - DNA, 86 bp, Homo sapiens
tgaccatcatgagcctccttaacaagtccaagagtgagatgaccccagaggagctgcagaagcgagaggaggaggaatttaacacg

SEQ ID NO: 115181 - DNA, 604 bp, Homo sapiens
ctcgaacatcagactccaagttcttcagcttttggactctcgcacttagaccagtggtttgccaggggctctcgggccttcggccacagactgaaggatacactgtcagcttccctacttttggggttttgggactgggactggtttccttcctcctcagcttgcagacagcctatcatgggatttcaccttgtgatcgtgtgagtcaattctccttaataaactccccttcacatatacatctatcttattctgtccctctagagaaccctgactaatacatctagcattaaaaaaaaatgcaagtgataaactgggaaataatattcataatatatatgacagattaaatgtttgttattttttgttatattatttatgttactaccaaaatggcaaaaaaatgaataaaaataatacaaaattataaacagaagaagagacaatggacaaaggaaataaaatttttgaaagatggagaacaggtaaaaagatcaacagaactgaaaactcaagcatcaagtaactgtgaaggaaatgccagtgagaagcaagccaacccttgcaaggcagcactagaaagtctaggcatgggaagtactag

SEQ ID NO: 115182 - DNA, 542 bp, Homo sapiens
cacaatgctgactcaaactgaagaagatagattataaaaccagaatgcccgttttaatttacaaagagaaatataattgtcaaggggcgctaatattattgccctttgatcaacaccttctctacttgtaaaggacaattccatgaaaatccttatcttgtcagaaggttgcaagatgagtataaatacaggacttgacatgtcaatttattcagagatataatggccacatgtgtctacacagtgggatatgccggcacagtctctctcctggccgccctctgccccaaggtcacccttgctcctcttctcccattctcccttggatgcatcctccttctcctccttgcaggcttcctccagcaccatgaagtgctaagagtactatgtcctgaggtaagggcacctgcaacggagattgtgaagagaagactgtgggtttctgtggttacaagcacaactctgggtcaaaaacccattccaagtcctcagaggggcaagtcccttccattcagtattaatatagctcatcagtgcctctg

SEQ ID NO: 115183 - DNA, 309 bp, Homo sapiens
aaaatggcggatgtgaaagtggcagatatgaaagtagcggatgtgaaaatggtggatgtgaaaatggtggatgtgaaaggcgcatgtctcaggcaagaaggaaagcagagacctggtgcagtaagatggatgtatatccttccatgggaatactgccagcttccttccaggccttgcccctaaaagttaatctgggaagtgcaagactgtataagacccatgtctgttactcctacaagttcagaaaatacacgtgtacaagttactggcttcaggtgttacttgccaggtgattccacagaatcctag

SEQ ID NO: 115184 - DNA, 702 bp, Homo sapiens
catcccacatgttgttttctaatgtgacattgtcattctccatcaagaaatggagcctattttgccctcacttgaatctgggcttctgccttccatccttggggtgcctcctcttggaagttcacagccatattagaagaacaaatgccctgagaccaccatgctgtaagggggcccaaactagccaggtgaagaagaggccatgtaccaaagctctggacatgtgactaaagccttctggaaccgtctgtgccaacatcacccatcagctgaagggagtcaaggaagagatccagtcaatactagatggaacagaagaactgccaagctgagccctgaattcctgactcatagaattgtgatgaaataaaggttgttgtttgaggaccaaaaaaaaacacacaaaaaaaaaaaaaacactttgtggtgggcgcctctgggccctcagaaaaagtttgcccgacaaaacccactcggctttggatgcgccggcgaccaccaataggtaatgccggcacaaggtcgtccacagcactggttccaagaagcaaaatccgctggaccagacaagaggccggggattccaccaccgataaaaaacgcggggtggaaaaacgaggggtttctgacacaaatccggagaggggttacgggggcaacgcacgggcataacaagaggagtccgcagagaagtcaatatca

SEQ ID NO: 115185 - DNA, 794 bp, Homo sapiens
atattaggctatgttcagggatcagggaggctaattatgcttatattgccttgtagcattttggtaagaattaatgattgtgtagatgtccagatttaggtcagcaatattctaaaagttctcattgaactaatcatgtttataagtagcctgtactttctatcataataacaatagtggaaaagctagttgacataaaaggagcccagattttacttaagtaaaaacacaaaagcaaagatattttcccacataaattacaaaagcaaagatattttcccacataaatgtccccataaaacaagttgaaccaaagaggaaagatgacaggtaaccgtatgacacgctaagaaagtatcataatacttaagttaacttcaaccttttatttccttatcctaagcagcctcttttctctttatcatttagtcctgtgcttctcaactttgataagtaaaaaagttattgcactaaataaatcttattgaaatgcaggatctgattgagtgggtggggtagtgttctcattgttcagttcccacctatgagtgagaacatgcggtgtttggttttctgtccttgcgatagtttgctcagaatgatgtccttgctcactgatggacatttggttggctccaagtatttgctattgtaaatagtgccgcaataaacatacgtgtgcatgtgtctttatagtagcatgatttataatcctctgggtatatacccagtaatgggatggctggctcaaatggtatttctagttctagatcctagaggaatcgccacactgt

SEQ ID NO: 115186 - DNA, 785 bp, Homo sapiens
gagaaagtgctaagcaattggggattacacggagaactaggcccacagttagagggtcaggtctttgggctacctgacctaactttttcgccgtaaaaatgttaagcaaaaatcgaagtccgtcaaagtccgttccattaaaagcatgttaccagagcttgagccacagagaatctgaaaatccaaccttgctcctctttgagctgtaagggagagcctctagtgtaacagtgtcgagtttaatagttaaccagtgaagagaaaaatcttaatctagttcatttagagttagttaacgttacttggctagggtttttatcttgcttggattatgattaaattttaattgtcccactgagtccgtggataggcatatttgtagatttgctgaacacctggtgctagtcttttacgtttcaggtccctcggttcctgaatggtaatgactgaggtgctgttgggtccgttgagtaaccttgtggaagaggtgtgttgtagaatcgccccagggagttagtgacctttctcctttcttttgaagtgattggatggttagaactgatccataacagtgtgtgtccgagtagggaggataagtcttactataaagtgggtggcctcagttcttttgttagtaatatttttaggccactatggagagtcatggtataatcggaacccattgtacaacaatcacatgcaacttgcagattgtttgtcctgtgtcccggagcaaaaatcccattacataacctttgacttatgtatatcccaaagagcagata

SEQ ID NO: 115187 - DNA, 625 bp, Homo sapiens
taccagatacattcaccctaaagtcagggacaaggcaaatatgtgtatctctctgctgtttcttttgagggtattaaccactttaagacagaggggtaggaagaaagttagaggcataagaattgaaaagtatatgtgggagaaacaagtcaattaagaaaaattgaatttacaaaaaattcagtgaggtaggatgtaaaatttacaaagttagtagcttttcatataagcttttgataagtagcttttcatgtgggcaatcagaagatacaatagaaaggaacacccatttattatagcaacagaaagacaacataggagtaaatgtaacaagaaatgttacagtggtgaccttgtattgcagtgttgtgtagtgtaaggtaagattacagttttctgttgttccaaatttatgggagaaaaattttaaaatacttgaagatacaaaaatgtacttgaacaagcagagagatatttcatgtccttggatgggataactccacatcataaagtttttggttctcttcaggttacttttatgctaaactaattataaaaatattaagtttttttccagaaactagacaaattgactaaagtatattagggttgagagtgagcatgt

SEQ ID NO: 115188 - DNA, 842 bp, Homo sapiens
gaaacagaggaggacggaaggaataaacgaaagaaataaagagaaagaaagaaagaagagaaaggaacggaaggaacggagtttaatctactgagccaataagagcaattgcattttgcatactttatgcctgagttgagagagaagagtccaggaattcagtgggcttcaccttccttctttctctttctaaaaaagaaaaaggaaggaaggaaggaaggaaaggaaaggaaaagcatttatggaatagcctattaagattttggagacataagttgtgtttccagtgaaaatttagacatagacccttaagttatcaatttccttagctgcaaattgagggtattgtctaagggtgagttttgggaagcagccattcctgacttggggaaaagaggatgttggttctatgggctaaatggtcagcacccctctcctctccccactcccagtggaaactgtgcacatttcacctgaaggcacatatttctcaggttgacatttctgctacagtgtattagtcagggctctgcagagaaaaagaaccaataagatgacatctatataagatgacatggtttggctgtgtccccacccaaatctcattttgaagtgtagctcccataattcctgtgtgttgcaggagggacccggtaggagttaattgaatcatgggtttttccggtgctgctctcatgatagtgaataagtctcacaagagctgatggttttatgaagggcagttcccctgcacatgctctcttgcctgccgccatgttaagatgtgactttgcttctcctttgccttcaaccatgattgtgaggcctccctagctatgtgg

SEQ ID NO: 115189 - DNA, 762 bp, Homo sapiens
gacagaggagaagaaaaagctcaaacgacatcttgctctctttaggtctgaactggctgagaattctcctttagacagtgggcattaattataacaatatcttcataattaatgcccttcagattgtaacccaaagagaaaattattttgagcaaaggtcaaatactctttttattcttaagatgatgacaagaagaaaacaaatcatgtttccattaaaaaatgacacgaggctagtccaagtgcagtgatgtttacaaccaattgatcacaatcatttaacagatttctgtgttccttctcattcccactgcttcacttgactagccttaaaaaagcaacatggaaggccaggcacggtggctcatgcctgtaatcccagcactttgggaggcctagacgggcggatcacgaggtcaggagatcaaaaccatcctggctaacacggtgaaaccccatctctgctaaaaatacaaaaattagccgggcgtggtggcgggcacctgtagtcccagctacttgggagcctcaggcgggagaatggtgtgaacccgggaggcggagcttgcagtgatccgagatcatgccactgcactccagcctgggcgaaagagcgagactccccgtctcaaaaaaaatttttttgaaaaattcgtaaaccatacttttaagattatttcagtggatttttaaaaatcttgtacagaaatcagggttcttagctagcagtttttctcccacgcagtcactgtaatgtgacta

SEQ ID NO: 115190 - DNA, 470 bp, Homo sapiens
tatgttctctaggccttttagaaaacatggagttgttcctttggccatgtatatgcgaatctgtaagaaaggtgaaattgtagacatcaagggaacgggtactgttcaaaaaggaatgccccacaagtgttaccatggcaaaactggaaaagtctacaacgtgacccagcatgctgttggcatcgctgtaaacaagttaagggcaagattcttgccaagagaattaatgtgcgtattgagcacattaaacactctaagagccaagacagcttcctgaaacgcgtgaaggaaaatgatcagaaaaagaaagaagccaaagagaaaggtacgtgggttcaactgaagcaccagcctgctccacccagagaagcacactttgtgagaaccaatgggaaggagcctgagcagctggaacctattccctatgaattcatggcataataggtgttaaaaaaaaaaaaaaaagacct

SEQ ID NO: 115191 - DNA, 458 bp, Homo sapiens
tgagcccaggagttcaaggatgcatgcagtgagctacaacacactactacactccatctggagcaaggaagcaagaccctatgagaaaggaaagaaagaccgtatcagaaagcaaagacatagagaacaaagaagagaaagaaagaaaatatactagtgggactcatttaattggtcccatgaattgctctaaaatagttttacataagaaagacaatttgctttacataattctactggataacaaaataattggtggaccaatacaagaaaacaggtggtatgtgtgttgcctaagtccaatagcattttttttttttgagatggagtcttgctctatcgtccaggctggagtgcagtggcacaatctcagctcaccacaagctacgcctcccaggttcaagccattctccggcctcagcctcccgagtagctgggattacaggcgtgcaccacca

SEQ ID NO: 115192 - DNA, 396 bp, Homo sapiens
gtgccttgtgattccaagggaccatctggaaggagttccaccagccctgtgtgcctttcccacagttctagagttttaccaggctcagaatttcagtttttattattaaaatccctctggctcctatttgcctttttgaaggtgcctgttccagactacaagtcagctaaagccaaaagccacaggggcagagcaagacccgaataagcgcacgtcatccagggtgagcgaggcctactgccccatttaagctgccacctcagtgaccagcaattcccctgggaggaactggggacttggctaatggcaacccctggtccctggacacagggctttcttcccaggaacaaaaggcaggtgagatacaaccagcacccgctcacaggcacgaggagt

SEQ ID NO: 115193 - DNA, 606 bp, Homo sapiens
ggaagagtgtgtgtgtctgtgtgtgtgttcggggatggggggtgtctgagcttttgggtcctggaagacgtagaggaggcaaggccctccctccccatcaggctttcctcccaggagcagcagatcagcctcccagactccctggtagcatggccagccctgccctgggcaaccaggagttctgcctggtagaccctgcaccccgttaggaagccagtggggtggtatgttcatttgccccccaccatcactagtaggacacctgcaccactttctaccacattctctgggaccatcagagtacagatataccctcccattcagacaaatccaatctatgggaacttggggctgctaaacaagacatatttgggggataattattcaacttccctcaaagataatagaaaaagtggtgggtgtgttggctcacatctgtaatcccagcactttcaaaggccgtggcaggtggatcacctgaagtcaggagttcgagaccaacctgaccaacatggtgaaaccccgtctctactaaaaatacaaaaattagttgggtgtgatggtgagcactggtaatgccagctactcgggaggctgaggcaggaa

SEQ ID NO: 115194 - DNA, 426 bp, Homo sapiens
tcccccagcagtgctccaaaagcccaagggctactcctggttcttctccatccccccttagaacctgggattgtgtctctgcctcaaggtcagactccccaaaatgctagacagactgcactgtctctcagcagagacattgaatctgctatgtctccagggaactcaaccacaaaccacaacctctggaacagagcaggacacacagaggacagtgcagccatctcctcacccagggcaggtgttggtggatattcccaggtcattgccctttgtcaaggccctggatgctcaatacaaaggcctgcatctgggcagtcctagcctgctgtggaaaggtcattgcaccccacactgaggttgagaccccctgtgtgtccccagaaagagcttgtcattctgagatcccacagatctgtgcttctc

SEQ ID NO: 115195 - DNA, 419 bp, Homo sapiens
tcagaacaaggcctggcacctggagtcttatgtctagctactgttatgaagaacttaagggaggcggaaggatctcttgaagccaggagttggaaaccaacttggtctctacgaaaataaagatggacatagattagatgaatagaaataaaaaattagccgagcgtagtggcgcacgcctgtggtcccagctacttggaaagctgaggcaggagaatcacttgagcccaggagcttcaggctacacagtgagctaccactacactgaggcctggtgacaaagcaagacccagtctcaatcaaacaatcaataaaagggaatttaaaaaacgtttgcgtttgtgggtaaaaaaccaaattagacatgatttctaggtatgaagcaacgtggtgggagactgaaagtctaggtaaactgg

SEQ ID NO: 115196 - DNA, 368 bp, Homo sapiens
ctataaaacacctcccaggcggttgatgctttagaatgtactgtctatcccttttgtcttcagtattatctaaaagaaatgcttgttttgtacttggccctacttacacagttcaaggttaaagttgatttggaaaaattaagttctgcaaagaaaagctgtcagagtgaccataaatttatgaggcctattcaaatagcctctacccagtgtcttttgagtaacctttaaggctacaaaggactaaagggccttaaaaatcatgtctcttctttgccccagttcattttcattattttgctttgtttgatagttaacagagggttaccttgctggagtgaaattttgcctaaaaggaagcacagaag

SEQ ID NO: 115197 - DNA, 461 bp, Homo sapiens
catcactccgtactctgcttccgtcctcacttgaccttctcacctaccttcctttacgtcatcttccttctgagatgctctgtgtccaaattttattctttgtaaaaggatgccagtcattggatcagagaccaccttaatccaggatgacttcatcttaactaaattacatctgcaaagattctatttctaaataaacccacattctgaggttctgggtgggcatgctatttggcaggacaaagtcaacacaggacactcattttcaggattgatcgcatggtttgaggaagctgatggtgacatctcttcttaaatctgttttcaggaaaatcatactggtagccttcaagtggccatggtgggagcattgacccagggaaatccacatttcccaacacatgctggatacctgaggactccagagctactatctgctcatatctgctcaacattaaaaa

SEQ ID NO: 115198 - DNA, 409 bp, Homo sapiens
aagcgaaacactatcattcttcctggcagtgagccctatattttcctccaatctgccaggggcgttccttttgggaaataaaacccattttattattttttattattttgtataattattctgtataatttttctgtattattctgtattgctttataattattctgtgtaatttttaatgttttaagataactctgaattttttgttttatttttaaaatgtgcaaaagcctatcatgcaaatagatattggaaatcagaatattcaaaaccagaggtggtttcatagacgggatgggggtggtatgggtggtatggccatagacaagaagtggtttcatagaaaccttctggtctcaaatgaagaagcgacgtaacaatgatacaggctacagtgagtcaaatttgt

SEQ ID NO: 115199 - DNA, 557 bp, Homo sapiens
  misc_feature (500)..(500): n is a, c, g, or t
  misc_feature (550)..(550): n is a, c, g, or t
aaggtcttaccattcgtccaggccccaaattcaaacaccctcaatcgtttctgcttcctctttctgccttccagtcgggaggttctgtttagtgctttcttttcttttgcatccaaattcacatctccttgattcaaatccttcccataccttacctcaactgggtgatggcatcctactcccggtctctcctactcttgccggggcctacaccattctactcaaaaggtcagatcaatctttacaaaagtaaaactctaaccaatccaccggtccacttaaaatttttcaggctgggcgcagtggttcacacctgtaatctcagcactttgggaggtcaaaggcaggaggatcacctgaggttgggagttcgagaccagcctgcccaacatggagacactccatctctactaaaaatacaaaattatccgggcatgatggcgcacgcctgtaatcccagctactcaggaggctgaggcaggagaatcacttgaacctgngaggtggaggttgcaatgaggcgaggttgtgccattgcactccagcctgngcaacaa

SEQ ID NO: 115200 - DNA, 284 bp, Homo sapiens
gtcatttctgcttagtcttctccaatctgtgacagttcctcagcctttccttgtcttttgtgacattgatacttttcaagagtactagtctactgttttgtagaatgtttctcactttgggttttctatgattatattgaggtaatacatgttgacaggaataggaaatagcacagaagtgatcttgtgcccttcatagtgcatcctaccaggaggtatgtggtattgatttgtcttgttacctgtgataccagccttattacttggttcaggtgaagtctacc

SEQ ID NO: 115201 - DNA, 104 bp, Homo sapiens
tgaaacctctctggggttagtttctgctgaccccaggatcagtttctgctccttgccagccctggagaagccaacagtcaatgctcaatctccttgtctttttt

SEQ ID NO: 115202 - DNA, 736 bp, Homo sapiens
acaagagcaaaacttcgtctcaaaataataataataataataataataataataataataataatctacaatgtcatttcccatccaagcttgacttctacctttactttctgatatggttttgccatgtccccacccaaatctcatcatgaattataatccccataatcctgatgtgtcgagggaggggcctagggggaggtgattggatcatgggggcagttatcctcatgctgttcttgtgatattcagtaagtcctcatgagatcttatagggttttgttttgttttttgggatggagtcttgctctgttgtccaggcaggagtgccatggcatgatcttggctcactgcagtctctgcctcttgagttccattgattctcctgcctcagcctcctgagtagctgggattacaggcatgcaccaccacacccagctaatttttgtatttttagtagagacaggatttcactacattagctaggctggtctcaaactcctgacctcagttgatccacctgccttggcctcccaaagtactagggttacaagtgtgagccaccgtgcccagctgagatctgatggttttatacatgtttgacagttgctccttcacatgttcccactctctgtgcggccaccatgtaagtcggacctgcccttctgccatgattgtaagtttcctgaaggacttccccctctgccatgattgttaagtttcctgaggcctcccc

SEQ ID NO: 115203 - DNA, 454 bp, Homo sapiens
gtcacccgacggggtgggtgaaggtagtaatgatggtacttttcaggaagaaggcataccttgagcaaaggtacagaggtgagaaacagcctggtttttgcagaacaaacaaaacacaacagtctgctgtggctagaagataaagcttggggcagagagtgtgggatgtgctagtgtgttatgtaacggatctcaacctaaagggcaggaaatcaaacgcccaaatacccaagagagtcagggaggtaatgaaaaggagcaagtgaggtgaagtacatgatccactgaaaacttcaactctaggcatctggggatgtgtatcagtggggctagattctctcatttttctttttcttttttctttctgagacagagtctcactctgtcacccaggctagagtgcagtggggtgatctcggctgactgcaacctctgcctcccgggttcaagcaat

SEQ ID NO: 115204 - DNA, 110 bp, Homo sapiens
atgtgatctcattggttccaggtccaacctgcttcaaagtctaggctgggtccctcgcaccaagctgcataccagggcaaaggctggtcttggctgcagcacaaggaccc

SEQ ID NO: 115205 - DNA, 136 bp, Homo sapiens
aaaatgaacatttttacacattatatttcatgagttaaaaggctgtacttattgggggacacttgggataaggaggacatatcaggaagctctatgttgtgatgtctgaaactggccttaagagctgatttttgag

SEQ ID NO: 115206 - DNA, 336 bp, Homo sapiens
aaaagtcctggaatgtctttcaaactctgggtgggaattactgtttacaagttgtcagccagtgtcactaggtgataattcccctctgtgtgagtgtcatggttacagtatgcttttttgcctctaaaagaacaattatattcaagaaatttcctagtgcatttaaaaacagctgggtgaaagtcattttaaatccccaaatccaacacattcgttcttttgtgcatttaattaagcagaagttaaaataaattagaacaggagacattcagtgctgattgttgaatcaacaaagcaagaaacagcctagcattaccctaccacagatgtctgtca

SEQ ID NO: 115207 - DNA, 315 bp, Homo sapiens
cgtgtaccaccacatccagctaatttttgtaattttttttgtagagacgggctttcaccatgttggccaggctggtcttgaacttctagcctcaagtgatctgcccacctcgccctcccaaagtgctgggattacaggcatgagccactgtgctcacggcctgaaccttttatttagagtggtaaatataaagtgttactgtgaactgtaaagcataaattctcttgaaacagaggtttaaatctctttctatatgttgcattctttctgtgcctattaattttacttttgctatttttcttttttaaaatcaga

SEQ ID NO: 115208 - DNA, 314 bp, Homo sapiens
ggacagaggcagccccatgacttgagtctagtcattcgaggggccaggccctggggatgggaatccgttcctcctctctctccccttcctccttgggtgaatcaaccaccacccaggcatgagtcagccaggagtggctcaggcatgcctaggccacctgctggtccccctccctggatgtcccaaccagggtgtcccagccaggtttaagatctaaggaagccaggcgtggtggctcacacctgtaatcccagctacttaggaggctgaggcaggaggatcatttgagcccaggaaacatagtgagacccctt

SEQ ID NO: 115209 - DNA, 243 bp, Homo sapiens
caaatatccatctgattcataaacttgccttgtaattctcctgccattggtccttcagcttctgtttgtgcacaccagcagctggaaactcaccagttgaatgatatgcagcctggggacaactgagactttccttgcactcaacttctacatcctggatttagataatgtttgtgtatctgagtctaaagatacattatcttctcatcccaagtgaacagattgggaaaaatggtcaaagag

SEQ ID NO: 115210 - DNA, 371 bp, Homo sapiens
aaatcagggagtcttgggtgcttaaagccttctagttatcttgaaaaatatagaatcttcttatattgccttcatttggcaaataaaaggattatgtatgcagtagacttaatgttttgtgtgaaatgcagtatcacttactttgaaaagcaaaaactgggccgggcgcagtgactcatgcctgtaatcccagcactttgggaggccgaggcaggcagatcacctgaggttgggagttcgaagactagcctgaccaacatggagaaaccccatctctattaaaaatacaaaaaattagctgggcgtggtggcgcatgcctgtaatcccagctcctcaggaaggctgaggagaatctcttgaacccaggagg

SEQ ID NO: 115211 - DNA, 713 bp, Homo sapiens
ggaaacgaaaactgcccatactcttaccactggcaagcacttagaatatacccttctgctcctttttctttgcatagataatataagtgaatgtttttcgtttattaacaagtttgcaaactaacaatctttaaatctagcctgcataacaaataaaagtgtgtttgtttaggagttttgaggcaatttgatattatctacaggtgcattttgtgtgttttttccctccaagtctaagaagccatattactggtatctacaactctgaaacacttgtaaagtatttgacagtagcattttgttctttaaatcctattaaaggattttggcatttcagaagctttcaaacaggaaacgtgtctcccagggaggattattcagcactatttgaaaaatgaaaagtgaaagtgaaagtgagataggaagatttaggccttttctgaagctgcagactgaatgtggagttttcttccttaggcaataactgtaacctgaatatttatttatctgtctaatctgaatgactctggttcagctagataagattagagtattaggatttttgtgaggtattttaaatagcttactgtcaaaatattcactagaatttttgctttggcaatcattttaattttctctttttctttggaagtggaatttgtttactttttaaagtgattaatattctcagttgattttctattctttcttga

SEQ ID NO: 115212 - DNA, 272 bp, Homo sapiens
cctttttctgtcacccttccgtcccagacctaaactttccaagtaagaattcaacttctgtgcaacaccagagtcctcatggttactgcatcctgtaacacctctaagaatcatacataaaggggggactgcttgctccctttctccacccctcctctctgtctctctctctctctctctcacacacacacacacacacacacacacacacacacacacacacacacaacatgaggacactgggtctttgcaaacaggttctactgtccagt

SEQ ID NO: 115213 - DNA, 234 bp, Homo sapiens
ggtcttgctctgttgcccaggctagagtacagcggtgccattagggctcactgcaactgctgcctcctgggctgaagcgatctccccagcagcgcacaccacgacgcttggctaattttttttttttttttttttgagatggagtttcactcttcctgcccaggctggagtgcaatggggcgatcttggcttactgcaacctccacctcccaggttcaagcgattctcctgcct

SEQ ID NO: 115214 - DNA, 301 bp, Homo sapiens
ggaaccctcgaaaaaaacttccgggtgtcctacctgccccacaatagccagatcattagctcctctggtagtgcccctcaagaaattcccaacttcactgttgcccctgcaggaaatgcccaatggtgctactagggctcaagtttcctgctcattgcaggaccttaaacaaataaagggggacctgggcaggttctctaataaccctaataaatatatagaggctttccaaaatttaatccaagtgtttaatctaacttaaaagatgctatgctacttctaagccaaaccctattgcaaa

SEQ ID NO: 115215 - DNA, 600 bp, Homo sapiens
tcaggcacactatgtgtgctatatatgtgttcacatccaagggtcttttggattccagtagttattacaactgctggggaaaaaaaagacccgcccctgccttcttctaaaagaaatgtattaatagaaattttatccaagttcaccaactatacaaaaggatgatgaatgcacatttttttggggtcctaacagttttctgctggctgctttagcttcatgagaatgacagggataggaaaggacagagatagcttcatctggaagcaaaggagctgagaactagaaattgtctcaagttctcaggaaagcaaaactatgtttggaaattattgataaataatgtgtccatgtcatataataaaaaatgaacattttctattttaaaacatggataaaatatagtagttgtcccacaagacaacttcaaaaaataatcaggaataacagcatgcccactgaataagatgaagagcctggtatggtggtatgcacctgtatttccaactattcaggaggccgaggtggaggattgcatgagcctaagagtttgaggctgcagtgagctatgaaaatatccactgcactccaacctgggca

SEQ ID NO: 115216 - DNA, 256 bp, Homo sapiens
ggccaggctggcctagatctcctgacctcaagtaatccaccccccttggcctcccaaagtgctgggattacaggcatgagccaccgcgcctggcctctaattctttagttataaaattgctctcactagggaagagggcagaagaggatatgccgtcttgtgctttcaaaacatcaattatttcaggaagtacagaatataatgagagtaaacattttggcgagataggacagctgtctgcatgtttaaagaaagg

SEQ ID NO: 115217 - DNA, 297 bp, Homo sapiens
ttgaccatttccacaaggattttgattttcttttacttattagtcatataaggcagcagctaaagtaaggtgctgttttaatatgttggggatgaaaatttttgcaatggaaaattactgactgagcattaaaataaatgtaagcattccacatgacattttaaaacactgaaacatgggtatatttgatttatgagtttctaaaggagagtaactatggtacagtggttatagtaaaggcattaccaaaagtcaagtgccattgaagcttctagaatacagtttggttggttgagt

SEQ ID NO: 115218 - DNA, 503 bp, Homo sapiens
aaagccaagacttgttaaaaaggtttgaagaggaaggaccataacaattgaaagggggaaattataagatacagtaaattcctcttcaaagatttagcctgttgacttccttattctttgttctcaaactcgacttccttgttgtccatgcctccttgtccctagttactgtgaacaaccttcccaccagttctaatcaataactcacatctgctcccttggttacccactctgcacccattcttcccactgaaactgcacttcccaccactgtaactcacatcccccttcccttccttatttggaaaagtattcacaaatagccaatcgggtcaacttagaatgagcggtccaaccccagcccctgggggagtgacacagaggtagggactgtgttagggataaaaaccttttccttcctttgttcagtgtgctcctgtgatcatgattgatgcaggcagcacccttctgcagaagtaaattgccttgctgagaaaaaaaat

SEQ ID NO: 115219 - DNA, 849 bp, Homo sapiens
cttaactcaggcctcacaggtctttttgaaagccagaagctaaagtggcttaagagaaagctagaagtattggggtagtggtgttcccacttcagggtgaagttgtcaggatgtacctgttttatgattctagttcctttgattggcagtccttgaactaaattaaaaacagagaaaagttcatatgatttaaactcatgatgcttctttgtgaaaagggaaaatgagacatgttgttagccccagcatctcttttgagatgggggttttactatgttgcccaggctggcctcaaactcctggattcaaactatcctcccccgtaggtggaattacaggtgcatgctaccgtgcttggctatgggcttgtttttaattgttggacggtctgggtgcccctttcactttattctttttttccgctctcacttttttttcctctcacttattaagtctttgtcctctttaagtcctcttctaaaagactggaattgcaggttacatttatacctaaatcttcctatctaggtaaagagaaaatatactaaattccatagaaagcaggtaatttgtccacaggacacagagctgatcactgtggaagatccctccaatcacatcttcgattctctctccctctttctttaccttgcctttgctctcttcatgtgacgtgcctgctcccccttcaacttccaccatgattgtaagattcctgaggactccctagaagctgagcagatgccagcaccatgattcctgtaagactgaagaaccgtgggtcaattctacctctttcctttataaattacccggcctcaggtatttctttatagcaacgcaagaaca

SEQ ID NO: 115220 - DNA, 739 bp, Homo sapiens
cactacttcctagttttgtaaccttggaaaaattattcaactcctttgtgctttagttgcctcggtgaaaaatggggataatcatagtgctgccttatagggttgttgtaataattaaatgattatcctgcacatagtaaacagtcaatgaatttatgctattattattagtctgctatttgtgggctttcatattttgtctcaaatccaaccttctctttactcactatttctaaacacattgtgcatttttcaatatatatgcatttcaatatctatcttttgcttcctctgcctgtaatacccttttctacgccctatctctcctgtgtctttagaaattctatcagttcttcaaatgaacctcaaatagacttcctccacgatccttcacctatcataccaggattgtttatgtttctgaaatttcacagcctatcttatacttttcctgtttacttgattcatgttggcttagtttaattacacacgaagaaatcttgtgttgcctgatggactgtaaactccttgaaaacagggtttgtgtttattttttttgtattctaaagtaacaaggaaagttctccaaacataaatgtaataggtatttgttgaatgaatatagaaggaagggtgtaggttttggataagaaatcatcattatcaaactagtcaaaaatgacaagagtattgttttggatgcataagtatagaattagtacctctcactcatccccca

SEQ ID NO: 115221 - DNA, 311 bp, Homo sapiens
ctccgtttttcctgtacctggaggtatcaccaccgaagtctgcgaaatagcaaagatggcagcctgccccttcctctggaagctccatcccggggggtacggacctgttgccaggccaaatgcagttgtaagaggtacctgaagactttgtttgggaggtctcacccagtcagaagaaaagtgatctagtacctgcttaaagaagcagtctggctgctttttgatagagcagcatgcgtgttggggatctcttcagcctctgatcagattgagcaccccaaagcccacaagctggactggctaagatgctt

SEQ ID NO: 115222 - DNA, 375 bp, Homo sapiens
cacaatgcctggctcttaatatgttttcaattgctattcactgagtagtagttgtggaaaaaaattctatccctgtttgaaaccaaaagagagaaagaaaaaataaactaaagcaaaaccgtaagctagaatgacagggactgtgactatcttgttaactgtgatatccctgatgtctcctacaatgcacagtacataatgagtattgaaaaaatatttgttgaatgaaagaattaatgaaaatatctcagtttgaggactcagcctcagctcagtctttacgaacctgactggtatattcacacagtgacatattaggctgcagtcaaaacaaatgaactgtagtgacacaaaataatatggatggggccaggt

SEQ ID NO: 115223 - DNA, 232 bp, Homo sapiens
ggaaatgagcgcttctgtgagaggcaaagagaactcaatgcacactcatgagtgcattcacaggatttgagaatatgtgatttatcaagaccaccttgtagttagtggtgtaaattcagataaacaccataaattggaggtaatgagtggtgcctttctccaggcctggatgggtgatgggacatctacaggagattactcctgtgtggggattgcaagtgtcatttgcaaa

SEQ ID NO: 115224 - DNA, 584 bp, Homo sapiens
aacactaaaagggaaaagttatacctattaatttgctttattaaaacaaattggccaggtgtggtggctcatgcctataaccccagcattttcagaggccaaggcggaaacatcacctgagcctaggaatttgagaccagcctgggaaacatggcaaaccccatctctacaaaaaataacaaaaaatgctgggcatggtggcacacacctgtagtcccagctactgtggaggctgaggagggaggatatttgagcccgagaggttgaggttgcagtgagcagtgatcatgccactgcactctagcctggatgacagagtgagactgtctcaaaataaacaaataaacggaataaactaaactaaaataaaacaagtttcttaatttcaaattctttagtggctttttggtcatagagattataaatcaaatgtaaatggtatttgatttaggaaattatggttttatatatgtaatgtgctctgagaattaagaaactattaggaagagtaaatctcatcagtatgtagggagaaatattgaacctcagatggctagtagaaaaacaaaactatcaagagccat

SEQ ID NO: 115225 - DNA, 468 bp, Homo sapiens
accaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaatta

SEQ ID NO: 115226 - DNA, 261 bp, Homo sapiens
gaggcgcggcctgaggtgggcaggtgcagggggcgtgacttcatttaggggcagggcctggggctaggctgaagccggcagtgaggaccccgctctcgggtggaattggaggggacccgcggttgggcgcggcagggctcacagggacacccccgttctcctccccagggagaaagtgctcgtcgtgcacggcttcccgcccgccgtggcaacccttcgggtaaggaaggagaccaggcggcggcaggcgggcaagggctt

SEQ ID NO: 115227 - DNA, 321 bp, Homo sapiens
gggcgtggtggtgcatgcctgtaatcccagctactcgggaggctgaggcaggagaatcgcttgaacctgggaggtggaggttgcggtgagccgagatcgcgccattgcactccagtctgggcaaccagagtgaaactccgtctcaaaaaaaaaaaaagaaaatttaaattgacacctgggctcccattatgttcctatggggcagcacttatctggaaggacacgggctttgtaacgctaacctccagcagggcctggggctggggagaaggcgacagctcttgactttctctgcttctgtgttgaatttttttcatagca

SEQ ID NO: 115228 - DNA, 401 bp, Homo sapiens
tatacttctcaatattcttcaaattctctacggagatatgtattgcttttatatttttatactatgtcaccaccatacccgagaccttaccagtcacacactcacccccattcatattctatcacggtataatcttgagcccaggagttcaagaccagcctgggcaacacaatgggaccccatccctataaaaaattaaaaaatttggcatggtggtacacgcctgtggtcccagctactcagtagaatcacttgagtctctactcaggagaatcacttgagcctgtgaggtcgaggctgcagggggctttatcacagccccacactccagccatgggtgacagaggcaagactccatcttaaaaaaaaaaggttcgaagacttggaaagagatccccaag

SEQ ID NO: 115229 - DNA, 1062 bp, Homo sapiens
  misc_feature (927)..(927): n is a, c, g, or t
  misc_feature (956)..(956): n is a, c, g, or t
  misc_feature (958)..(958): n is a, c, g, or t
caacttaggctaggtacgaggcctgggtgtgaccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtacnccctccttccaagagccagtcccactccngnggggggccccggagccgtggggtctaacccggcccccggccgggcccccctctttcccgggcacgggcgaaccccgggggtctggcccggcgggaaaaacacca

SEQ ID NO: 115230 - DNA, 355 bp, Homo sapiens
ataaggggtaaaaagtcagcctccctccattacaggagcgggtgaggttcacgaaaaataaagaaaaaaaaagagctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115231 - DNA, 519 bp, Homo sapiens
tatcggaccattagatgctgtccagttctgctgtgagcagtagctctgaggagcctgctagatgcggcctggaaggtactggaaacccacaggggcacccataggccctcatctttgtgtcccatggagccggagagcacagtggccgctatgaagagctggctcggatgctgatggggctggacctgctggtgttcgcccacgaccataggccctcatctttgtgtcccatggagccggagagcacagtggccgctatgaagagctggctcggatgctgatggggctggacctgctggtgttcgcccacgaccatggtgagtgtcccagggtgccgtcagagctggctgggccctgacaatttggagatctccctctctagtccatctcactgccagcatccttctcaattcttctattccccacggatgtttcaaagtaaaaaaatgtagttatgcaaacaaacaaaaaaaatgtctgacgagcagattctgtagtctgagactgaatgcaggctga

SEQ ID NO: 115232 - DNA, 4611 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115233 - DNA, 4219 bp, Homo sapiens
cgcccccgccgcgagcccggcccagggataaagtggcggcgcagacgccgcaccctgtcgccgcgaagccggtcgcgcgcagctcgtcccggccctggcccgccgcaaacgaggatccgctgcgctcggggaacgcgacagcggcgctcgtggccccggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115234 - DNA, 4554 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcaagcaccacgcggtcgcgaggtg

SEQ ID NO: 115235 - DNA, 4694 bp, Homo sapiens
  misc_feature (4365)..(4365): n is a, c, g, or t
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgcaaaaaaaaaaaaaaaaatcagaaattggagaaatccttaacacaattttctaaaaaataacagacatttttgttatacattagactatcagacactggacctaccttaatggttagacactttatgcaaaaaaagagaanggtcccaggtgattttccacaaagaatggtgctaaagggtccatctgggaaaacaaagccaagcctctgccctgcctctcccagctcccacagggttccaggaattcctggggtccccaggacaccagagtggaaataagggaggcgcctctttctggccaccttcgtcaggcccaggccttctctgacagctccggttggggctcctctgaccggtgagagggggtggcgctccctaggggcagccccaagggatcaagggcctcgaggtagaaaggccgctctaaatgagagcccagattggggcctggaccggaccgtgcaggcgg

SEQ ID NO: 115236 - DNA, 4327 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgccttgtggctcagtcacatccctgcgtgtatactgtctgcggggcacatatgtatccatttagagctaaaggaatcagtgtacactacagctaatcctaataaatccgatgttttcggaa

SEQ ID NO: 115237 - DNA, 4257 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccagatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115238 - DNA, 4800 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgagctgaacaggagaaaatccttgtaagtgggagagatgcagactagattcagaaggatcttcccctggaaggatgcgagcaccaagagaatgccagaatttatacatttttctcctctgaaaccatacaaagggagggaatgggagaaggcggggagcgagcacgtgctggaaacccaccttttgccagttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115239 - DNA, 4368 bp, Homo sapiens
gtaatgaacgtccatttttttaaagcaatttgcttttcctcatgcaatcttctttgttttttaaagtgatacttacaataatttcagcagaagtgaaacttgggttgccaggtgtctgtacttttattaggtttgactgaccctgagctccaaacaatggaactagcactgtttgggaacttctgtaatctcacagaggacaacagatctaactgaatgttttcaagggaaaataaaaaggtctgttccatgttaaacctgggagcttttagcgtgaaggaactgagccgaaagatggtttaacgcttgcactctaagagagccaggattctaactgaaggtgcagaccagctgccccatctctttgcagagctgaacaggagaaaatccttgtaagtgggagagatgcagactagattcagaaggatcttcccctggaaggatgcgagcaccaagagaatgccagaatttatacatttttctcctctgaaaccatacaaagggagggaatgggagaaggcggggagcgagcacgtgctggaaacccaccttttgccagttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115240 - DNA, 3978 bp, Homo sapiens
agctttcaggctcctttaggactctgatctttcaatgatctgaagaaagctcatactgaaagggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115241 - DNA, 4689 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggactattcgaggattttgaaacacttgatggaaaaggcatcaagaatgttaaagttttggattccacgtcctttttgggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115242 - DNA, 4297 bp, Homo sapiens
cgcccccgccgcgagcccggcccagggataaagtggcggcgcagacgccgcaccctgtcgccgcgaagccggtcgcgcgcagctcgtcccggccctggcccgccgcaaacgaggatccgctgcgctcggggaacgcgacagcggcgctcgtggccccggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggactattcgaggattttgaaacacttgatggaaaaggcatcaagaatgttaaagttttggattccacgtcctttttgggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115243 - DNA, 4521 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115244 - DNA, 3806 bp, Homo sapiens
cagaatagggcttgctgtaattctctcctggaggcaggctctctctctggctctctgttcccccttccccaacctctgtgaaaccacttcaaggatggctcaagctgcgctgatccttgaggcgccaacagcctaagctgtcagcatcttctccagagcctggaagtagaggccttgtcactttttggtataaaagttttgggttaagaggtgccagcagcagaaacatatgttcaaggatgaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115245 - DNA, 2804 bp, Homo sapiens
  misc_feature (2475)..(2475): n is a, c, g, or t
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagatggcttctcagatatggcttgcaaaaaaaaaaaaaaaaatcagaaattggagaaatccttaacacaattttctaaaaaataacagacatttttgttatacattagactatcagacactggacctaccttaatggttagacactttatgcaaaaaaagagaanggtcccaggtgattttccacaaagaatggtgctaaagggtccatctgggaaaacaaagccaagcctctgccctgcctctcccagctcccacagggttccaggaattcctggggtccccaggacaccagagtggaaataagggaggcgcctctttctggccaccttcgtcaggcccaggccttctctgacagctccggttggggctcctctgaccggtgagagggggtggcgctccctaggggcagccccaagggatcaagggcctcgaggtagaaaggccgctctaaatgagagcccagattggggcctggaccggaccgtgcaggcgg

SEQ ID NO: 115246 - DNA, 3855 bp, Homo sapiens
tcaccccgggtcaatctcgggcgaattgggccagagcttggattaaaaagttctccggggtggttgaaagaaaatcaaaagttaaagccatggaaccacaagaggaaagtgtttctagaaggtgacagtgagcagcttatgaatgaccagcacagtgtcccctgccacagcaatggaggtccctggagacctcgccaggctagccaccgtgggttggcgggagtggaagtcggcttgggatgagctgaggaccccgtggaggtcaggatgtgaggccgggagtggaaccccctcttttgagaaggttgcctgactcagagacacagaaacaggtccagggatggggagagatgtggagtgagggaaggtttgcatttgagaaaggaagttcgagaacacactgggacattgtaacacatttgaaccatcttctgatagaaaggtgttggcctcctaataatgggaggtcagggccaggtcctcgggcatagggagagggtccggagaatgctgcagacccctgcccactgcccacggtctccgctccctgcacctgcctctgatggtgcagctctgattccgtgtctctcctcattgcagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115247 - DNA, 3526 bp, Homo sapiens
cactacgaaagatcgagaataaagatagagagcgagcggcgggggggggatttgagtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115248 - DNA, 3077 bp, Homo sapiens
atcgagctccgtgacccctccgcacaattagtccaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115249 - DNA, 3047 bp, Homo sapiens
ggctaggtagcgaggctgggttgaaatcggccgaggcttagcacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115250 - DNA, 964 bp, Homo sapiens
tcaagcttctaacgatgtacggggacatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115251 - DNA, 1421 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggactattcgaggattttgaaacacttgatggaaaaggcatcaagaatgttaaagttttggattccacgtcctttttgggtgagcaactcccctctgaggcttccctggtgtgctcacagctcaggatggaggttgtgggagagcaggagcagcagtcatctggtcgacctcgacaatgtgatccatctgggtgcgggacctgccatgactccttccttccccactgcttcctcgtcatgccgcctcaatggcccctgctcaaccgttctgctttccttcatgcacaatcaacccacttcctctgcttagctctttctcctcccatcctaccctttcctccttcaggagagattaggctcatgaaatcaaca

SEQ ID NO: 115252 - DNA, 1004 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatggtgagtgtcccagggtgccgtcagagctggctgggccctgacaatttggagatctccctctctagtccatctcactgccagcatccttctcaattcttctattccccacggatgtttcaaagtaaaaaaatgtagttatgcaaacaaacaaaaaaaatgtctgacgagcagattctgtagtctgagactgaatgcaggctga

SEQ ID NO: 115253 - DNA, 1117 bp, Homo sapiens
cgcccccgccgcgagcccggcccagggataaagtggcggcgcagacgccgcaccctgtcgccgcgaagccggtcgcgcgcagctcgtcccggccctggcccgccgcaaacgaggatccgctgcgctcggggaacgcgacagcggcgctcgtggccccggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctattgcttaccggccacgggggcctatactgcctctgtgaggttagcccaagaagcctgcaacagactctcagcgatactgtaagagtgcctacccggtactccaacaggagggtccggataatcaccacccgctaacgcaacaaacagtgggtctctaagcaagccgagaacagtgttccccatatagttgacgcccctatgtcggtgaaactcggc

SEQ ID NO: 115254 - DNA, 4867 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaaaaaaaaaaaaaaaaaaaaaaaaaaaaaaaaaaaaaaaaaaaaaacaaaaaaaacaaaaagggaacctacataaaacagaaaaaaaacaaagcagaaaaaaaaacaatgcaaatgagcgagaacaaaaaaccgataagaaaaagccttggggggggccccgtgccccaattcgcccttaagggggcgcttttaaaattaccgggccggatttttaaaaagcgcgtgggggcctgggctgttccccttgggttttggg

SEQ ID NO: 115255 - DNA, 4315 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtttgtgattcgtccccgacagcagcaggaggattgcccgggat

SEQ ID NO: 115256 - DNA, 4398 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115257 - DNA, 4367 bp, Homo sapiens
  misc_feature (4232)..(4232): n is a, c, g, or t
  misc_feature (4261)..(4261): n is a, c, g, or t
  misc_feature (4263)..(4263): n is a, c, g, or t
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtacnccctccttccaagagccagtcccactccngnggggggccccggagccgtggggtctaacccggcccccggccgggcccccctctttcccgggcacgggcgaaccccgggggtctggcccggcgggaaaaacacca

SEQ ID NO: 115258 - DNA, 4408 bp, Homo sapiens
cgcccccgccgcgagcccggcccagggataaagtggcggcgcagacgccgcaccctgtcgccgcgaagccggtcgcgcgcagctcgtcccggccctggcccgccgcaaacgaggatccgctgcgctcggggaacgcgacagcggcgctcgtggccccggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgagctgaacaggagaaaatccttgtaagtgggagagatgcagactagattcagaaggatcttcccctggaaggatgcgagcaccaagagaatgccagaatttatacatttttctcctctgaaaccatacaaagggagggaatgggagaaggcggggagcgagcacgtgctggaaacccaccttttgccagttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115259 - DNA, 4155 bp, Homo sapiens
ggctggagagttgcatgatccagctcaacgacctgtctgtctgcattaacagtagcctgaattatgacagtagtggctgtgctcccaaagggggttaaagtacttgagctatcccttctggaagcacagccccttttgaagacagaagatgctgactaattagcagttccagccgtgctcctcagtagccaagggaaatgcaggaaagaaatcccatcagccaatcccagaaatatcagggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115260 - DNA, 3232 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctccaggaaccaacgctagcctccagaacagggcctgggagagtcgagcggccgcgaatttagtagtagtagtagtagtagtaggc

SEQ ID NO: 115261 - DNA, 3452 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggccttgccatatgcaattgcatatggcaaggccaagctggagttctccatttacccagcaccccagctttccacagctgtagttgagccctaccactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttcctgagatttgatggaggccggaatgttgacctgacagaattccagaccaacctggtgccctatccccgcatccacttccccttcgtcctgccatatg

SEQ ID NO: 115262 - DNA, 4395 bp, Homo sapiens
ctccatctttctagtccccaccttccccggtgcagacacccggcgaagcccacccggttttcccagcggcatttccgatgacagcttcggggctacgtgtcctgtgctgtcggagacgcacaggaagcaaagtttgtgagaagccttgggggcgactttgccttgggcacccgcatttgtgcgtctgcgaggtgcctcggtgtgcgcggagctagtttcccagtttcccgggcccctcccttctccgagcccctctagcgatttgtttaggaaaagtgatgacatgaactagtagtggagaatcgcagcgccgctccccgccctggggagggaggggagccccggagagcctgccggtgggagctggaagcaggctcccggctgagcgccccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115263 - DNA, 3999 bp, Homo sapiens
  misc_feature (85)..(85): n is a, c, g, or t
  misc_feature (113)..(113): n is a, c, g, or t
gggactggaggcacccccagccctgccccaggccacagcaggacaggccgggacaggcctcacccaaggccaaggctggcatcanccaatcattcagagctgaggccctgggnctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgaccggccaagtccccacagagcacttctgtagctccagcttgtctccctggcttctctttgaaggagaaaaatgtaaaatatgcactgagaaagccagccccgcctgcctcccccagatgcatgtgatggcatcaccattccccaaattgaatatcagcatgcggcctgaccagggactctttagatgcatgaatttatttatatgtgggtctctcaaaggacagccacggcaggaactgcgtccccaccctgaatgcattggccggtgcccggctcatggtctgggggatgcaggcaggggaagggcagagatggcttctcagatatggcttgccaaaaaaaaaaaaaaaaaatcagaaattggagaaatccttaacacaattttctaaaaaataacagacatttttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctgtggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115264 - DNA, 1844 bp, Homo sapiens
caacttaggctaggtacgaggcctgggtgtgaccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgatcacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtgatggcatcaccattccccaaattgaatatcagcatgcggcctgaccagggactctttagatgcatgaatttatttatatgaaggctctcacagagacacacacagcacttcagtagcatttgcattcctggttaaagaatcaccaatatttaaaataaaaactttcctgaaattgggactgtcatgttatccagaagggctggtacatccgcccaccatgtccccctgctgggtcaggagccaacacaggaccctgcgtgtgagcgtgcctgacatctcacgcacggccactccagagccggtccctgtccttggaaagctgtgaagccttgcgttgagttccttctcgatactgacggctccgtgctgacattctgagctctggagtcacaccagcgcaggggcgtggaggaactgaggtttggaaggaatgccaggtctcgcacagcttggcctcgagaaggtgagaggaaggcaaaggccagggaggggacccagagaggcctggcacacaaggcccaagcaccaccgtcaacacagcccagtccatacagaaatgggtttcatgcctgaaaagctttttacagaaagatgccgcctgtagccagtgacagccgcaaccctacaggcctcagttccttgcagaggtgaggggtagagagtcagcctctctcccttccagcagcgacccagcttccctccacttccaggtggtgctgggctcaccaagggagcactggtgggtgctctgaaaacccacaggatcccacctccaggcccacctgggtcccatctcactctcttcttctttcaccaattgctaacatagaccttgttgggatcacgatggcttcacaagccagctgttgggtttgctatgtcactgtggctcagtcacatccctgcgtgtatactgtctgcggggcacatatgtatccatttagagctaaaggaatcagtgtacactacagctaatcctaataaatccgatgttttcggaa

SEQ ID NO: 115265 - DNA, 783 bp, Homo sapiens
agcaattgcaataataaaataattggcatacacattagaaaaagatactcaactatccctatttggtgacagttatgattatttgcataacacgtagagtttaataagggaatttggtaaagtaataggttaatacaagtgtaatcagtagattttctctcctgcaaaacatatatgaaataaacttttaaaacccattcccaatagcaatgaaaataataaaatatataggaaatatataatcaagaaaggtataatatgtagaaacctatagaataaatggaaaggcttcttgaacagaaagacttaatataaaaatatcagttctccaaaaattaataaaattaataaatttaattaataaataaatttaagttcttattagaattccaagagaatcaggataaaaagaactgaataaatttgtcttaagtttacatgaaaaataaaggcacaaaaataccgaaggaagctatgaaagttaacagcgagggaaaacttaaaaatactgggtatcagaatatgctataaagacactgtaatatactatttagaaataggaatagacaaatagatcgatagaacagaataaagaataaaaaaaaacaaatctcatatactttgagatctatttatgagaatgtagtatggccaagattcaattcagctggaaatggagggggttatttaataagtggtacagaactggctactgatcttaaagaaaataaaaatgctcctccactcatactctatttaaacattaatttcaaaaaaatgaat

SEQ ID NO: 115266 - DNA, 337 bp, Homo sapiens
gtgtccacggtgggaagtgtgtggcgagaaggattctccagtatccacagcgggatgtgtgtgagtagaaggattctccagtgtccacggcgcgacgtgtgtgtgagtagaaggattctccagagtccacggcgggacgtgtgtggtgagaaggattctccagtgtccacggcaggatgtgtatggcgagaaggattctccggtgtccacggcaggacgtgtgtggcaagaaggattctccagtgtccacggcgggacgtgtgtggagatggattctccagtgtccacagcaggacatgtatggcgagaaggattctccggtgtccacggtgggacg

SEQ ID NO: 115267 - DNA, 373 bp, Homo sapiens
tgttaaatgtagattgaaagcagtctccaaggaggtatgttagcctgttcatattgctaaatggacagtaggattatgggggatttttcttaatacttttatatattgggcaagcaggcatatgggaatgatttatgggtgagacctgaagccgcacccagttcttgggtgccctgtacagcccgtatgtgaggcacagacccatggcagattgtcctggcccatttgtgattgaacctctagtagcaagagctgctttacaccggtacaacctaaaagcaggggtgtccaatcttctggcttccccgggccacattggaagaagaattgtcttgggccagacataaaatacactaacgatagctgatgagct

SEQ ID NO: 115268 - DNA, 284 bp, Homo sapiens
cgcggctctacttgtcgatgtagatctttttttttcattatactttaagttttagggtacatctgcacattctgcacacgtatcccagaacttaaagtataaaaagtataataaatttttttaaaaaaagtaattgtggtttttgccattacttttcatgaccaaaaccacagttacttttgcaccaacataatattccaaatggaatgtgccaaatgttgattctaaatattaatattccaaattgaaggaaaccctgagacagtatacttccattgtgccac

SEQ ID NO: 115269 - DNA, 364 bp, Homo sapiens
aagaaatatggtcatatttttttcagaaaaaagaaatgcacatttctgacatttattttcagtttgatattcattaagttgaattacacaatttgtaactgccagttttctcattcaccaagccaagaccaaattgaatgataaaattaaatagaaaattatgtttactttttcataattgcaccatttagtgttatcccttgcattctgtgatatataaaaatggataggaactttaaaaaatatacaatcatttctttttagagtccacaattttggcaagtattttggaaggtttatgaatatctacgtagctttctcacatttttccaatggatgtttgctatggactgaatgtttgtgt

SEQ ID NO: 115270 - DNA, 229 bp, Homo sapiens
tccccggccccaactttccatactgtattcattggaaggaagtcactatgctccccctccttagagttggagtatctacagaatttatttggaattcttccctccaggtctttccaataaatggttgttctcagcaagtgggtgagtactccaccagcattttatttatttatattttatttcatttttcattttattttgagacagagtcttgctctgtcgcccaggc

SEQ ID NO: 115271 - DNA, 469 bp, Homo sapiens
cacctcaaatttcatgccactcagctcagacttggtccctctctccttgttccagatccaaggcccaagctgctttccgagctcacgacatactctcttctccttctccctccacaaattccaactcttccatcaacaaacacaggcagtccaggggagaaaatgcccaactggccctgaggctgaccagtttgggaaggaaacaaatcagaagttatctatttcatgtttgggcagtgtttttttgtttttgttttttttgaaacagagtctcactctgtcgcccaggctggagtgcaatggcatgatcttggctcagagcaacctccgccttccaggttcaagcgatcctcctgcctcagcctcctaagtagctgggactacaagcatgcaccaccatgcccggctaatttttgtatttttagtagagacggggtttcaccatgttggccaggctggtctcgaactc

SEQ ID NO: 115272 - DNA, 320 bp, Homo sapiens
atagttttgggatctctatggcattttaatataggagatgacatttaggacagtaaatgactctattcaaacagatcctcagtgtgaaagtatacctatggatatgagcaatacatgagcatataatgttttcaattttccaaagatacctcctttttaaaggtaatattcatctttaaatcttttctagcattagaaagtgcactagatacacataaattttgagaaccaatgtaccagtcttgttatatcccccagaggtattgcatttctgatcctgaatcccatcctggcaccttgaaccatttcactctccaagg

SEQ ID NO: 115273 - DNA, 326 bp, Homo sapiens
ataggtgtctactcattaagaatgatgctagctgttaaattagccaggcacggtggttcatgtacccaaatatcactgggtcctattaatatgtacaattactacatgttaactaaaaataaaacaaaattataaaaataaaaaattataaatattaattaaccatattaataatactaaagagacaaatcatataataatgttaagtgctgaaaaataaaattcaagaaccattcctaattattaaaaaatcttacaataaaaatagatgatttcctaacatgataaaatatatctatctcttaatagctagcaagcatcattct

SEQ ID NO: 115274 - DNA, 279 bp, Homo sapiens
aacccaccggctctgacctgcagtttcttctgtaaagatggggacagttcatagatctcttgagaggatgaaaaatcatgcatctccagcgtccagcctggtgcctgacatgaaatggaggcttactggtcgggagctctgacattatctggaattctccattactcttctcacacctgtccaccatcgtctggaattctccattactctcctcgcacctgtcccaccatcgtctggaattctccattactctcctcacacctgtcccaccatcgtctg

SEQ ID NO: 115275 - DNA, 887 bp, Homo sapiens
gaggcactgataccaaaaccaaactacaggtaaggatatagtggcaaagattgaatgacacaggctgggcattgaattcaatgcttctgtttggaggtatgactttggtctgtgaagaggtaaagggtattcatctgtgttgtcccatagtcctgttgccatcacttctctcctggccagatttcttaggacttcatgacaagtgtttgtgtattttgagtctgtgtgtacacagacctgaggaggcgccaagtatatcaaggctttggacaaattacgaatagatggctattgagcatgcctttaaaacagtaactattttaaaaagtactatttcagacaaatgacaaaagtagattgtatcttaagatgcagcctggaaattcaagacttgtggtgttcaatttatctgtcttctttaattgccttaaggaagaatctgaatctataatcaccacattccttctgggtaaagctgctggtgatggccataatttttataagaatgcaaaaactggcccccttgatgattcaaactacttctggccaaatccttgaccagatagataaaattgtattgtataattttatatccttaatttatagacaaaatccttttatctaaattttgaatttaccaattcccagtttccctaaaactgtagtgaaccaagttcttgaaattgctcatattcattgccttttattgtcgtttaatactgtgaggcaaaaatctatcaatttaagtgcaatttgtctctgacacacaaccaataaaagttatccatgaagcttaagcataacatgaagcagagtgagatactgaaaaaaaaaaatgggatttttaccaatgtgaaatggcccaatctacgtggaacccaaaatgt

SEQ ID NO: 115276 - DNA, 210 bp, Homo sapiens
tatgcaggacatcacataacatgttgtgaaggagttcagagatgaagacattaccatgcacagagtggttagactattagaacggtagtgatgaaatgctgctggagttgacaggaagagaaggagctctttgtacctgaagaatcaagaactgaaagagatggaactggtgtgccaggctctttcctatatactttccttaaaccctca

SEQ ID NO: 115277 - DNA, 667 bp, Homo sapiens
attcccacataaatttatactctaaagtaattctgcacaaagttctaatggaactgttcttttgaactgtgtaatttatctttatgaatttatttttatttttaatttgtctgggtatatagtagacatagatatttatgaggtacatgagctattttgatataggcatacagtgtataataatcccatcaaggtaaatgggatatccatcacctcaagcatttatccattctttgtgttaacaatccagttacattattttggttattttattttttaagtatttattttttttgagatggagtcttgctctgtcacccaggctggagtacagtggcatgatctcagctcactgcaacctctgcctccttggttcaagcaattctgcctcagcctcctgagtagctgggattacaggcacccgccaccacgcctggctaatttttgtatttttagtagagaaagggtttcaccatgttggccaggctggtctcgaactcctgatctcaagtgatctgcctgcattggcctcccaaagtgctggattacagatgtgagccaccatgcctagctgtcttttggttattttaaaatgtacagtgaattattgactgtagaccctgttgtgctatcaaatactatatcttactgattatatctgactata

SEQ ID NO: 115278 - DNA, 317 bp, Homo sapiens
gatgtgatacctaccttctactgtatcctatgggtagggtctgagcaggagacaaaaacactcagaaaacttgagacgagaaaaactctagaaagtcaattatatgcattttttaatatggtgtcagattttttttctcccactcattttcccttgtctcaatctaaattttatccagatgtgaacatgaagaggcctgtctttgttcattctctgcttctttggttttcctttgtgcctcaaaaggttttggtgctatgcttcaagacacaggtcatgaaggggaaacagttaggatacagtggggagactgcagt

SEQ ID NO: 115279 - DNA, 176 bp, Homo sapiens
ctatctttattcaacatcagacttgtttatagaaagggatagtcaaatggagaagaggtactagttgtacaaaatgacagggtaacccaggggctcaatgagaggtagataatcttttactctaccttttaatggacagatccatggcacatcacatttaggccttaccttacttg

SEQ ID NO: 115280 - DNA, 303 bp, Homo sapiens
tgtactaagggcataatatgcattgtctcattgagtcctcaaacaatatgaagtatgttcaagtggtaatctgagtttatagagaggaaattgacgtcgcctatagccacacacttgtaggaatagatccaggacccaatctcaggtttgtatgcatccaaactcaggtgtcttaaccactgtgtccttcagatttatcatttgctatgtatgaagtgtcattaacaatgaggcgaaatcatttaaaaatgtattcaaatgctgctggctctacactcagcttttcttgcttgttatctatct

SEQ ID NO: 115281 - DNA, 287 bp, Homo sapiens
ctgccaacagccagcactaacttgccagccatgtgtgtgaactgacttggaagtggatcttccagtaccagtcaagccttcagatgagactgcagccccagtagtctcaacaatattgcaacatcttggttgcaatatcatgagagccaccaagccagagccacccagttaagctgttcctaactctctgacccaaagaaaccatgtgagacaataaatatttattattgttttaagatgctacattgtggggtagtttgttatgcagcaatagataatacatccaa

SEQ ID NO: 115282 - DNA, 743 bp, Homo sapiens
gtgtgagatggtaccttattgtagcatctgtctgatgattagtgataagcatttttatatgtgtattggccattgtatgtcttcttttgagaagtgtctgttcatgtctaaatgacccttttaatggggtcatttgttttttgcttgctgatttaaacttcttatagatttgggatattagtcctttgttcagatacatagtttgtagtatttttttcccattctgtagattgtctgtttactctgttgatagtcagaagctctttagtttaattaggtcccagttgtcaattttttttgttgcatttgcttttgagggcttagtcataaattctttgctcaagccagtgtccagaagagtttttcctgggttttcttctagaatttttatagtttcaggtcttacatttaagtctctaatccatcttgagttaatttttgtatgtggtgagtaggtaggagcctagcttaattcttctgtgtgtatatagttagccagtttctccacatcatttattgaatagttatatcctttccccattgtttatttttgtcgactttgtcgaagaatatcaggtggttgtaggagtgcagctttatttcagagttctctgttcttttccattggtctatgtgtcttatttttgcaccaatactatcctgtttttgttaccatagccttgtagtacagtttgaaatgtgatgtctcaggtcaggcgcggtggctcacgcctgtaatccca

SEQ ID NO: 115283 - DNA, 892 bp, Homo sapiens
gtggaggaaagcagccaactaggaggctttgaagacaaggttgccgtggaatagtggtttgccaggggtggaagaggatggatatttccagtatacagaatagcaacagctcagggcacaaagggacagtggggccaaccagggcaagtgcaggtagttctgtgtgtgtagagcttgggctgtgccttgaagagcagagatcctcaactgccacaccattctctcatttgtcaagtatttgttgatgtcctgctgtgtgtaagatgctgactcaagagccccgactctgccagagtgacacacttcccacagtccctgtgcactcctgcctggatctggaggggagtgcggatgtgaatccttcacaatatcctcccgggaggcatggatcccggacaaatgcagtcctgggagcggaggtgacttcctcagccaggcccctggccagccagatataccattgagaacatttcaatgctttgttgtagtggttggtttgaattagcttttcatgattcagaaaggaaaacttattgtcaagtttgcatttgcagtatttccccacccaggagcaaatgcttcaggatctggatcacgtatgcactggggtcatcacaggcctcctgggaaatgtaggaactcagagctctaagagtccttgagtccttgccccaccggcccttgacatttgcaccccagtgaccttgcccgagttgctgagttgcccagaattctccagttacattcaggatgtccattactcaccctccagatctggcgacccaaacaccgactggacgaagcccttccttccaactaatgattcccttttgaaatgggcttttctcaatctggcgttatatttcaataaaacaatcctgcttccaaatct

SEQ ID NO: 115284 - DNA, 680 bp, Homo sapiens
cgcagtggctcacgcctgtaatcctagcactttgggaggccaaggcgggtggatcacgaggtcagaagatcgagaccatccaggctaacacggtgaaaccccgtgtctactaaaaatacaaaaaattagctgggcgtggtggcgggtgcctgtagtcccagctactcgggaagctgaggcaggagaatggcgtgaacctgggaggcggagcttgcaatgagcgaaatcgcgccactgcactccagcctgggtgacagagcaagactccgtctcaaaaaaagaaaacctgaagaggtatttgcttcatcaaattcagacagcaatgcaaaactatattgtgctcattgtcaatgcttctattttaatgtagcactggaaatatgtggcagaagaattagtgaaataaataaaaaatccattgaaattgaagaaaaataagtaaaaagttgctgtttctagatcatacaatcttatattttaaaaatcataaacagagtaaaaactgtctcaaataataaatactcagtaaattagcaaaacataaaattaacatacaagtatatgtacagctttatatacttaaactctcataaaataaaaagaaaaaatcttatttactatagcattgaataaatttctgagaaaaaaaattaaccatggaggtaaaaactctttaccaa

SEQ ID NO: 115285 - DNA, 390 bp, Homo sapiens
ggaaattctaagcttcacctctgattcctccctttgtctcccctccccagaattcaagcattagaagaatattcctgatttggttcctgaagatttctcccatctctccctccccttcacttctattctcaccattttaattcgggccccatcagctgtctcctggactgttgcaattgtttcctaactgctttccataccttaagtttctcctcctgcctctcgctcagcctcaaatcatcgctcaggaagctgccagagacaaggctctaaacacagactcgatgatgtcaagtcccagtttgaaatctcctttggcttcccatcacctataggatggagtcccgaccccttagcttagcacataagggctctctcaagctgcctctt

SEQ ID NO: 115286 - DNA, 265 bp, Homo sapiens
gaagtctaaagtcactgcagggtaaaagtctggcctaaagtgggctggggaggtagtcaggtccttaacaacatgattcatgctttgaaaagatgactgtagctgggcacggtggctcacacctgtaatcccagcattttgggaggctgaggcgggcggatcacctgaggtcgggagttcgagaccagcctgaccaacatggagaaaccccgtctctactaaaaatacaaaattagccaggcgtggtggcatatgcctgtaatcc

SEQ ID NO: 115287 - DNA, 209 bp, Homo sapiens
gctgtaggaaaaatgagagccgcctctcctctgaagcattttcagagcctttctgtctcagctggaattaatgtttggattcttttgtgtgacatcaactcatcccgtgatttagtcatttgtatttcttgatagttgagtcttaggctccgtggctaatgtgtgcttttgggaggaccttatgtaaccatttgttctctgggagagat

SEQ ID NO: 115288 - DNA, 462 bp, Homo sapiens
cagcagctgcggccttgacaagctggcactgtgggcatttattcagcacggatttaatgacaatggctttgagtcaacacacttgtgggtaatcaacatggtcgccctccccggagtgagcagtcctgtgtgcggatgatgaaaggccaggttcggaggcctaagtaaactaacttatctagatcagtttttttacatccccttgttatctaacctaagctttcaggcaccagataagagagtctagctgccttcagccaaatcgttttccaaagcttttataaaacctcttggccttccaagaaggtttgcatcgttctgcaattgttcctaccaccctgatggatctcctacagccagaaggcttcctcatctacaacattatcttttctctatttcatatctcgtttttctggttctcagctccctctcacctcatctttgcttgtgaatctttgagga

SEQ ID NO: 115289 - DNA, 519 bp, Homo sapiens
gcccttggttcctgtcacagttcagaccttatggattctccttgctgcttgcctgaagctctgaaactttcttgccatacataggccctaggaaccaagatgagtttcccgctcaaacagagaaaatgttcaaaaccccattgcttctgcctgttcccacctcatttccaaaaattaggcaaaagttgcaaagcatctggcagcctgttttccctgtcattgtctctaattccttcccacaaacccctaagatgtatattgctccatcctgctatgtaggacttatcctggggcataaaaactttcttatccagagaaataagcatcatgccatagatgttcataagatatagaacagacattcatagccattatctacaggttgcaagagattaaatatttcctttattcatttaaaaacgtgtattttctaaatcttctataataaacaggtactattaatacatatattcataaaaagaaaaagtgtttacaaattgcacaaaataagatggaaaa

SEQ ID NO: 115290 - DNA, 444 bp, Homo sapiens
aaagtgcccttcaatgagggaatggttaaacaaactggcatatccataccatataatattattatgaagtagtatttctcagcaataaaaaggaaagaagtatgacacatgcaacaacttggatggatctcatgcttagtgaaaaaaggcagtctcaaaaaaagttatatgccaatgactccatttttgtagcattctcaaaatgatagagataaagagcagaggggttgccaggggttgggctaacacacaggacatgtgtgtggtgatggaacagttctatatcttgttgaggagattatatcaacttacatatgtgatgaaattgcatagaaacacacacacaaacacatgcgtgcatgtaaaactggtgaaacctgaataagatctttctgaattgtgccagtgtcagtttcttgattttgatattgtactgtagttatg

SEQ ID NO: 115291 - DNA, 589 bp, Homo sapiens
catcctgaaattaacaagaaaaattgaaattaatgttgaaagagcaccagagagtatacatccaaaaagaccaacattaatataaattttagtaaaattactgaaccatgaaaagtaaatgcctttagttatctaaacaaaaactaattacttaaaagggaaagaaaattagatcatcaccagacttttcaacagcattgccttatgctttaagaaagtgttgtaccacatttgatatcctgatggaaaaaaatgtgagccaaggattttacacccaacaaaacttaatggtgaatataaaggcataaaccaatatagaatgcaaaaacttgggaaatattgttttccaaagcctttcctaagtaatctacaaaagaacaagctttaaacaaccagaaagactagaaagtcatcaataaaaggattggagaacattaaacttgtagaactaaaacaaaatgagagttaaaaaagaaagagtataggtatatgctaaactatttcagtagttttggcagtggttgtattagtattgttattctgaagatgtgaaataatgcaaacgcataataaaaaatgtcatctggtc

SEQ ID NO: 115292 - DNA, 501 bp, Homo sapiens
taagatgttagacatcagaagccaggtgcttatccaggtttgctgggacctgaagtttatacaattttaagcgagacctctttaagagcatgaacacaaaattacgaatgcaaaattacattagatacagggtattacaaaaggtctttgcaagtgaaaagctctgaagcttaagggttgataattcatggtaaatttgtccttgaacaactttctgatgagcaactcaaatactttgagcttcagctagcgagtccagtgagatgagtttctagccttccacaaggcagaagtcacgcttttgggaagaatgtttagtaggtgggtaataatggattgccaaagggtttgttcagtgggagctaagatgggccaatccatgcagagaaagtgtttgagtgatatagcacagcctctagaatcggctcgagctgttctttctaaaatctgctctgtggacttgtgctggtcaatgacagatactaccagtgagaacattcc

SEQ ID NO: 115293 - DNA, 338 bp, Homo sapiens
aaaataccttacttattttgtgtttccttcttacttaaggtcatagaattaactcccttaaatttgagaacatgttttgggtaattcctcaggttaaagttttattagaaaaatttgaagttgaccgagtgtggtggctcacacttgtaatcccagtactttgggaggacaaggcaggcaaatcatctgaggtcaggagtttgaaaccagcctggtcaacatggtgaaaccccatctttactaaaaatacaaaaaaagtagccaggcatggtggcaggcgcttgtaattgcagctacttgggaggctgaggcaggagaattgcttgaacccgggaggt

SEQ ID NO: 115294 - DNA, 493 bp, Homo sapiens
gttcctcttcccccagttgacagagcgccatttcgtgggtgtggaggtaaaaagacgtcaccagccctgctgtccctctaggtcacagctcaggcctgacatcagcagagagaacagaagggtcacctccccagagaaggaaggagctttgcctttgaacgatgcatttaaaacatttataaaacatccttcaacttcttccaggaacaaaagttttaaatgaaggaaagagcctcagctatttcaaggtcttggattctttccctttctggcatttgtgagcagccgtgcagattttttcctccagaaatggaggaagactgatttagcaagtttgcaaagagcccacttgtgtgaaacaccttccctcctgctttaaggtgaaactcctctttctaggaggaaagcagatagaggtctaggtctggattgcgttggtcctagcatttgtcacagcgttctactgaattagtgactcagtgcagcagtcact

SEQ ID NO: 115295 - DNA, 331 bp, Homo sapiens
aaatatacattgaatttacttcctgatattcttgaaaaataccacaaaatccaggacagaaaaagctaaagcagcctccgttggcatttccatgaaatactagacacctgcagtgcaattcagaaattctcactatttcctatttcttgaagaccttagaagcaaatgaactgtggatcttgaaagttctatgctgagaccaagttttaaggttcaagcagtaactagcagttatactataatcaaaccattttttttctaagcacccagaaatctagaatttatcttggcaggtactcaggaatgattttcagtataaagcaggaaaagg

SEQ ID NO: 115296 - DNA, 773 bp, Homo sapiens
acctggatgacagagccagaccttgtctcaaaaaaaaaaaaaaaatggggattcattatatcattctctctactttcatatattttttaattttttcataataaaaagttcttatgatatatctcccaaagacctactacatgcgtagcacaatgtgaccttggttggcttctggagggttgtctactcttccctataattcaatttcagatttagtcatcctgtgtgaaataaaaattgaagttattttgttacatgcccaccaaagagtttatttcactttttggcactggggttttttaacactgatgatatctgaaagcactgttctggacacttatcattagaagccaagtttccctcaacaacagatcacgtgtcttgctttatatcatttacatttgctaattattatctagagaaaaagtgtcagtgaataatcttataataatcaatgggagcttctctacttaaatattccttgaaattaattgtcttgtaacaagaggtcatttgcaattacagtaatcatcctaatttatctgttgatagattccagcttttaaatactaggttgtgaaaatagaggttgacctgcattgtaatatgcttgtttcaaaggaccttaactacagtatttagaaatgggttattgcgccccaactgcgaacattcaattattgctttatgtactctgtgcgggaacatgatctgaacaattatcccatatccccaaagaggtgagggttctacttcctgagacaatccagata

SEQ ID NO: 115297 - DNA, 404 bp, Homo sapiens
aagtaagacaggaagctgaggtgaacaggttatcagggtggccggttgtgtcaagtgaccaaagtaaagaaactccgcccttgcacctcccaaccagtgtaggttgcaccctcccattctccaggtactgccagtaaaaacatctgtggcccaatctactgcctgagcacggtacctgctactgcagcggagtcagtcccaaggagcgacaccagtgagcaggaaagcagaaaaggtgtgggaggaaactcctgtgtggtcccctttagggggtgggtagtgggaaccagaagacccaggtgctgctattttgaagtcatcagggtcggttccatcactgcttactgacttgctgcacctgcccatttctactgagaaccaagagcagtagctttgttccttta

SEQ ID NO: 115298 - DNA, 293 bp, Homo sapiens
aatgttttcactcacatgaatgttgaaaatcatgtgggaagctagtcatttcttaattgtgcaggactcgaaggttcccacaactgtgggtcgtaggatgtttggcattcttatttttcccaccactgaatgtcagtgaattctcaatcattgtgacaaccccagagacattaccaccaccatcattcttttgagactcaattgttaaagacattttgctcttattatgacagttattatagttcataaatgtaagcatgcttgaatgtccccaagtgcgtgtgatttttttg

SEQ ID NO: 115299 - DNA, 200 bp, Homo sapiens
ggatgggggctggatgctattgacatctagggagtggagcacccaccacaaagcacggtgcagccccaaatgcccataggttatggggcctgtcctctgcgtgtgggatgttcagcagcatccctggcctctacctgctagcaagcctgctggaaccaatccccctgtcattcactcctgtgccaccaccttggtgcttt

SEQ ID NO: 115300 - DNA, 872 bp, Homo sapiens
agcgggttctccacctgcgcgggcctgaatggccttcaggagcacagtcggcctgaggagttgatggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatagtttgaagtggaaaaccagagaaaaattagaagctggtaagaaaaaaacaaggttgggaattgagagttaagggagattaaagcaagtcgtgaaactattaaatggttacaatggattcggaaacttgggaagta

SEQ ID NO: 115301 - DNA, 479 bp, Homo sapiens
gggtggggtgcaggtttcaccgtgtggcccaagctggtctcaaactcctgacctcaagtgatccttccgcttcagcctccccaggtgctgggattacaggcatgagccaccgcacccagcggggacaggacaattttgccagctggagaaggggtggcccccaaatgtccccttcaccaccctcctgcctcttccttcagaacactttttccctgaagccctcctgggtagccccctacccacatgcctcagcattgggatgtggggagtgtgggggtcccccttgctcctcagccccatttggagtaatgtcctgtgcagctgagctcacaactcctcctccacctgtccctccacccggtgtcactggcaattgctcacttcctgggcctgcacccactcagctcccctatccctgggcaccagcctcagccagctcccatgtggactaatgacccttgtccctcccctcagctgcc

SEQ ID NO: 115302 - DNA, 448 bp, Homo sapiens
ccaagaggatgaagcttcactggcagttctctcaggaggacccatccagaaccgcaagtctaagcgctgtctggagctgcaggagaatagcgacctggagttcggcttccagctggtgttgcagaagtgctcgggccagcactggagcatcaccaacgtcctgaggagcctcgcgtcctgacccaccggggccacttccggctgcctctttgctactgtgtagcacctgctgcaacgttgcctgctgtccacgtggggttgtttggagtctggggaaccaggttagtgggcccccaagaagagctttttatttcctattcaattttcatggagtttatagaaagatgctgattggtaggtgatggtatgatatcaaactattttgcagttgtaaataggggacagatggaaaatatttataactgacaataaaatattattaagaaaa

SEQ ID NO: 115303 - DNA, 593 bp, Homo sapiens
ttaagttttagggtacatgtgcacaatgtgcaggttagttacatgtgtattcatgtgccatgctggtgtgctgcacccattcctacttctttactatttcccttttccttaaatttatttcaggaaattaaagtgtagaatacttgaggggagagtaaaggatgagtgaaataagaatttaaaaagacaagaaaaaacatcctaagaaatatgctaacagttatgtttccactacaagaaaaaaacctactaagagcatatatagtgtaactattaaaattccatctgcttcaagctctttcagttcatttcacaagtcctgaagatttgtcctgacttcttccggctgcctctttgctactgtgtagcacctgctgcaacgttgcctgctgtccacgtggggttgtttggagtctggggaaccaggttagtgggcccccaagaagagctttttatttcctattcaattttcatggagtttatagaaagatgctgattggtaggtgatggtatgatatcaaactattttgcagttgtaaataggggacagatggaaaatatttataactgacaataaaatattattaagaaaa

SEQ ID NO: 115304 - DNA, 366 bp, Homo sapiens
actggactgtggacccctcaaaggcagacagtccatctggctcagcatctgttttcagaacctggtatgtgatggacctcagagagctgtcactacctgctgcctcccattcctcccattctctgccccttttctctactcagtacttccccaaacctattcttgtcaaggagaccaatggcctttacattttaaaatctgagatgaaattctctgtcttcatcttaactactctatcagcagcaagtgatacagcaagccacctccttcttcttgggacactttctcatgtggcttttggcacaccagtccctcttggttctccgtgtgtctcatcagatgcttttagcctcctctgaggattct

SEQ ID NO: 115305 - DNA, 1155 bp, Homo sapiens
aagcttgcggccgctcatttatttatttatttgtttatttttgagatcgtgccactgcagtccagcctggtgacagcgagactctgtctcaaaaaaaaaaaaaaaaaaaattcaaaactataggaaagttgaaagaatactaaagtcatttaatatccacatacccttcatctagattgtatctgttgttaacattttgccacatttgatttatttatgagtatatattttatttttgtgctgaacaatttgaaagtttgctttattcctcatttataaactctcttgcatgtatctcctaagaacgaagacattttctggtataaccaccatacacttatgaggaatattaaaatacaaatacaatactatctccccagttgacctcaataatgtcctttataatttgtcctgtccccaccctgattccatagctagatgtcatagttcttcagtctccttcaatttggaatagtcccctagcctttctccctaccttctgtgacatttttcccccagtataggcctgtagttttgcagaatgtatctcaattaggacatctgtgatgatttcctcttgattagcttcaggttaaacatttttggcagggattctaatgagtgatgtgttttttacgtactacatcacagacgaaaggtaatgttaggtttgatcactccgttaagatgctgttcacaatatttctccattgtaactactttttttcccttttatataaatcagcatataattcttatgctaatacatgaagctgagtaaatatccattttcttcccatagcctgtcacccaatagttttagcattgattatttttgcttgaataaattattcctttggcagttggaaaatggtaattttctaacatttcttccacatttatttgcatttttatataaagaagagcattcgttctctgctcccactgcttcacttgactaaccctaaaaaaatatatatatgtgtgtatatatatatatagagagagagagagagagagagagagaaacaggcaggcatggtggctgatacctgtaaccctaacactttgggagtccaaggtgcgaagactttgagcccaggagtttgagaccagtttggacaacatagcaagacctcgttcctaaaaagaaaa

SEQ ID NO: 115306 - DNA, 257 bp, Homo sapiens
cgtggtggttaagagctgggtttgagtcctgactctgcaatcacatgatattggccatgtgatactgtgtggctttcattcaacactgggaatctcagtttcctcaattatgagaataacctgaggtcctatgggtttgtggtggaaatcaacaaagcttacaaacttaacatgcttactagtccctagtgcacagtaggcactcaataaatgttcgctgaatgtcatgatactaaatcatgatgaacatactaaat

SEQ ID NO: 115307 - DNA, 434 bp, Homo sapiens
aagccaaaatgttacagtaactactctggcctcttttcagctctgtttccctcttatcaatacatacaatgaaatgactaggaagaaattcttctcatgctaccttgtctgtgaacttgtacttgtctgaatttactatagtactagtgtgttcaacattatgcttggaagaaataaatagcttaaattttacatatcagtaagtctggttcctatcagggaaatttaagaaataagtgatattctcaagcaattaagttaaacagaattaagaacaagaaaaaaatacttaactatattactgctgtcctattttaagaaacctaagctgaataagctccttagtttcatacattgttctttacctgagttaagttgactttatttttaatttcaggtcactgtataactgtgaacacttccccacggttgtg

SEQ ID NO: 115308 - DNA, 379 bp, Homo sapiens
gtgcatgccaggcaacccaggctacttgcatttcagcagtcagttgacacctgttggtgccaggcactgtgctaggacctaggtgtagggaggtgatagaagataaaaaatgatgacaagtctggtcccggtggctcatgcctgtaatcccagcactttgggaggcttaggtgggtggatcacgaggtcaagagactgagaccatcctgaccaacacggtaaaaccccgtctgtactaaaaatacaaaaattagctgggcgtggtggcacgtgcctgtagttccagctacttgggaggctgaggcaggagaatcgcttgaacccgggagtcggaggttgcagtcagccgagattgtgccactgcactccagcctggtga

SEQ ID NO: 115309 - DNA, 341 bp, Homo sapiens
attataccacttgactgggtcacccatcgaggaaggggtggagtgaaggttcaaacccaagtttttgacactaaagcccacgctctttcccctgtatgtagtattttcttgcagaatttttctgccctgatatttaagaacttctttttgtctaaatatttattcatcctgctacaatgtaaacacagctatgcaaatatattaatggatatttgttttgctttgttgtttttactgagggcaccctagcacatacacaaacgatgacccagcaccagggaggttgcttgttttctggcttctgctttttttttttttttccttccccctgatcctgtctt

SEQ ID NO: 115310 - DNA, 611 bp, Homo sapiens
agtggattgaaataggaaaaatattttcaggattacaacacgatttagccaaatcattgctttaattttcacagttaatcccaggaattcccagtcttcggaaaagaccacaatatttcaaagcaatttagttcagtccaagcagaatctgcaatttctgcatttactctccgtcaactggaattgggtcttcagatgacctggagataagtttttgacacaaaacctactgaaatgcttccattgattaactcattttttcagcaaggattttctaagcgactactacataaagctacagtgcttggcaaggaaggaagtgggatgtcaagtacaggtggtgagatttctgtggcctgatgtgggcacctctggaaagacacgcattggagcgcgacggggtagcgatggcatccagcagcgtgggttcccacagcgccggcgcccggccaaaaagcgcgccagtaaaactttccgcaattccctctgtgccaagcgcgtcctgggcagccgcacttcggaggggcaaaactcaccctaacttttgagtgcagagtcaaacttaaggaataggttagagtgaagggaaaggggagcccgggctgaggagg

SEQ ID NO: 115311 - DNA, 694 bp, Homo sapiens
gcaaggcagcagctccattgatgtgccagccttccctttcctcccctgccacagctcctgggactgttaaagagatacaagaagagaggccaggcatggtggctcacgcctgtaataccagcacttagggaggtagagccgggtggatcacctgaggccaggcatttgagaccagcctggccaacatggtgaaacctcgtctctactaaaactacaaaatttagctgggcgcggtggcatgcacctgtagtttcagctacttgggtggctgaggcaggagaatcacttgaactggggaagcggtgtgagccaagatcgtgccactgcactccagcctgggtgacagaacgagactccgtctcaaaaaaaaaaaaaaaaaaaaaaaaaaaaatttggggggggccggggcccggaaaagtttttagaacccttggtgggggggccgcggcacccaatagaggagagggacacatgggcaatagggaggtaccaagagaaaactcgggcgcacagaaacataggcggctggattcccacaccaatataaaaaaaggcggggaggaaaccagaaggcggttcgggacccaaattgcaggaggaggattccagagggcaaataaggggggctctacaaccagggaagtgtccaggcagcagctcgaaatgtaagatttaggcggagcaaggatggagc

SEQ ID NO: 115312 - DNA, 273 bp, Homo sapiens
acctcacccacgccctggtcagctaatctctgcttcacccatcctggctgtccagtctccggggtggcgtttctgttttctttcggcagaaatgcctgggaaccgaaaggcccctttccctgtgacctgacctcccacgctaagaataacagccccaggacagcatgtctttcggtccctctggaaagagggcatggctgggaagtgggaagttaagggagctggatagagctgggaggaaagggaagaacacagattcttggctttgtgagt

SEQ ID NO: 115313 - DNA, 313 bp, Homo sapiens
ctcttcatgtgaaatggtggcgtctggggttcctctccagcactcccatgtcgcctgcctcttcatgtgaaatggtggcgtccggggttcctctccagcactcgcatgtcgcctgcctcttccatgtgacatggtggcgtccggggttcctctccagcactcgcatgtcgcctgcctcttcatgtgaaatggtggcatccggggttcctcctcagcactcgcatgtcgcctgcctcttccatgtgaaatagtggcgtccaggttcctcctcagcactcgcatgtcgcctgcctcttccatgtgaaatggtggc

SEQ ID NO: 115314 - DNA, 806 bp, Homo sapiens
gtggcgtgatcattgattcggacaggaggcagagaaattctaggcagaaaagagtggggtccctggtgagggccacaccctgaagtctggaaccacagccccgaatgagaactttccatccccattttccccgcttgaatgtcaccttttccaaaaccacccctggcccactccaccccacatcctgtacctatgaaaaccccaggctccactggcagagagcagagaaagggagaagaagcagctgaacgttagagaagtctcttgacttcagagggacagcttgacagcaggacttaggagaagagtctggccagagacagctggacatcccgggaagaataccttcctgctccatcccctttgtagttccctttcccactgagagccacttccatcagcaagaaaatcccctatatttactatccgtcaattcatccatgcgatctgatttttccttgactctggacaagagcttgggatacagaagcctataacagtgacccactacccttgtgaaaaggcagagggtccactgagctgttaaacacttaagccatctgcggatggaaaagctaaaagagcgctgcctgtaacattccttctggggtttcaagagtcatgggtactccctactagatgctgctgcggggcccacacaaagttttgctcctgtccacacccagaagtactcgccccagctcctgcacctgctcagctgtgctctccatcctgtgaagggtggaggatgaaagtaaagggatagcaaaaatgtaccaagcaaacacttactatcataagaatac

SEQ ID NO: 115315 - DNA, 213 bp, Homo sapiens
tgacctctgtcaaagctgggccttggttactcacaggccactcacagcccctccccatggctggtaacccagacctcaagggtgagcaagaggctaagaaggctaattgggaaggtggtggccccgtagcccatctgctggccctgggctggatgagcgagcaggaagcagcagccagctctgggcaggtcgaggagggccaggcaggctccc

SEQ ID NO: 115316 - DNA, 390 bp, Homo sapiens
agagcatgaagcaaggtttctgcttagatcacttcatcacgcagcaacgtggctcccaagggctagaagagaaacactaccatcaggtctaggcttttatacaatttcaccttaggccccaacctatcaagccacactagcacttaccattaaaaaaaaaaaaaaaaattaacccataaaggctatttaacttgccaaggctatactctttagttatttttaggaaatcttcaatctcaacaataagactcttgaatttgaaatgtctctaatctgaatgttacctttgacattgttggcagaaatcctacaaacatctgccatctaaaataggttaagaaagggcaatagaagctttgaaacatacccaagtataaagcagaatttagt

SEQ ID NO: 115317 - DNA, 548 bp, Homo sapiens
ttgaggtcagctcggcctctggaggtgcctgctgcactgccctgctctatccctgggcacagccacctgggcacccgcagcccatcctctggcctggcctcaacccaccctgcctggggccgtttcatcttctctgaccttcacagaggccaggatccttctatatttcaaaatttaacacattttgttttcctggaactgtttctcttccaggaagtgggagtgccccacaccagggcagtgagctgaaagctctccccaggccctagggagcaaaggctgggctggctgcgccggctgccccccactagccgcaccttggcatccaccctgctcctcctctacttgcagcgcgacccccgacccctcggtgtcttccatacaccgacctcagcgtcttcctagcccatctgctcacactacccctgcctgcaaccctccctcctggcctccaagcctggcgcaatcccacagcttccgcccaagtcctcagcctctcagcgctcacagggctgcgcccacccctgcagtctttccccagagagggg

SEQ ID NO: 115318 - DNA, 353 bp, Homo sapiens
tttcctgcactactgtgctatctgtgttgagctattaatatttacaagtaaacttctgacatcatttgtcgaatcctccttctagagtgagagacttaaattgatagtattgagagagaaagcattcatactttaagattttcactgctttcttaatctgattcatttcttccttaattttctgaccataagagatgagaagtcagttttttggtatctgctttaaattgctttttctttacatatacttgctttttgtttattctgacaatgataaaggattatgtccctcacagctttttaaagaaatattttatagaggcttaaaggagtatgttattaattaaagtgtc

SEQ ID NO: 115319 - DNA, 677 bp, Homo sapiens
agtattaataatgtgctgggctcatttatgaacacttattcttttaattgggctgtttgtctgcttattatggagttataagagtacaaggattatttatatattctggataccagttttggtcagatattttctccagtctgtggctcatgatttttattttctcagtggtgtggtttagggagcaaagttttaaattttgatgaagtcaaatttatcaatttttttcttttatggtttgtatactttggctcctcagaaatctttgtctaacctaaggtcacaaagatttttttttctcttcaagaagttttatgttttagttcttacattacatctatgggtccattttgaattaattttggtttatggtatgaaataagagtcaattttttttccccccatatggctatttattctagcaccactttttgaagactttccctgttcacctttgtaaaaaaaaaaaaattacttggtatatgtgtgggtttgtttctggacttcgacatttacttttgtctatttctccttgcagttgtattggtttttgctgcatgtattttgaaactctgttattaggcatataaacatttgagataattatgtcttcttcatgagtttacccctttatcattatgaaatgacctcttttcccttggtgatgttctttgctc

SEQ ID NO: 115320 - DNA, 431 bp, Homo sapiens
ctgtaccctgatgcctacctacctagcacacagcaggaccttaggtatttattgggagaaaaaaaggaaggaaagaaagaaaaatggcatgtaacatttttttctaagtattcaatgttttggcatacaaacccacaccaaaaataatacaaataaaaacaaaacacaccatttttgaagaaagaaaatccaaaagaagtcttcactgcatcccaaaaagtaggtaagaatgggaaggaaagagctaattaatagggtggttttcatgggctgtttgggaaataacatagaatgggacccacgttggccacaggatgacaaccatgacctggtgaatagaatacaatatgtggctccctttctagagcaaagattatggattctgtacagtccaatcaaaagttttccattttcactaccatcactaacct

SEQ ID NO: 115321 - DNA, 306 bp, Homo sapiens
ttcatagaagcattatttatactacccaaaaagtggaaacaacataagtgtccatcagctaggctgggcactgtggctcatgcttgtaatcgcagaactttgcgaggtcaaggcaggcagatcacctgagcccaggaatttgagaccagcctgggcaacatggtaaaaccctgtctttacaaaaaatatatatataaaagccgggcgcggtggctcacgcctgtaatcccagccctttgggaggcggaggcgggtggatcatgaggtcaggagatcgagaccagcctggccaatatggtgaaaccc

SEQ ID NO: 115322 - DNA, 604 bp, Homo sapiens
aagagctgttatccaacacttagaaataaggccaggagagtgtggtgtgacattcttgggcattgttcaaccagctccctagaggatttattttaatatctagggaaatgtacttttgtttgactttgctattgacaattaattaaaggcacagagtggtcatacatcaacttgaagatcttatccagtagagatgcaaataatttctgtctagtataaaagataacctcaaaggttgtgacttctttttatgcctcatagaacagtaacctgtttttcagctaatccagaaaccttagtctcttattcctgtttaaacgcccataaacacctgcttcctcaaaattctctttgaaccagctctaccatcttacttgcccccttatttatttatttatttttgagatggagtttcactcttgttgcccaggctggagtgcaatggtgtgatcttggctcactgcaacctccatctcctcggttcaagcaattctcctctgcctcccaaagtgctgggattacaggcgtgagccaccacgccaggccccaatgtgtagtcttttatccctcacccttctccccaagtccccatagttcattgtat

SEQ ID NO: 115323 - DNA, 691 bp, Homo sapiens
gatattctaagcttccggtttgtcccataagacagatggttaaattaagaacttgtgttttttatttacagcatgaatgaagcattcatataacagagaaggctaaaggcaaagcatttgaattctttgcttaagacaataaagtattttcacggaacttagtggatatgatttgaactgaccagttagagctgggaaatatttggtcatggtaatctactgattacatgattaatactgaaaattatatctagttctattattaaatggttttcacagccctatacctatacctaaaaggcttctaggctgccctactccagtgcctttaatttgaacagttttgcctatatggtttttttaaattctttgacaattttaaagacagaaagggtggagaaaacgaaaagatggacatattttagcaattatattaagtataattattgatgatcaccaagacaaaagtaggaaacactagcaaaacaagcaaaatataaaatgtatatttttttaaatttataaagtagttaattttttttttaatactttgacccccaaaaagtgagcctaagtatctaaaaaatttacttagggaccgggcgcggtggctcacacctgtaatcccagcactttgggacgccgaggcaggcagatcacgaggtcagaagttcaagaccagcctgaccaa

SEQ ID NO: 115324 - DNA, 399 bp, Homo sapiens
  misc_feature (243)..(243): n is a, c, g, or t
  misc_feature (258)..(258): n is a, c, g, or t
  misc_feature (262)..(262): n is a, c, g, or t
ctcgctgtcctccatcctccattccgtccaactcctagcccagtcccgggggcgcctacttcaggtctgagagtctgaactccgagatgctctgggtgtgtggatttccttcagctaccctgatgtccccacttccaagtcctgactcctttgagccatcccagggggtgtccggccactggaccatggtagctgatgcatttagatgcaggtgtgtgtgtgtgtgtgtgtgtgtgtgtgtgngtgtgtgtgtgtgtntaangtttaatgtattaatatagattataattggattattagtgtaggttaaatgagtatatgttgtgtgtggtatattttatatttgatgtttatagtagtattttttgtttaatgaataattttgtatatttttgtttt

SEQ ID NO: 115325 - DNA, 339 bp, Homo sapiens
  misc_feature (243)..(243): n is a, c, g, or t
  misc_feature (258)..(258): n is a, c, g, or t
  misc_feature (262)..(262): n is a, c, g, or t
  misc_feature (314)..(314): n is a, c, g, or t
ctcgctgtcctccatcctccattccgtccaactcctagcccagtcccgggggcgcctacttcaggtctgagagtctgaactccgagatgctctgggtgtgtggatttccttcagctaccctgatgtccccacttccaagtcctgactcctttgagccatcccagggggtgtccggccactggaccatggtagctgatgcatttagatgcaggtgtgtgtgtgtgtgtgtgtgtgtgtgtgtgngtgtgtgtgtgtgtntaangtttaatgtgtttcaatccatttaaattgcaccctcagtgatgctcaaatgnctccatgtttgggtgtggaagagcc

SEQ ID NO: 115326 - DNA, 420 bp, Homo sapiens
cctctcctgggcctcccaagagtaaacctctccacgcagaccaggctgcaaacctggattgaaaccagcgctgtcgcactccttgaacgtatcaggcgttttcagtagcgggaccggaaccagaacccaaaagaggctccttccttgtcttgaattcctcccacctgagttagcatcttggaggtcaacgtttcaaggaactcagtatctgagaagagaaagacaccaaaccgtagttccccatgaggacttgttgctgaaaaaaaacatctaactccatacaatatttgaagagagttattctgagccaaatgtgagaagcatgaccggtgacacagctccagggggtcctgaggacatgtgccgcagggggttgggccacagcccgagctcatacactacgaggtgggaggagaggaa

SEQ ID NO: 115327 - DNA, 160 bp, Homo sapiens
agcattacatagcattcaaagcataatacaatttttctctattatatttaaacttttattccacggtactctctcaagggccctgtgcactaggaagataataccatttccacaaaaattaattaaaaggtaccattcatggccaagagcgactgagagg

SEQ ID NO: 115328 - DNA, 342 bp, Homo sapiens
aaatggcttagggagactggcccatttttgttccagaatattttgtctgctaccttttcctttaacttcctcatactgtctgaaattccacttgcatacgtattaaggattaactttttaatgaaattccactattagagacccattttaaactatccaatccctgtacaaagcaatgactatgaaaggctgtgaggccatcatttactcacagattagtacgaattagttcaaaagcttgctttactattcccactcagctaagatcagcttcatgggaagaatggggccaggcacagtgataatcccagcactttaggaggccaaggcgggaggattgct

SEQ ID NO: 115329 - DNA, 166 bp, Homo sapiens
gtagtcttttgagtcctgttaactataaaaagccaatagcagttggtgccgtggttccacaccctggggtggaggtgagagatgagttcctgccatcttttttgggatggcccattagcctgttggcacccatccctcaaaagatgggtttaatgataaatttggt

SEQ ID NO: 115330 - DNA, 431 bp, Homo sapiens
aatcttgtatcaaattgtaatccccagttttggaggaggagcctggtgggaggtgattagatcatggggggcagatttcccccttgcagttcttgtgatagtgaattaattctcatgagatctggttgtttaaaagcatgcagcacctcccctttcactctctttctcctgctcctaccacttaagacatgcctgcctccccttcgcctttctccatgattggaagtttcttgaggcctccccagccatgcctcttgtacagcctctagaaccgtgagccaattaagtctcttttcttcataaattgcccagtctcaggcagttctttaaagcaatgcaagaacagactaatatatagggcctcactctgttgcccaggctggagtgcaatggtgggaccttggctcgccacagcctcaacttcccaggct

SEQ ID NO: 115331 - DNA, 431 bp, Homo sapiens
ttgacgtatagcatcactgtagcacagtgcattactcacatcacatatttgtggtggtctgtggggagctattccagaaaaaagccttgttatcataggagatgatagctccttgtgtgttattgcacctgaagaccttccagtaggacagaatgtggaggtggaagacagtgatagatatatatgtagtccactgttgaccgaaacattgctatgtggtgcatgaaaggaagtaactcagggccgggcgcagtggctcacgcctgtaatccccgcactttgggaagccgaggagggtggatcacgaggtcaggagatcgagaccatcctggctaacacagtgaaaccccgtctctactaaaaaatacaaaaaaattagccgggcgtggcggcatgcgcctatagtcccagctactcctgggaggctgagg

SEQ ID NO: 115332 - DNA, 527 bp, Homo sapiens
tacgtatctatccatcccgtctcagccatctgtttgtgacaccacatgacccagccacatctcagcaggtgcagaatgtctcttagtgttggcttacacctggcagtctgtgcacattcacaggatagtcttacttacagattgagaatctacagttttgagatcattatctttacatttctgtatcctccatccttcacagagtcttcagcacagagcatgagttcaaaatcagtgctgggagcattaggagaaaattaccccataatgtgtgcccatacgatgccttcacaaatgcaggcaatttaaactgaagttcaaggttggtggtggtgctctggagagcaagaaactggagaattaggcagaattaaggctgggagggctctggagccagcacaggagtttgcatggaagctgaaggtcacaggaagccattgcataaatttttgcattggtggagcacagccagctcctctggcctcatgtcaagtttctcatcttattataagcctgaaaggggtaga

SEQ ID NO: 115333 - DNA, 516 bp, Homo sapiens
agggatattacgtgcttgtaggcactatgaggaggaaaaacaaaactgaaaactaggtcttctgtccctgcactcactatgttctatctccttactgggccagaaattcttatgcaaattaatagggaggtaagactagccaggaactcaaagcccaaactttccaaggcctgtgatcctggaacagctcttccatgtgtccatgagagagactggtgctaggaaccagtaagtatagaggcaaattttttgtgctcctttctgagcagcacactttaaaaattccatacagtctgtatctgacataaattagggtattgtagccaagttgtcaatttcaccaatcctcaagccacatgtctattctgtgcaggtctatggaacctaatgcacagtctcctgagagcataaatgaagtatcgggcaattggctatggccaaaggagacttgtctttttcccctgagagattgctctcactgaggcagaagagactcttctagatgcaccgtttaga

SEQ ID NO: 115334 - DNA, 402 bp, Homo sapiens
tttctgggatgatggcactcctacacatataaaataatgatttcaaatgtttacagcatattttatctaaaaattaaactctgagaaacaaatataaacccttctggaataattttatttttcctttgggatggtggaaattttcttctgttttattttcacttacccttttgattggtttcataagacatttccacccatgtagaaaagcagttaccagcctggccaacatggtgaaaccccatatctactaaaaatacaaaaattaactaggcttggtagcaggtgcctgtaatctcgggaggttgaggcaggagtattgcttgaacctgggaggtggaggttgcagtgagccaagatcacgccactgcactctagcctgggcgacaagatcaaaactcc

SEQ ID NO: 115335 - DNA, 350 bp, Homo sapiens
ggggtcagtcagggtcacctccaaggagagtcagctgcttcagtgggtcagaggtggggcatcaggaaagacccgcccatcacatactcttcgcattactccttagtgaagaccttgaccccaggaggctccctaacaatgtgactgtaacctgggagggtggctagagagtggagcctctgagaggttaggcaaagagcttagagggaagatctcaagcagggtgagaggcttaacaggaccccgggtggagctccccaggggacagtgggggcctaaaggctctgagaccttgagtgacggtgtagggaaggaagaaagggtagagttgagagggaggcgagaacccc

SEQ ID NO: 115336 - DNA, 386 bp, Homo sapiens
tgaattccaggcctcaagtgatcctcctgcctcagcctcctaaagtgttgggattacagacgtgagccaccacacctggcctggcatgagcttgaaaagtctgagggaaggagaggggcccatcatcccggcaggagcgagggtagagcaggagatgagtctggaaaggaagtcatggagagtgtatcataagcaagaccttttaaagcaatttccgaggcgttcttgtcctcctgagctacccatcctcagtgagaaaggcccaggctacttagagaatgtggcaaagatcttcctgccaccctccaatggcccatttcaaaagtgagcgtgtcttttgaaggcgtcagcttctggcacatcttacccaggctcgtggtttgttt

SEQ ID NO: 115337 - DNA, 817 bp, Homo sapiens
agcggagtatctggagtcagctggagtgtgccagcagcaagatggcccttaccagatgctggcaccttgatatttgacttcccagcctccagaactgtgagaaacaaatttattttctttataaattactcagattgtggtgttctgttacagcaacacaaaatggactatgtgaagaaaaccatgttggaatcttgtgctgtcattgataagaaaggatctgagcattaggtcaatcaccaaaaaactgaaaaatcagtaacaatgatgacagactcttcaaataggatgatttaaattttaggaaattggaagaagactccaagaaacttaacaaggtcctccaatattttccccaaaatgatcttctctgatttgactatgcttgttcctccatatctccctgatccctagacttcttctgtcctctatccacattctctcccaaggtgggtcatctagtttcatgactttaaatcctcccttaaactgttggttctcaaatatgcacttgtcacttctctcctaaactccagactcatgtattcagctacctacttgacacttctgtgtggatgtctagtaggtaataatcttagaattattgtgccctgtcaaattcctgctcttccctctaaaatatcttaatactattcagtcttccccatttctgtttatctcagttccttttcaggtcaaaaacctgagttatctttgattcctctctttctctcacattctagtagtccagttcctttcataatcagatcaattagtaagccctatcagctccatttttaaaatgtaactaggatcc

SEQ ID NO: 115338 - DNA, 434 bp, Homo sapiens
caaatgttaatgtcctttccctttcccctggtgatccaggtctcctgctgaagttcttgcctagctgcggtcttccccacccccacccccacaaaaatgtgaagatagctattgagaagtaccttttaaggccttctccctcttgggatgagaacctgatcaccagagccctggagaggcctggagagtgagccacctgccaaacaaagctctgggaactagggacccattgcaggctgtgaggctgtggcagcagaaatacgcatggcccagagcatgcatgcagaaagtcaaggagtcttttccaccagagtaaggaggattttcccggctgtggcagtctggtcctctgctaagaggaccttaatgcttcataccacagtattgcactggcttttcagatggctcccacgtgagtctcacaacaacctcat

SEQ ID NO: 115339 - DNA, 233 bp, Homo sapiens
agacagtgtaagactgcccatacaccttctgtcaatgtcttgatgccgtttactgcatgtgaaacccgcagcttggagagcacacaggcagaggcggcaaagcaaacacgtggctgactcactgcccctcccatgcaggcagaggctggaaaacagggctggggacaggctcctcatgagggtttgcaagtttttttttttttttttgagacggagtctccttctgtcgccca

SEQ ID NO: 115340 - DNA, 745 bp, Homo sapiens
ggcaagggagcaatcacttattgaagcatggatacttccaaatagaataggacataactctagttctggaaatgactcaaaatcatccaattggttaaaagcagagaacgataaactacacccaaatatatccaaaaattatttcaacaatttatttctggttctcataggtatgtaatgcgaaggaagaaaattgaaccctcattttaaaactggttaggtacagttatttcatttcctttcctggaatcttactttttttcctgtttttgtttgtttgttttgcattagtcagaaaacacttaacccaaatatacatacagatttttaaactttaactactgaagatgagcaaaagtttaaaaatattgcctccactgtaactgataaggtctgacttcctgctgggacagatacaatttgtttggctactcttctgaattaattaaatgagttttactggcatctctatcctagaaattctccaattgggagggagtgaagcatgaagctgagataagtggcaagcatttttaaaaagaggtacttttaacttgtcccaagctttttttgaaccttaactgggttcctaatgtccagtagtctcccgttatctgtaggggatacgttctaaaatcccaatggatggctgaaactatgttttttcctatatattcatatcttatgataaagttcaatttataaattaggcacaataagattaacaggaataataatagaacaa

SEQ ID NO: 115341 - DNA, 304 bp, Homo sapiens
ccaccaggtcccacctttaacattccctactacaattccacatgagtattggtagagacacagaatcaaatcatattattctggctcttgctccccaaatcttgtatccttgtcaaactgcaaaatacactgatgacttctctactgtcccccaatgacttaactcattccagcacttactaaaatgtccaaggacttacagaccccatacaagtcaaaaacccagcaggccagtcattgaatcctacagctccaaatcatcttttctgaatggacgtctcacatccagagcacaggcgtgtca

SEQ ID NO: 115342 - DNA, 540 bp, Homo sapiens
  misc_feature (530)..(530): n is a, c, g, or t
caggcctctcagcctagtttgggtacttctttgtgctttcattacaccctgtgtttcctggccttggcatttactatgctattggtagtgcttatcttgtttacccactaaaccaacttggaggtcaacatgattctgtacctggaacacctgacaggtagtggacacttagtaaatactctatgaattcatgtaagtagttatggcatgcagcttttcagtcactcaaacctgacctcttacactagcgtgccatagagcctacatttcctacactcagccaaattctttaaagagatatccatatttttgagcactagtatgttccaggccttggggatagatatatagctatagtggatgagacagagtaagtcctgttctcataaagcatgtgttataagagccccttaaaaaaaattgtgaggctcggcatggtggctcacacctgggaagccaaggtgggaggatcacttgagcccaggagtttgagacaagcctgggcaacatggggagtccctgtctctacnaaaaaaaaaa

SEQ ID NO: 115343 - DNA, 123 bp, Homo sapiens
cattgccaataatttacatcttattatacgaaaatcctaagggagcccatctgcatatgcctttatattcttcaccgagtccatcctcagacaaatctttagtggcacaacagtctccacagt

SEQ ID NO: 115344 - DNA, 204 bp, Homo sapiens
ttattttcaccttttctaaacaactccaccacactttctctgtctcgagagaaaggggttgaaaaatgtacatatccaggattgccatttttttgttttttttgtgacagagtctcactctgttgcccaggctggagtgcagtggcatgatctcagctcactgcaacctccgcctcccaggttcaagcaattccccttcctcag

SEQ ID NO: 115345 - DNA, 785 bp, Homo sapiens
gttatttgatgcatggaagtttttaattgatgtagtccaattgatctatttgtttctttggttccctggttccctgtgcttttggtatcagatcgaagaaatcattgccaaatccgaggtcatgaagcttttcccttatgttttatcctaagagttttatggtttcaggtcttacattaagatctttggttttttgagttaatttttgtatatggtgtaagttaagggtccaacttcatgtctaacattaattttaatagccatataatattcagcagtgtggatatttcataatttagtagttttgctgttataaacaatgtcataatacatttttatattggtgcttttattcctgtaagatcgattcctaaaagtgggattgctaaggcatataagttgtttatccactcccttttagggtagccaggaaagccaggattcaagtatacacgtttgttaataaatgcagtgaatggtaaggttaaaactgccaagaacttaagcactttaaaagcattttcatctgaacaaacttgtgaggaagttatttgaaaactaggggaaatgaagagaaagactattttaaaactgctggtagcaatcttcctttcttacaagatttgccttatttaatctcttccaacaaaagtaggttgatgttttttcctggtaggcaaaagatgagagcgggtttggcctggctgtccagagcatgaagggcacatattggtctgttgtcaggctcagcagcatggctgactaaagacattgacatcatgaca

SEQ ID NO: 115346 - DNA, 182 bp, Homo sapiens
agcccagtctgctcttctcacagccttcatcatctcagttgagagctccctcatccttcaggtgctcaggccaaaaatctaggtgtcattctcaattcctctctctcataccacacatctcatctatcagctaataccatggctctatctttagaaccatttcagcatccagtctcttcccc

SEQ ID NO: 115347 - DNA, 637 bp, Homo sapiens
tcaaagtttgtgggaagttaaatgagttaaatatagggctattagaggttcatgtcactttaagtttaatatgtatgaaatttacgctctatacaatgtagtggggaatgaattcttttggtcagcttttctagtgaacaatttgattcataaaaattttatttttgtgcagttttctaagagtttagctgctgtataaggtaagatgtaccttattacttatagctttcagcagaattctttgtgtcagtgaaatgttgatatggtataattattatatggccaagtaaccgcttctcaccatagagtcataaatccagtttagccaagtgggttcagcagttattcctattagcagctgattctagtagtaagatgactttctttcaggtttcagggaaggggttccagatagcctgaagttgctttgtagatgctgtgtttattgaagtagtttatcttcccatttgcttatttatgggcttatttcctcataggtggatgtctctttgtgccctcatttggtatttggtgctgaaactaagcatggtgctaccattcaagaagagtttaaaaattggggtattttgactgcagtattcatgacatattcatgaatacgatttcatctctccgt

SEQ ID NO: 115348 - DNA, 510 bp, Homo sapiens
taggagaagagaatgctgaacctatatatatcctccctctgcaccactctgtgctttatatgtgggtccattaagcaaacatttggatggttgatgaaggatactgagtgacaatcagattttcttgttcactttattactgaagctatcctctgtgatggccttttatgagatttagtggaatagaattagattcacattctgtacttattaaaagagactcttccatatattcttcacctcctcctttgtgtccttcttgtctgtccttatctttctcctccttttagtcctcttcctgctcctcttactcatgcttgctcgtttccttctccttgttctccctgttttccttttcctccttctccacatgctccaccttgtcctcctcctaatcatccttctcttcatcctcttcctcatcctccttctcatcctccttatacttgtcttcctcctcctcctcctcatgctacttctccctttccttgtgctccctattcccccagg

SEQ ID NO: 115349 - DNA, 316 bp, Homo sapiens
caaaccacatcactccttcaatttttttctggtagatagtgaaggtcagcacctgtgggaaaggatgaaaaatgggtctgaagaagcaaatggaagaactcagcagagcaggagatgtgaatgctcacagagatacagctagagaccagcatgaatggtggaagtctcttggtagagtcttgcaagttgggaagagaaatcacacatgttccgcccctgagcagtgtccccttgattgcagcaccgtattagattgctgcaggagtgtgggtgtgtgtgaaagagcttgcagaacaccccctaacattcctggcca

SEQ ID NO: 115350 - DNA, 358 bp, Homo sapiens
actgagccaggccttgggaagacaaaggggaagagaatccttctttgtccctacaccatgctgtttggcagatgagaggagctaccaagggctgggactttctgcaggtgtcaaagtcagagtgcccagatctgcatccactcatcttgcttttctttttctggctcctagttggcccaagtacttcagcattgtagcactgataactctcacggaggtctccttccccagaccctttgaggaacagaactcccacactctgctgtcactgaacccgctgtcgccagcaagctctggcctgcccttgtctatggggcatttagagctggtgtctacggcggaacagaccagaaataaa

SEQ ID NO: 115351 - DNA, 360 bp, Homo sapiens
gcttaggcagagaagcaagtgtgattaccagtctgtatcacagacacaaagacgccagtctaaggaaactggactttgtcctctaggttcagggtaagcgctagagggactcagataaaggaatacctcaggaaggccagcctgttagtcacacagaagcaggcagagcagcaggcagagcaggagacagagcagaacaggagacaggctctcctgaccaccgcttcagtgcgggcggagtgagcacattacagcaacagtgagccactgtgtgcaagccctggtgagggtgaggcaggtggtggacaggagagaccagtgtactggcctctcgtgtcggggctagtggggggggacccc

SEQ ID NO: 115352 - DNA, 931 bp, Homo sapiens
agcgggcagcgagcgcagcgcagcgcagggagcgcaggcggtggcggcaccaggttcccggggctccagcgctcggcgcagcgaagtagcctccggcggtggcaactacggcggcggcgccggggcgatgctgtgggtctcgttgggcgccggtgtcctggcctcttcctcagaacgaagaacaaactaaattcatctcaaaatgattataaatcatcaagaaggagtagcctgccacctgaactactcataggaaatgacattagaggaagacttcaaagaaacattaagaacttggatcccattcacctgaggcacccgaagaagagaccatccatatttccaggacggaaacacaccctttccttaggcgtcctgcgtcccccgattcctgctccctggttgccgcgtccttggctggcgtcagaaaaatggctacaaactttctagtaggtgagaagatctggttccacaagttcaaatatggcgatgcagaaaggagattctacgaacagatgaacgggcctgtggccggcgcctccctccaggaggccagcatgatcctccatgatattgccagagccagagagaacatcccgaaatccctggccggaagcttaggcccaggggcgtctagcggccccagcggagaccacagcgagctcgtcgtccggatcgccagtctggaagtggacaaccagagagacctggctgaacgtgctggagaagagcttgcccggccactgggccacagccccgcagacccagcacatgtctcccatgcgccaagtggagcccccggcaagaagctagccacaccagcagaggatgacgaggacgatgacattgacctgtttggcagcgacaatgaggcaacacagctgcggcattaccaatgaggagcggctgcagcagtacgcggagaagaagg

SEQ ID NO: 115353 - DNA, 990 bp, Homo sapiens
agcgggcagcgagcgcagcgcagcgcagggagcgcaggcggtggcggcaccaggttcccggggctccagcgctcggcgcagcgaagtagcctccggcggtggcaactacggcggcggcgccggggcgatgctgtgggtctcgttgggcgccggtgtcctggcctcttcctcagatgaaaagattctgaagaatagagatcttgaacatagcatggtgccagacacataacagaacgaagaacaaactaaattcatctcaaaatgattataaatcatcaagaaggagtagcctgccacctgaactactcataggaaatgacattagaggaagacttcaaagaaacattaagaacttggatcccattcacctgaggcacccgaagaagagaccatccatatttccaggacggaaacacaccctttccttaggcgtcctgcgtcccccgattcctgctccctggttgccgcgtccttggctggcgtcagaaaaatggctacaaactttctagtaggtgagaagatctggttccacaagttcaaatatggcgatgcagaaaggagattctacgaacagatgaacgggcctgtggccggcgcctccctccaggaggccagcatgatcctccatgatattgccagagccagagagaacatcccgaaatccctggccggaagcttaggcccaggggcgtctagcggccccagcggagaccacagcgagctcgtcgtccggatcgccagtctggaagtggacaaccagagagacctggctgaacgtgctggagaagagcttgcccggccactgggccacagccccgcagacccagcacatgtctcccatgcgccaagtggagcccccggcaagaagctagccacaccagcagaggatgacgaggacgatgacattgacctgtttggcagcgacaatgaggcaacacagctgcggcattaccaatgaggagcggctgcagcagtacgcggagaagaagg

SEQ ID NO: 115354 - DNA, 545 bp, Homo sapiens
agaagttgttataggatctaccattgtggcttaattacaaaaatataaacttaattcaatattcaacaaacgtctattgagaacttgtagtaggaggatactatggtgaattagaacagccagtggagttgacatttgagtttcgtaaagatttgaatgtcttgtttccagtgttaaatcccagcaatttaaaatgtaaatatactgcaaggagtctaaaattttaaatagaaagatttccctttaatctgccataagagagtgtttcatgtaaatgcgtgagctgagcttgagaagcagcaggaggatcggcatcctgtgcacacacacggagcagaacagcgctgatgagcagcagtgccggactcatattcgcagaatcctagccatcttcccgtgagcatagagcatctgctctgagttcaacaatggtttacctaggaatcttttttttccctctttttgaagctggcattttatttctgtctttttaaaattataggcatagatcacaggctttttatctttcatagatgctgtgtttc

SEQ ID NO: 115355 - DNA, 531 bp, Homo sapiens
aaagagaacccctgctcaaccccaagacatgatcatgaggaagccacaccatctagacaaaattcttgccacaccatctagaactttggacgtccccatttccacccactccctcactccccaaagccagacaagcaccaagttccatcacctccaccccctgagggcactgacctccgttctccaagccaagttctggccccttccttctcacctggaccaccatatctggtaccctggcctccagttcccctcccacactggcctgaccctgacagatgcttctcacagctgtgttgaatgcaacttcagcaccatgcataacattctcccggccccctttaccctcaggaccaagtccgagtttctcagcctagaatttgaggccctttgtgaggtggcccagccacttcctcacctcacttctcattcctgtgctccaagcacacacgggatctcacagccccctggccagaccttgaatttacacagctccacacgcaaaggcttatgtgttttcctcgccctggg

SEQ ID NO: 115356 - DNA, 388 bp, Homo sapiens
gaggtcatgccactgcactccagcctgggagacagagctagactccatctcaaagaaaaaagaagaagaagaagaaagctaactcagtacactaagagtgatttacatgcctgcaaataatttgtgtctggggtcttgaccctccccaaatgccttgttatttatatctctgcttttagataacagatggtcatgtgtctatgggcttgtaccggcagaggcaacagcaggtccttaagactccccaggtgccatgatgaaaagaaccttagaaaatattgaaataatctcaaaacttaaaaaaaaaaataccagaaataaaagctagtaaaggtgagaggtgtggggcttttggaacatagagcataataaatcagaataaaaagta

SEQ ID NO: 115357 - DNA, 672 bp, Homo sapiens
aacccaatgtccattaatggatgaatggataaatgaaaagtgatatatctaaacagtgaagtattattcagccataaaaaggcacaaataactgatgcatcctacaacatggatgaattttgaaaatctataccaagtgaaagaagacaaaaaaggccacatgttatatgattccatttatatgaattgtccataatagacaaatctataaagacaaaaagtagactagtggtttccaggtactggggtgggggagatgacagaggggtagaggtttctttttaatgaaaatttttctgaagttaaacagcagtgatggttgtacaactctctgtatatattaaggaccactgaattgtatagtttaagagagtacatttattatttatcctattaaaatttaaatcctaagaatacatttttagcactgagagttattttttatttccctgaatccttgggattgcagagaagggtaagacagtagatttggagaaaggatgaaatgtggttagctaataaaacatttgggagaagaagtagcaatcatccatgcagtttctctcccttctatggaatccctttgtatgccgtcgaattatgaccacaacatgaaggcctatcagatgaggttttgagatcatttggaagatactgctgtactggctaagg

SEQ ID NO: 115358 - DNA, 245 bp, Homo sapiens
aagaaattaatgtcacaccttcttttgggatagatcattaatttatttaagaaatcaataaaaaacaagataaactaatttacagagattgttgaaatgtcttatagaaggcacagtaaaatacaacagtatccaatccctttctttctcagctctgaacacttatgaaagacatacaacatcaatttctacagaaaagaaaaccccacacaaatccattcttgcagaattctaaaagatagaga

SEQ ID NO: 115359 - DNA, 745 bp, Homo sapiens
cagcctgccctgatcatgttactctcattggttctttctgcccttttgtttgcatcgttcctctagaccatcacatcctttcttacgctgttacatgcttctttctttctttctcaactagatagtaaggcactgatgtgccttttattctgtctaccggccctggccgtaagaagcacttgataaatacaccgataaaatgaataaatgtaaggatgattttttttaaatcatgggctttgatactgactctgaactgctcaccattgggtcctcagagcctaactcatagcctgacacatagtcatgacctcaataaatatttgttaacttagaaattcatgttgacattggataaaagggacaggcatttgaaggaggcgtctgtcaagatttttttttcccatttttcttcagtagttctaatcagcttctccattcatcaactgtgagaattctgaggactcggcatttcccagagttgggataatgatggagtctggcagttgtgagttggaattaagaagcttgtagttattttaaggtggagtgatgggccccagtactgagcaaaaaaagcattgaggctttatgccagtattttatacgtcaaacaattaggctaaagttatcagttatataaaagttcagctaattggctctaaaatttcagactgtatttattgcagggctgctcaagtttttcatttaaaagcatccctgtaaattagaaaaaaatacatct

SEQ ID NO: 115360 - DNA, 130 bp, Homo sapiens
caaactgacagtttccaaaactgatataccaggaaataactgtaagcataaaattttcagatacaatgataacatcagaaaaggcagttatataggctggatgcagtggctcatgcctaaaattccagca

SEQ ID NO: 115361 - DNA, 362 bp, Homo sapiens
cgttactctaaggatccccccgtcactcgctcttgagcagtagcgagggctggcagagtagggtgggtggatgttgtaaatgggggcggcttgaataagtatgtttcagagttatggagagatggtcatgatgggcaacagaacactacctgtttggggaagtgtgctcagatgtttcaagcacttgggagcagcttatatggtagatagtcaaggttttcttcattccgcctcatggagaagataattggaagggccacaggaagttattggcttccttgaagcattttccaatagtttagatctcatgaatcagatcctccatgcagatgatgccatatttaccaagagcgacggacagg

SEQ ID NO: 115362 - DNA, 386 bp, Homo sapiens
gtgatttcctcagtgacttaggctgtagttgttagtggaggctgtggtgaggttttactgaggatggggatgccaggttatcagtccttatgccccagttgcgagccaagtgtgtctttccgtgggcctccagatgtatgtgaacaccagcattgggggtccaaacgtgccgattcttggaccgccaggagtcccttgctatagtgctggcagtgacagtggtaggctgggtgtgtggctgagtctatgaacccctggataatgtatgtggcataggcaatggcagtagcagtggtgacacaacacttggactctgaaacagcatatgttggtgttagcggtggctgcaacaggcttgggaggtggtgcatgtgggggtgggagag

SEQ ID NO: 115363 - DNA, 379 bp, Homo sapiens
acaacctccagggagggacacgtcacgcgccattctctggaagaggatccttccttcttgtaggaaacctgcttgtgaagtgttgagtttagacaacggaaagatcacatcagtatccccttagaaagggttccactaaatatcggtgctcgttcacaattctttcttcctcttttctacttatgaagctagcacgtgctcttgtggagaaacgtgacctcacagaaacacatgagctagagaggggagccctgcccggcccacttcccctttctccctggcagctgagagccatccatgcgtggcgtattcctctgggaagaccttgagtatgtagagtccccagaatccaacttcattcttcttgagtgccacaagg

SEQ ID NO: 115364 - DNA, 450 bp, Homo sapiens
cagggatgacttgtgctagatttcactcatctctgtatcctcccacaaagactggcctcctgattactaaatatttgagaaatttaattgaggggattgactgctgactctgtataggtcaatagctctctggagttttgttctcacccagagggagaaagatgagggagaggaggctgcaaggctgctggctgagggttccgtggccttggtggaaggggagtaggcagcaggaagagagacacattttcaatggggtgggtcaaccctgctgatgtaagatggcaatgtcatagctgtggtttcaacactgaagaaatactagttatggctgggcgtggtttctcatgcctgtaatcccagctgttgggaagctgagacgggaggattgcttgagatggctaggtctagactagcctgggaaacagcaggaccccatctctattaatt

SEQ ID NO: 115365 - DNA, 472 bp, Homo sapiens
acagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaactataaaaaaaattgtatggattccacttacatgagataactggaggggttagattcatagagaaagaaattagagcagtggttactagtggctggaggcaaggggggggaatgaggag

SEQ ID NO: 115366 - DNA, 551 bp, Homo sapiens
tgctttcttagcttcagccttagcactttcattttcttgagatcaaggtgctcttcctgcttatgaagcaccatgaaggtagaatcacacctcctctcccgctggttttctactactcctacctctctgccccccgcccaccaaccccaccttcactctctacttaaatatcccctcctcagggaggctttccctaagcaatctctggacaatggagtcgtgcattcccttattattttttaaacatctaatatccctgctacactggaagcctgaaatcttcaggaaccatatctgcctgtctatgaatgcacacacagcacctagcctagtgtgggctttcaacagatattttggagactgagtccatgtgattcagtctgcattagtagtgcctaatcaacaatgaatgatcattatcttttcctccatggagccacttacatcaattaaagtgtgaggcagtctcccctccaccccaacccctatacttttcccacctgatcttccaactgaagttctctggctcccatacttgccccggaggaatg

SEQ ID NO: 115367 - DNA, 479 bp, Homo sapiens
gaataatcaaccggcaaaatagtaattttttattagctatatttgcattattaatacctgtataggatacattttatacatacgtatatgataaaatacattttatggaattttatatcttgcattttcatcacctaatacacaatcagtttcccttttccctaagtatttttcaaaagcagttagaaaaatagccgtataatagttttttgatgaacaatttctctgttgctggacatctaggttatttttaaaatttcaccatcttaagtaatgccatgctacacacatttctttgtaaatcttggcatatttgatttttttcttggtatatattctttgaaatggaattactgggctagataataggaacattttcaaagttctagatattaaacagttttaatttcagtgatcctttgagagccttaactttaaggactgagccacattattacctgggtgtataacctttttgt

SEQ ID NO: 115368 - DNA, 350 bp, Homo sapiens
caaggagccgggaatcatggctcatcccttgccacatttggtctgacccatccccttgtgagacctcacctccccttctcctcacctcctgcacatccctccactgagccttgtgggacttagggctcagcagacccgccaggtcctgagtgttccctgctcagactgagctccaggggactgcagccctctgagtgcttgtcatcctcttccctgcctccatctgagcccaggcccaccagggacagggtcctcgcctctcatgattgcgtctctgccagcctcactccctctgtagagaccctgcctttgggtctcaggcctcgtcttttttgctgcttctgcagacc

SEQ ID NO: 115369 - DNA, 334 bp, Homo sapiens
acagggtctcactctgtcagccaggctggagtgcagtggtgcaatctcagctcaccgtagcctcaaactcctgggctcaagcgatcctcccacctcagcctcccaagtagctaggactacgggtgcatgccaccacatttggctaatttttttttttttttttttgcttttggtatagatgaggtcttactatgttacccaggctggtctcaaactcccggcctcaagagatcctcctgccttggcctcccacattcttcctttgatttcttgctggagctcccccttagccaaacacaagcagaagtcagagggacagagagcagggtggagg

SEQ ID NO: 115370 - DNA, 492 bp, Homo sapiens
atattattttcacctgtgtttgttgttgttattgttgttgtttgttttgagatgagatctggctctgttgcccaaactggtttcaaactcctgggttcaagtgatcctcctgcctcaccctcccgaataactggtattataggcatgtgccaccacacccttcacctgttttttaaagctatgttttagtgtccagcctcccactgaattaatagagtaacatgaaagactgttgtattctctgcctctaagttttcctccctctattctatcttctacattgtcacaataattttctaaagcatgaaataattatatcattgccctgcataaaagcctttaattatctgttcttttcaggttaaagtgtaagttccttatctggtcccaacctattttttcttttatctcttgttaatctaatgctagagactctgaactctattcatacttaactgttccttgtgtaggcctttttttcatacctgcctt

SEQ ID NO: 115371 - DNA, 766 bp, Homo sapiens
tttggtagcttagggagttacaagtttggtagctcatggagttgccatagacatagaatatattgatttttaatcacagcacacaacaagatgtacatttatatccttgtgagtaagtgaatatggttgagagaagaggttaggttgacaaagcaactactaaaaaattgtctttttccctctgtcttatgggtaacttggatgaaaacatagaagatgagcttataatatatgatgattaataaagtagggagagagagtcagttggatagaagagtttctatttcaaaatcccaggttgccacagtggctcacacctgtaatctcagcattttaggaggccgaggcgggcagatcacttgaggggaaaaaatctaaataaaaattttaacaatcatataaatataaagccaagatcttaatctggaatgggaaggttaagaccattcattaattcaacaaatatttactgagcagccctgagactgttttccttggggtctgggaaggggagccatggtcaatggactcttgttatctgtaggaatattgatccctaccacaaggtacagggacagggaataaaggggagatagtcctcctatgagataaaggtaggggatgttctacagggcccagttttatatttttcttttctgccttgttatttcttctcatgattttctttcagtaaaatctctttcccacatctctttcagtaaaattttgttaaatgatagtcttgttctctgttttggggaattac

SEQ ID NO: 115372 - DNA, 591 bp, Homo sapiens
caatatctaaaatggtatcaatattctgaatgagaaataatctcacaataatataagcaatataagtgcctcctgatagatatggttttttcactattcaactttttttctttatttttcttctagccaatggtgaaaataaaagtaaaatattttatctgttatccttttggtaacaaattacttaaatttcctgtactttgtagattgatttttttggtaatatttcttcatttaatgtaacttaaaaatgaatcgatattaagagttaaagatttgctatggtgtgaatatttgtggcctcaccaccaagatttatatgttgaaatcctaactcctaaggtgatggttttaggaggtggggcctttgtgaggcgcttaggtgtgaaggtggaaatctcatgaatagcattagtgctccagcaagagatcctcaatgaagaccttttgcccttctgccatgtgaagacacagccagaaggtatcatctataaaccagaaagagggcccttaccagacattgaatctgttggcaccttggtcttggacttcccagtctccagaacagtgagaagtatatttctgttgctt

SEQ ID NO: 115373 - DNA, 404 bp, Homo sapiens
agttgtaaacagaaggacctaggagcaatgggactactctttcttggccaaaaccagaagtcatgtccttttttcaaatggggaggctaacccttttaatcaattatcagtgaaagcagcagcagcatatatgtaaataaatatatatatatgtgtgtatatatatgtgtatatatatgtatatatgtgtatatatgtgtatatatgtatatatatgtgtgtatatatgtatatatatgtgtatatatgtatatatatgtgtatatatgtgtatatatgtgtgtatatatatatgtatatatatgtgtgtatatatatatgtatatatatatgtgtgtatatatatatatgggtcttgctccactgcccaggctggagtgcagtggagcaatcatggcttactg

SEQ ID NO: 115374 - DNA, 452 bp, Homo sapiens
actagctgcgggaccttgaacaggttatgtaaattctaaaccatacgtttcctgagggttgttaggaggattaaatgcatatataaagtgtttagcagaatatgtggtgagcccttcctacaatcttagctgttgttttgtggtctttggtctctgttttgggagagtagccttagtcccaggactttttttttctttcttggagggtattgtctcctgtcctgccttacctcattggcaagtatatttgtttttgaccatgaaaacagactgtgtgtctcctccttgtcgctagagttttagttacagctgccctatatcaggttaaaagtgggtgaagtagacacaagggtagtgtatttgttcctacttggctctactttcatttgtggttggagaatcttgtctgaattttgtatttatttatttatattttattctattattttttt

SEQ ID NO: 115375 - DNA, 1237 bp, Homo sapiens
aacaagtcctctccctctaaaagccagcaggttgaagctttacgcatccagaggcagaaaactaaagatggaacagaaaatgtatccagggttttccagatgtggggagaggggttaagggagccctgaggagaggagagggtaagggtcttggcagaattgtgccaagggcacaccaaggctttggccaaccggtcgcccctgctaagtaacagtaatccatgtatacaggcgaaagtctctaagaggacagaagagtaaaaaggaagagtagagttaagatgatgatcccagttctccgtcttgtaccccagggaagacctgtgtatccttccaggtttctttaggcacatttacaagtacatacacttggacatataacctttttttcctacagcatcatgatcatattagccacactttcagagtatatacttaaaaggtcttgctatagtggcacagatatctttcattctttttagatgactttttttttttttaagcacagtctctccactacctctctttccctaactccctaatctttaacacattggagagaatttaagccagggacaagcactcacacaagtgacatccctaccctgacaggcctgcttgggtggcaggtctactcgtcagtcccaggctgggcatttcctgacagaggtccaggtccggcagacagcaaggcacaggaagtgtcctgctgtgctcactgactgcgtgggctggcgggggtggggggctgcaaatatccatgtcggacctgagcagtctcaggcttgccagctccaggcagggaggctgagaactggctttcagcctggggaggagtttggaggattcgggagggagaggtttgtggggttggtggtggcgagagaagaggacaggaggaaggagagtgtgaagggaggcaaggggctgtgggcagaggggaaaggaaggtggcctcgggtgaggggatactcagagactactcagctgcctgggccaggcccctctgcagataagtgtggctggggtggtggtatgcagggctgtgtggggctcccagctgactggctgcgtctgtagcagccccactattcctgccctgggcctcaaaccaggagcgtcccaggccttaggtcagctaaccaaggcccgacattgctggcaggggtctgcaggggtttctgtggatactttgacatttttcacaataaacatcctctgttttgaaaaaaaaaaa

SEQ ID NO: 115376 - DNA, 508 bp, Homo sapiens
atttaatacaggaaacttggtgctgctgaaatcatggggcgtgtgggtggtaggagtggcggtctgggtttgagactcttgagttcgagtttgcagcccccgaatgagctcctagctagagttcagcgggatgccactctggcttccggcagtgcctggactcatttggtcactcctgggaagctactgacttgatgctggtatgaggggtgtggccgcctcacacacaggtgatctactttcctggccagtggccagccaggagcttcaggcaggtgcctgaccccaattcccctgcagtgtctagctgcagggaagtctaggatatgtgacttctggctgtacagccacaaacccagctgcagctctggattagaaagggagattgggcagggtggctcacgcctataatcccagcaccttgggaggccgaggtgggcagatgacgaggtcaggaattccaaaccagcctgaccaacatggtgaaaccccgtctctattaaaaata

SEQ ID NO: 115377 - DNA, 176 bp, Homo sapiens
aggtaattggggagtgggagactatgatccaactctgttcagtttagatggcttgtttcatctaatgatgctgggaacccaagtcgcccaagctactgtcatcattgctaaacaaaaacccaggccttagaatagctatggttcccctaaattagtaaggactagacctgaggtgg

SEQ ID NO: 115378 - DNA, 273 bp, Homo sapiens
gtttgtgcatgtgtgtatgagtgtgtgtgcatgtgttgtgtgtgtgcatgcatgggtgtgcatacatgtgtgtgcacatgcttgagtgtgcacatggctgtgtgtgtgtgtgcatgtgtgaggtgccatgctcttgatggcctggggcttctgctgttatttggcagtgctttggctctggatctgcttccctgctccccattctgtccctcccatcttacccagcatctccgggtgtgggctccgagcccgggcacaggcaggtaccccctg

SEQ ID NO: 115379 - DNA, 339 bp, Homo sapiens
ttttcctgtgtcagtaaggtttcactatagccttccagttgccccaaatgaacatctttgagtcaaacttagtcttgttctttctcacacctgatgttgttgattagaaaactatgccaggtttggccggatgcggtggctcacgcctgtaatcccagcactttgagaggccgaggcgggcggatcacgaggtcaggagatcgagaccatcctggctaacacggtgaaaccccgtctctactaaaaatacaaaaaatttgccggccgtggtggcaggtgcctgtagtcccagctactcgggaggctgaggcaggagaatggcgtgaacccgggaggcgg

SEQ ID NO: 115380 - DNA, 301 bp, Homo sapiens
tgaactttaagtatgggaatttgtgtttatttttgtgtttcaaaacgataaccacctgctgccttgccagattcttgtttcttccagtcaaaataatatagctcttaaaagttcattttctcaactaagaagcacaatattagaagaaaatgttcttttctatttctttaatttctatttgttcctcaagttgatcaccaaatcctgagggtaaggaaatttacttcaatcatcatatatatagcatgaggcacatttaggaatcttgtagtccataatccaatcacatcctccttttctg

SEQ ID NO: 115381 - DNA, 400 bp, Homo sapiens
aactggctctctgtgcttagtaagtacaaaagaaaggaaggaaagaaggaagtctaccagtggcagatgaacagaactttgtgagaagacagaagacttaaaatgtcatacacaatacccatgacctacaactacctgataattacggtcttccttcagtatcctccaaggattgtttccaggggaatcactgataataaaacccttgggtgctgaagtatcttatataaaatcatgtagtctttgcatataatcaacacacatccttctctgtactttatgtcatctctaggttaattataaaacctaatacaatgtaaaaatgctatgtaaatagttgccatactgtattcgttttttatttgtattactttttgttgttttattgttttctttcttc

SEQ ID NO: 115382 - DNA, 272 bp, Homo sapiens
ggagctaatccataatgtgtgccagccaagccacgtaattatgagaaatattgcgtcattgttttaagccactaacttttggggtggtttgtaagtagaaaagttaacagaatctagagctggaaaattttagcatggaaaatgacgctatttcataaactgtattatctcatttaatccccacaaccttttgagacagctactattatcctgaaaagcagagttatgaggctcaaagacgttaagtaaccagtccaagataacacagctaa

SEQ ID NO: 115383 - DNA, 655 bp, Homo sapiens
acggggtttcaccacgttagccagagtggtctcgatctcctgatcttgtgatccgcccgccttggcctctcactgggattacaggcttgagccgctgcgcacagccgagagttttaaattttttttggagttcttccaaaatgcgagatgcaagaaaatgttcttaaatggaataagacaactttaagtccaattgtagtccaaaccatagaaactcagaattcaggacttttgaaaattagggcaggtattcagttaacaagggctattttaagacatgacatttagttcacgtaggttggagattttgtttgacaaagatcttaaaattacttctggcctttggagttatgacatgctgtctttgtcaccttctccttccttcttccccctcactcaccaaaaaaagatgaattttcttttcttttctttttttttattttgagacggagtttcgctcttgttgcccaggctggagtgcagtggcgtgatcttggctcaccgcaacctccgcctcccgggttcaagaaattctcctgcctcagcctcccaagtagctgggattacaggcatgcaccatcacgcccagctaattttgtattttcaatagagacagggtttctccatgttggtcaggctggtctcgaactcccga

SEQ ID NO: 115384 - DNA, 723 bp, Homo sapiens
agcctcagtaaatttaagggaattgaaattatataaagtactctatcagaccacagtggaataaaactggaaatccactccgaaaggaaccttcaaaaccatgaaaatacatggaaattaaataacctgctcctaaatgatcactgggtcaagtatgaaatcaagatgggaattaaagaattcttcaaactgaatgcaaatagtgacacaacctatcaaaacctctggaatacagcaaaggcagtgctaagaggaaagttcacagctctaaatgccaacatcaaaaaatctgaaagagcataaacggacaacctaagttcacacctcaaagaactggagaaacaagaacaaaccaaacccaaacccagcaagaaaaaggaaataaacaagatcagtgcagaactaaatgaaattgaaataacaacgaaaaacaatacaaaagataaatgaaacaaaaagcttgttcttgaaaccagcttaataaataaaatagataaataaaactgattgaacattagcaaaattaaccaagaagacagaaaatcccaataaactcaatcagaaatgaaatgggagatattacaactgacaccacagaaatacaaaagatcattcaaggctacgatgaacactttcatgcgcatgaactagaaaacctagaggaggtggataactccttggaatgatataaccctcctatcttacaacaggaagaattagata

SEQ ID NO: 115385 - DNA, 1828 bp, Homo sapiens
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttccaaaaaaaaaaaaaacacaagaacaaaaaacaggggtggggggcggcctaggggcactggaaaaagtttttaaaacccattggttgggggcgcggggcccagtagggtagtgtggaacacgggcccactacggggtccaagaagaaacccggggcagaacacagggccggggtcctccccaattaaaaagcgcggggggggacaccgacggggttgtgcacacatcccagaggggcgcgaggcacacggggcctatccaacgggaccacgggagcgaggataaatc

SEQ ID NO: 115386 - DNA, 1774 bp, Homo sapiens
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccaggtaggtggccatcaccatgacgccatagtgacgtcatatgacggtttgagagggtagagctgagagacgtcactaggaagggaaggggccacagaaacatttcttttccctgtgatggcagtttgttggcgaacatcaaagaacccgagggtgggggggatggacgggctcccaggcaaatggccgtccttgtggccgcgacacccagttgtcgtcttgttgccttgcagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttcca

SEQ ID NO: 115387 - DNA, 1435 bp, Homo sapiens
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttcca

SEQ ID NO: 115388 - DNA, 1810 bp, Homo sapiens
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgagtcacagccccacacagccctcacccctgcgcccttgagccaaactcttcgtttactctcctcttttgctatcaggtgcagtattttggggaaattgggctgggaacgcctccacaaaacttcactgttgcctttgacactggctcctccaatctctgggtcccgtccaggagatgccacttcttcagtgtgccctgctgtgagcttctatgtgggagaataaggctgaatgggggtgaagggaggaggcggggctggacctcagcttctcagaggcttttgaggaactgttcttttatcatgccctcacaggtcagaaagtcaaaggggcagtaggcactggggagattccctcccccatgacacctttctgacctctaacctagggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttcca

SEQ ID NO: 115389 - DNA, 1336 bp, Homo sapiens
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgaatccccttgctggctggggaggtgaggtcccagtctggtgggtacgggctgggaaggctgatggcagtttgacagtgaacatcaaagggcctgagggtgggaggcaagtatttaaggggctttccagggcagcaggcactggacttcgtgacagatagtctggagggtggtggaggaattgaggacactttccacgtgtctacactgcgactctgcggatggtggccgggtggagggagacgatcatgcaggtttgcttgggactgcgtaagtctaggcggcagggcctctgcacacaggacgctgagtacccaggtgctcaatagggaaattaccctatggcactggggagccacggaagggactgaacagagcaggaatctctcatcttcactagttcctcttctcccccagtacatcatcctgtgctcggaaatcccaaagctccccgcagtctccttccttcttgggggggtctggtttaacctcacggcccatgattacgtcatccaggtaggtggccatcaccatgacgccatagtgacgtcatatgacggtttgagagggtagagctgagagacgtcactaggaagggaaggggccacagaaacatttcttttccctgtgatggcagtttgttggcgaacatcaaagaacccgagggtgggggggatggacgggctcccaggcaaatggccgtccttgtggccgcgacacccagttgtcgtcttgttgccttgcagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttcca

SEQ ID NO: 115390 - DNA, 1544 bp, Homo sapiens
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttcca

SEQ ID NO: 115391 - DNA, 1445 bp, Homo sapiens
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttcca

SEQ ID NO: 115392 - DNA, 1517 bp, Homo sapiens
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttcca

SEQ ID NO: 115393 - DNA, 1420 bp, Homo sapiens
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttcca

SEQ ID NO: 115394 - DNA, 767 bp, Homo sapiens
aggcggaagctgggctcctccctgcgtctctttctgggccgtggagctgtccgctctgaaacctgaggaagtcgtagttcagggaggggtagctcttgcacctaggccgttaggaacgagttttaggttcgaatcccatcttatggaaggtggtattggtcccttgggtgtcccacccgtctcagccaaactgcgggccatttcccggggcgagcaaggggagttaccgcgccagtgggtggactcgccgcctctcggagtcgggaggaagtcgagctggggtgcagttacgagtctcagttaataatgaatagggtggccaatggtgggccaggcacagtggctcacgcctgtaatcccagcactttgggaggccgaggcgggcggatcacgaggttaggagataagagaccagcctggctaatatggtgaaacctcgtctttactaaaaataaaaaaattagctgggcatggtggcgggcgcctgtagtcccggctactcgggaggctgaggcaggagaatcgcttgaacctgggaggcggaggttgcagtgagctgagatcatgcccttgcactctagcctgtgcaacaagaatgaaactccatctcaaaaaaaaaagaaaaaaaaagatttcacctcatggtcaaattggttaggatttgatggaataatctataaggtttcgtgtaaacaaattggggttaacattaataaactaatgcaagggtaaaattttgctttgaacaagattttcatttcataata

SEQ ID NO: 115395 - DNA, 470 bp, Homo sapiens
ggctctgtttccttctggaggccctagggaagaatccatgtccttgcctttcctagcttctagaggctatctgaattccttggcttctgccctccttcctccatcttcagaaccagcaatgctacattgagttcttcagtcacatcatgctgaccctgcttccgtcatctcatttcttctttgactcctttcttctgtgagcctcttctgcttttcttttttctcatttctctcttctgctgttaaggacctttatgattacactgggcccgtcctaataatctaggatagtctatgttgttttgtttttgagacagggtctcgctgtgttgcccaggctgaaatggcacaagttttctacaagtttttaataaaacttgtggggcatgatcatggcttactgcagccttgacttcccaggcttaagtgatcctcccaggtcagcctcccaagtacctgggactataggc

SEQ ID NO: 115396 - DNA, 272 bp, Homo sapiens
cgttacctaataagtgtcagttaccaggacaagattgatttctctaatagtcaaaattccttccgttgtaatgatccaatgtaagtagagaaaatggaaaacaaattttttggctcacataatcaggaagtttggattcagggatttgaaaacaaggtcattaggccaggcgcggtggctcacgcctgtaatcccagcactttgggaggcctaggcgggcggatcacaaggtcaagagatcgagaccatcctggccaacatggtgaaacacc

SEQ ID NO: 115397 - DNA, 645 bp, Homo sapiens
taattttccacagggtaataaaagcaaaggtttccattgccaattgataaagaaagaaaactaagcctcagagaggtgagaagatatgcctatattaatgtcactaataacaggcagggaagggacttgactcctggtctcctgactcccactgcacaggctaccatgaaagatttcctaggatggtggttcttgaaggagggcctggcccagtagcatcacctgagagactgttagaaatgcaaattcttggactccatctcaaacctactcaatcggaaactctggggttggggccctgcaatttgtgcttcactaagccccccagccgatactgttgtgcacacaagttcgagaacactgacctgggacatgggaatggataatgagataaaacagataaaaggactttaatcccacaaagcctacatatcaacagagaatgcctgggagcagctggtggctgcttatttcatctgtagacagcgtgagccacgcagtgccctcaaaccgaagtcaagctatttacccactagaaccccacagtggatactggactctgtgcatggttattcagggtgtgcactgtacaactcaaaggcaacagtgcccctgaagatgggctgcatggccattagtgtggct

SEQ ID NO: 115398 - DNA, 728 bp, Homo sapiens
ggccctgagttccgcgtcctcggctgggacgctgggcgacctccggcaagcggcctgaccgcccagtgcctcgctttcctccgctacgaaatggggccgatgacgcagctcaacctcgtaggcgtcgcgtgaggctgaaacgcgcttagatcggcgcctgggtctttactgtgatgtcgctcttggaattatcgttatgcagtgaacaagtgttgggcgaccaaagtgtcccctttaatcctcccacgcgctttattctgtgctcccagtttactgaggagatgatggagacccagggaggggaagtgacttgcctagggtaacacaccatgaacaagaaagaagttgaatactgaccgagagctaggcatgaatgatcatgaggctatatttgtctagttttgttaattctgccagtgttgattgtgccaggtgcaaactgaagtgaaattggccagcaagaggaatcactccaccgccccttgccgtaaccgatagattgacagtagcacctcccaggtacaggtgcagtagctgaggctcgcacaggttgtagggacccccctcaggtcgcagcaggttcacccaggagcccattcggtttgaggccacagccctagcacagtccccagagggagtctgtgctcttgtctctttctggctgtgagactgccccgggggtgacctatgtaaaacctgtgcgtctttgttttgcagcgacgaaaaag

SEQ ID NO: 115399 - DNA, 673 bp, Homo sapiens
tgaagaaatttgtggttcaaaacatttctgcatcttttcaaatcttcattcactcagcagtatttactaaaagcctgtgtggtaccatgtgatgtgaaacagacagatgtggccccatccctcacacagcttattgtaagtgtggggtggtgaggagggtggtgcagagaggcaaatcttaatactgagttggcaattgaaaatatgtagtgagttgcggaagtagagggtactgtgggagcacctaggaaagacaccagcccagatttggcacatcagagaaggctttctgagaaaggagatgtataaactgaaattggaaggacaaatcgggagttagccagctaagaagggaagggggaatgtttgaggtggagagaataaaatgtgcaaaggattgaagataagagatggtgtgacattattgaatcttagagtggagaatggcaagaaataaagcgaaagaagtgggctaggcgtggtggctcgtgcctgtgatcccagcattttgggaggccaaggcgagaggattgctttagcccaggagtttaagatcagcctgggtaatacagtgagaccccatctctagaaaaaataagaaattagtcaaatgtggtgttagtcccagctacgtgggggactagtagtcccagctacttgggagggggagatg

SEQ ID NO: 115400 - DNA, 543 bp, Homo sapiens
gatctttccacctcagcctcctgagtagctgggactacaggtgcatgccaccaagcctggctaactttttgtagagatagggttttgccatgctgcccaggctggcttagaattcctgaattcaagtgatttgtctgcctcaggctcccaaagtgctgggattacaggcatgagccacactgcacccagtcgatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcataaagtcatcctgtttgccacttaatttggttatgttttatctaccacactgcaaatatgttaattcaccatgagaaacagatccctgtacacatgtgtatcagtaaatcattcaatgaatagttagtgcttaggatgtatag

SEQ ID NO: 115401 - DNA, 510 bp, Homo sapiens
agctggaccacaggtggcaccaccacaaccagctagtttaacttttttttatagagacagtgtctggccctgttgcccagactggtcctgaattcttgggcccaagcagtcctcccacttcactgggattacaggcatgagccacactgcacccagtcgatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcataaagtcatcctgtttgccacttaatttggttatgttttatctaccacactgcaaatatgttaattcaccatgagaaacagatccctgtacacatgtgtatcagtaaatcattcaatgaatagttagtgcttaggatgtatag

SEQ ID NO: 115402 - DNA, 553 bp, Homo sapiens
gacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtggtgtctgggattacaggcatgagccacactgcacccagtcgatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcataaagtcatcctgtttgccacttaatttggttatgttttatctaccacactgcaaatatgttaattcaccatgagaaacagatccctgtacacatgtgtatcagtaaatcattcaatgaatagttagtgcttaggatgtatag

SEQ ID NO: 115403 - DNA, 4815 bp, Homo sapiens
agcttaacaagaccatggcctctggacccgcgatcagctcgctgtgtggtcctgagcagccacccaacatctctgggccttggattcctacctggcctttcttctggatgcatcatttttgcctttaggtatctggaccattcccccccatggatgataaagtctttgcttcacaccctcaggattaccttaaaggcctgaaaagaacagaggaggagtctgaggaggtgaattccagccgtgctcttgcaggctggctgggcagtgtgctggggaggagagggagcctctggctgggcctcctccaccgggcctggtgtgctgggaacaccccgcattgtcccaaggcctcagatttgactttcaaagggaaaacagctctcctgataaaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtgggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaagtccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcacggcctaaaatattcataatggttggtgtcttttgaatgaattcatgtcaaaaatgttattcagctggggaaatttctctaaatgtacactgattctgtgtgtgtgattttaaaaggagaacatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcggggtgtcatgtgttctgttatgttctgttttctggttgccagtttgatctgcaaagtatttttcagtgcaggtaaaatgtgttaaaccataagagttgactgagttaatcccaattggttgtgctcatatgccaccttttaaaccaatggaaattgctatatttggggatgtcatacatttgatattgcttcagcatttcaaatatgttgcaaaatttagtatccatatgcataagaagttaatcaccttgccagtggggtggtcacatatagtgttctcaagctttactgtgaatcagaaacatccagtaagcttgtgacaaatgcagactcctagggaaaaccagggggttctgcttcactaggttaaatgtaggttttgtagaggagatctgcactggagcaagtctcccagatgattctaatacaggagggccagaggccaaacttgaagaactgctggtgttacatgttccaaaaggcattagacctatcagctttgtttcgcctgatctcaagttttagcaactcaccaactaaggcgtaacctcattttatgttccagcgttttctactctgaatagttctaaaacactgagcattttctcatttgttgcattactgattaaagttcagtatttcatggtgttttcagggatcacagaaatgcggatgcaaaacaacttttgacagaggcccatcaaacccagatctgcacttggtaatgacttaggggggcttcctcacaatgcaggatcctctttgctgactcaggaatactccatattttagactactgcctctaccattaactagcccagacatttgaatggccttgtaaacagctcactgtctaatactcgaaggacaagtaacaatttatattggatgagagtggtcaagaaatatgatttcattagttttattatctgtttacttcctctggggaaggcagactgataaaattatatgggctggtaaatttttggtacattaattgcaagctgcatgacaaaatttgtttttctggcaacaatctgacattattagtggaattccacaccaacagggcttgtgagcttccatttcatcttactgtaacttcaattttatggcaaaaaaaggtacaaagtttaaatacccctttctagtaatgccaaagacatacagtgttttacattctctcctttataggtaacaaaataatgtttagctcagtaagtactgaaataatgagtgaccaatttgaaggatttttagattatttaatctttgcttatgttgctttttcacatgcttaatgatggaaatgaaatgttaaatcaacaaaataagatccagtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacacttaagacatgtgacacattcccattggtaacaattgctcaccatggcattgtctcaaaaaagactatggtggggagggtggcacattcctaatgggatgtacctctccccaatccccttgcttgagaagcactactcaaaaatttaccagaccttacaactgtgataaaacttgaatgtgtatgatgaataaggccattcagttaactttacctccctttacccattgaaggggttccttttccattgctcagtttttagaaaataattctcatcttttttctaaagaaatgaatttgtggctggtctgaaggtagtgagttagctcaattgattgttcgcagtcagttatagatcaagctccttgttctactcttcccctcttctcactactgcacttgactagtcttaaaacaaagaaagaacgaatgaatgaatgaatctgtggctgggattacaggcatgagccacactgcacccagtcgatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcataaagtcatcctgtttgccacttaatttggttatgttttatctaccacactgcaaatatgttaattcaccatgagaaacagatccctgtacacatgtgtatcagtaaatcattcaatgaatagttagtgcttaggatgtatag

SEQ ID NO: 115404 - DNA, 4527 bp, Homo sapiens
gcgagtccggggtcgccgcagcccgggaggagtgtctggtctccggcctgcctgtgctgtccccgcgccctgtccactggactcccgagacccttggaacccaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtgggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaagtccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcacggcctaaaatattcataatggttggtgtcttttgaatgaattcatgtcaaaaatgttattcagctggggaaatttctctaaatgtacactgattctgtgtgtgtgattttaaaaggagaacatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcggggtgtcatgtgttctgttatgttctgttttctggttgccagtttgatctgcaaagtatttttcagtgcaggtaaaatgtgttaaaccataagagttgactgagttaatcccaattggttgtgctcatatgccaccttttaaaccaatggaaattgctatatttggggatgtcatacatttgatattgcttcagcatttcaaatatgttgcaaaatttagtatccatatgcataagaagttaatcaccttgccagtggggtggtcacatatagtgttctcaagctttactgtgaatcagaaacatccagtaagcttgtgacaaatgcagactcctagggaaaaccagggggttctgcttcactaggttaaatgtaggttttgtagaggagatctgcactggagcaagtctcccagatgattctaatacaggagggccagaggccaaacttgaagaactgctggtgttacatgttccaaaaggcattagacctatcagctttgtttcgcctgatctcaagttttagcaactcaccaactaaggcgtaacctcattttatgttccagcgttttctactctgaatagttctaaaacactgagcattttctcatttgttgcattactgattaaagttcagtatttcatggtgttttcagggatcacagaaatgcggatgcaaaacaacttttgacagaggcccatcaaacccagatctgcacttggtaatgacttaggggggcttcctcacaatgcaggatcctctttgctgactcaggaatactccatattttagactactgcctctaccattaactagcccagacatttgaatggccttgtaaacagctcactgtctaatactcgaaggacaagtaacaatttatattggatgagagtggtcaagaaatatgatttcattagttttattatctgtttacttcctctggggaaggcagactgataaaattatatgggctggtaaatttttggtacattaattgcaagctgcatgacaaaatttgtttttctggcaacaatctgacattattagtggaattccacaccaacagggcttgtgagcttccatttcatcttactgtaacttcaattttatggcaaaaaaaggtacaaagtttaaatacccctttctagtaatgccaaagacatacagtgttttacattctctcctttataggtaacaaaataatgtttagctcagtaagtactgaaataatgagtgaccaatttgaaggatttttagattatttaatctttgcttatgttgctttttcacatgcttaatgatggaaatgaaatgttaaatcaacaaaataagatccagtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacacttaagacatgtgacacattcccattggtaacaattgctcaccatggcattgtctcaaaaaagactatggtggggagggtggcacattcctaatgggatgtacctctccccaatccccttgcttgagaagcactactcaaaaatttaccagaccttacaactgtgataaaacttgaatgtgtatgatgaataaggccattcagttaactttacctccctttacccattgaaggggttccttttccattgctcagtttttagaaaataattctcatcttttttctaaagaaatgaatttgtggctggtctgaaggtagtgagttagctcaattgattgttcgcagtcagttatagatcaagctccttgttctactcttcccctcttctcactactgcacttgactagtcttaaaacaaagaaagaacgaatgaatgaatgaatctgtggctgggattacaggcatgagccacactgcacccagtcgatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcataaagtcatcctgtttgccacttaatttggttatgttttatctaccacactgcaaatatgttaattcaccatgagaaacagatccctgtacacatgtgtatcagtaaatcattcaatgaatagttagtgcttaggatgtatag

SEQ ID NO: 115405 - DNA, 4645 bp, Homo sapiens
gcgagtccggggtcgccgcagcccgggaggagtgtctggtctccggcctgcctgtgctgtccccgcgccctgtccactggactcccgagacccttggaacccaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtgggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctgcttgttttctatgatcctggtggagggaactaaggccaatcaaatggagatagattccaggaggacagatttgagccaatgaaggagaactttccagcccttggagctgctttgggaggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaagtccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcacggcctaaaatattcataatggttggtgtcttttgaatgaattcatgtcaaaaatgttattcagctggggaaatttctctaaatgtacactgattctgtgtgtgtgattttaaaaggagaacatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcggggtgtcatgtgttctgttatgttctgttttctggttgccagtttgatctgcaaagtatttttcagtgcaggtaaaatgtgttaaaccataagagttgactgagttaatcccaattggttgtgctcatatgccaccttttaaaccaatggaaattgctatatttggggatgtcatacatttgatattgcttcagcatttcaaatatgttgcaaaatttagtatccatatgcataagaagttaatcaccttgccagtggggtggtcacatatagtgttctcaagctttactgtgaatcagaaacatccagtaagcttgtgacaaatgcagactcctagggaaaaccagggggttctgcttcactaggttaaatgtaggttttgtagaggagatctgcactggagcaagtctcccagatgattctaatacaggagggccagaggccaaacttgaagaactgctggtgttacatgttccaaaaggcattagacctatcagctttgtttcgcctgatctcaagttttagcaactcaccaactaaggcgtaacctcattttatgttccagcgttttctactctgaatagttctaaaacactgagcattttctcatttgttgcattactgattaaagttcagtatttcatggtgttttcagggatcacagaaatgcggatgcaaaacaacttttgacagaggcccatcaaacccagatctgcacttggtaatgacttaggggggcttcctcacaatgcaggatcctctttgctgactcaggaatactccatattttagactactgcctctaccattaactagcccagacatttgaatggccttgtaaacagctcactgtctaatactcgaaggacaagtaacaatttatattggatgagagtggtcaagaaatatgatttcattagttttattatctgtttacttcctctggggaaggcagactgataaaattatatgggctggtaaatttttggtacattaattgcaagctgcatgacaaaatttgtttttctggcaacaatctgacattattagtggaattccacaccaacagggcttgtgagcttccatttcatcttactgtaacttcaattttatggcaaaaaaaggtacaaagtttaaatacccctttctagtaatgccaaagacatacagtgttttacattctctcctttataggtaacaaaataatgtttagctcagtaagtactgaaataatgagtgaccaatttgaaggatttttagattatttaatctttgcttatgttgctttttcacatgcttaatgatggaaatgaaatgttaaatcaacaaaataagatccagtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacacttaagacatgtgacacattcccattggtaacaattgctcaccatggcattgtctcaaaaaagactatggtggggagggtggcacattcctaatgggatgtacctctccccaatccccttgcttgagaagcactactcaaaaatttaccagaccttacaactgtgataaaacttgaatgtgtatgatgaataaggccattcagttaactttacctccctttacccattgaaggggttccttttccattgctcagtttttagaaaataattctcatcttttttctaaagaaatgaatttgtggctggtctgaaggtagtgagttagctcaattgattgttcgcagtcagttatagatcaagctccttgttctactcttcccctcttctcactactgcacttgactagtcttaaaacaaagaaagaacgaatgaatgaatgaatctgtggctgggattacaggcatgagccacactgcacccagtcgatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcataaagtcatcctgtttgccacttaatttggttatgttttatctaccacactgcaaatatgttaattcaccatgagaaacagatccctgtacacatgtgtatcagtaaatcattcaatgaatagttagtgcttaggatgtatag

SEQ ID NO: 115406 - DNA, 2272 bp, Homo sapiens
cgagtaagctttctagcagcctatgtcttgttgagcagcagtggggcaccagcttaagggtaaagtgacaacagtgggttcactagctgctatctccgtagtgagaatgctctggcttcatgtacgtaggtagcattcgtgattctgcgacgcaatatacatacaacgcactcgagtgcgtaaatacgaggcgttgctcgagacgagacactccagtattggaagatatctgggcatggtccgatataacctggtatcatatcagagcagtgagtccatagtcgaagcttcgattatcgaacattatcgccaccgttccttgcaactcaccaactaaggcgtaacctcattttatgttccagcgttttctactctgaatagttctaaaacactgagcattttctcatttgttgcattactgattaaagttcagtatttcatggtgttttcagggatcacagaaatgcggatgcaaaacaacttttgacagaggcccatcaaacccagatctgcacttggtaatgacttaggggggcttcctcacaatgcaggatcctctttgctgactcaggaatactccatattttagactactgcctctaccattaactagcccagacatttgaatggccttgtaaacagctcactgtctaatactcgaaggacaagtaacaatttatattggatgagagtggtcaagaaatatgatttcattagttttattatctgtttacttcctctggggaaggcagactgataaaattatatgggctggtaaatttttggtacattaattgcaagctgcatgacaaaatttgtttttctggcaacaatctgacattattagtggaattccacaccaacagggcttgtgagcttccatttcatcttactgtaacttcaattttatggcaaaaaaaggtacaaagtttaaatacccctttctagtaatgccaaagacatacagtgttttacattctctcctttataggtaacaaaataatgtttagctcagtaagtactgaaataatgagtgaccaatttgaaggatttttagattatttaatctttgcttatgttgctttttcacatgcttaatgatggaaatgaaatgttaaatcaacaaaataagatccagtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacacttaagacatgtgacacattcccattggtaacaattgctcaccatggcattgtctcaaaaaagactatggtggggagggtggcacattcctaatgggatgtacctctccccaatccccttgcttgagaagcactactcaaaaatttaccagaccttacaactgtgataaaacttgaatgtgtatgatgaataaggccattcagttaactttacctccctttacccattgaaggggttccttttccattgctcagtttttagaaaataattctcatcttttttctaaagaaatgaatttgtggctggtctgaaggtagtgagttagctcaattgattgttcgcagtcagttatagatcaagctccttgttctactcttcccctcttctcactactgcacttgactagtcttaaaacaaagaaagaacgaatgaatgaatgaatctgtggctgggattacaggcatgagccacactgcacccagtcgatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattatcataaagtcatcctgtttgccacttaatttggttatgttttatctaccacactgcaaatatgttaattcaccatgagaaacagatccctgtacacatgtgtatcagtaaatcattcaatgaatagttagtgcttaggatgtatag

SEQ ID NO: 115407 - DNA, 776 bp, Homo sapiens
cacgcctggcccacaggattctttatatattctctatataagattttttcaataatgtgtcacaaatatcttcttttagcttggagtttatgtttttactctatggtaacttttaatgaccggacatctttctttttaatgtagctgaatttatcaatattttctttatagattcatgttgtgtcttgcttaagaaatactttctaccttaggtcataaggatgctttcttatattatcttttaaagactttatgtttttgcctttcatattgattgtcaatcaaccagtaactatttgtttctttttgatatatgcatggtgtgatgtaggaatcagataacagtttttgacaagggtaattaaaatgcctagtagctttggaatacctcatctttttcccagtgatctgaagtttcctatgtattatatgtcattacaaaccatttttgcatgcatttgtttctgggctttctattccattcatgggtctatttatctgtgcatatatatagactacagttcttagttatatagctttatagtaaatcttaaaatccatttgcttaacattcctctccaacttggtggctatttgggggcttttgttcttacaaataaattataaaatcaactttaatttcaaaaataataataacaatggcacatcctgttgggattcaatttgaattctctacagattaattttgggagaatatacatattcatgatagggtctactcaacaacaggggatatctgtctatttgcttaggaa

SEQ ID NO: 115408 - DNA, 253 bp, Homo sapiens
tgaatggaaaataatttctaatttgttgtaaaatttaccaatttggtattgctgctgtaaacaggattttatctagggtttagatgccttatcttcaaattccactatcaagctagtacataaaattgtttgaaaactgaatcagatgtttatgtaattcataaaaacatataatttccctctaatatttcatttttcctaattataaaaataatgcatgcttattatagaaatgtagacataaaaaactatg

SEQ ID NO: 115409 - DNA, 269 bp, Homo sapiens
gggcagtaagacagtgtgagagaaacagacatgggcatctcatcatcttagatctccttccttgattgtcctgtgcacaaaagtatccaggagtagaaggctggactctcagcattgaatggttttgaatagatggattcagccagcccatgagtcaactacagtccctgaaagggaatgacatcactcagaaatccttgctcatcatgcccatcaggcaagtgggtattagacctgctgttccagcaccaacaccttaaaggatattc

SEQ ID NO: 115410 - DNA, 224 bp, Homo sapiens
agccggcccggcatctggacttctggatgtggctctcagtttcctggtaccaacccataagtcaccactccgatcgtctttcttacatttattgtagagtaatcagaacagaatccagaaaagagatagaagagaatgggaaagaaaaacaatggtttggtaaatctgacactggaaggaaatggagatagcctagatatagataaggagaaggtccaggtatg

SEQ ID NO: 115411 - DNA, 287 bp, Homo sapiens
aaaacctagagcaaaaatcatgccggggaaaggaaaatcattaaaaaacaatgactaaaaacagaataattttcttacccaaattccagttctcatccttgttttgggttccctgttaaagcagataccagttatagccttcctgggttaggggagacagacagtctttcatcatgcccctggattttgagcaaaggagaaagcttgctccagaaatagaaaagaaaaggcaaaaagaaaccatctttcgagtttctgctcactaacagaggaagcaaccccaccct

SEQ ID NO: 115412 - DNA, 404 bp, Homo sapiens
cgttgcagagcatggcactctgatgcgtgcgcaggagagagaaacacatgttgtggaaatccagtctcaagtcacataagtcaggcaattatccaaatgattgtggaggatatgcatccttacaactatttctcaaccccagcctttcagaggttcatgcagattgtggcccctgattataggttgccatcagagacttactttttcactaaggctgtacctcagttatatgattgtgtcagagaaaaaattttcttaactttagagaatgttcaaagccaaaagatacacctgactgttgacatatggacccatgacccatccactgactattttattgtgactgtacactgggtttctttggaaactgcgtcttttctcaataatggcaggatccccgattt

SEQ ID NO: 115413 - DNA, 399 bp, Homo sapiens
gttaaacaaactctggtacatccacagcatggaattctactcaacaataaaaatgagcaaactattgatacacacaacagctaggatggatcacaagggcattatattgagtgaaaactccaatcttgaaaggtcacatctggtatgattccatttatatagtagtctctcagtgataaaattatcgagttggatccgaggttagtgattgcccagagtcaggagtaatgagggtttgggtacgtgattgtaaaaggaaagtgtgggagagatctttgtggtgatagaatattttttatcttaattatagtggtgattacacaaatctacacatttgctaatatgacacagaactacacacccacattataccaacgtcaaagtcgtgttttggtgtta

SEQ ID NO: 115414 - DNA, 801 bp, Homo sapiens
ctgaaaattcagtaaaaactgtcaagctaataaatgaatttggtaaaatcgtagattcaatattaaaattcaatttctgaaaagttacaatgagccacctgaaaaagaaattaagaaaacaatttcagttacagtagcatcgacgataacaaaatattaggaataatttgaaggagacaaaacatctgtacacctaaaattatgagattttgatgaaagaaattgaagaaggcacaaatgcaaaggtatctcatgctcatggattgaaagaattaatcttgttaaaatgtccatactatccaaagtaatctataaattcattgcaatccttatcagaattccaatggcatttttcagaataatagaaaaaaatctaaaatttatatggagccacaaaagtccaataatagccaaagcaatcctcagaaagaagaaaaatctggagacatcacatgtactaattccaaactatattacaaagctatggtaatcaaaacatgatggtactggcataaaaacaaactcatggacagatggtatagaatagtgagcctgtaagtaaacccacacatatatagtcaaaaaagctttgacaagagcaccaagaatacacgttaggaaagatgagtttcttcaataactaatcttgggaaaactggataaccacatgcaaaagagtgaaactggacccttgtcttacaacatatacaaatattaacacaaaatggattaaatacttaaatgaaagatctgaaactctaaaagtcctagaagaaaacatagggtaaactcttcttgata

SEQ ID NO: 115415 - DNA, 660 bp, Homo sapiens
acataagaacaataacatctcttttgcaggatcatgcaatgccctccggccaaaggctaccaggaacacacctttcggttgaacaaagttggctttttgagtcactgcactggaggggaatgcgcacccctggatgtctcggggaggggatgttagtaggactgatcatgggatttgggctcgcattaagtgattttgcaggctgtttctctaggctggatgctgtcaggaagcaagggtaattctgtgattgggtatgtcaatgattctcttctagacggcaggaggaactgagcaaagctacaactgcaattagttaagaaacatttgagccaggaaggggaacatttgggcagttttgtcatttggacgatgttcacgttttcgtctgcgttcaggcaggactacagaatggtctcgtctttgttttgatccttcatggttaccgagcggtcttgtctgatgtttctgggctgtagaactgttcatgtccaacagaacaccatggcctggctgtgaatgccaggccagcccaggctgtcagagggctttcccctttctcagttgttatgaggataacgtgcccacacttggcaaaccataggcaatatttcagctatgctggagcagtgatgatctggaggttgatacattatgtgg

SEQ ID NO: 115416 - DNA, 216 bp, Homo sapiens
aagacccagttaacaaatccgggggcaaggccaaaaagaagaagtggtccaaaggcaaagttcgggacaagctcaataacttagtcttgtttgacaaagctacctatgacaaactctgtaaggaagttcccaattataaacttataaccccagctgtggtctctgagagactgaagattcgaggctccctggccagggcagcccttcaggagctcc

SEQ ID NO: 115417 - DNA, 454 bp, Homo sapiens
cacaagcctgtgatcccagctactcgggaggctgaggcaggagaatcacttgaacccgggaggcggaggttgcagtgagttgagaatgcaccagtgaactccagcctgggtgacagagtgagactccatctcaaaaaaagaacggttggaattccaaaacatctcatacatgcagagtcttgagtctagtcacccgcttccaagccttaggtgcagtcacagtcttcccaccccctgctctgcacactcatcacacaaacacttccaatctactccatatgcaagcaggcacacctgcaagcatgaacacatacaggtgcacacacacccaggcacacacacctgggtctttcttttagacccagaaagcactgcaacaacgttgcatctttgttcctctgcgttttctggctggcatgcccttcccacacactcaccttcaagaccccactga

SEQ ID NO: 115418 - DNA, 410 bp, Homo sapiens
aattagcaggaaatacattgaactgagagccatgctgacattactcttgggcactgtggtggctcatgcctgtaatcccaaaactttagttttgtgcactgtgagtatgcacaaaagtaaagttatttcagacccgtggtaaactctacaggttcaacggcctatctctcagtagataaaatgtaaggaaaagaaaggcctggagggggacctgcagattgaaaaagacaacatacatatcaagttcttaagaacaggcaaaattttatgttgcctagagattatgataaaaagatggcagttactcttggagtggaggagagaggggttactaaggaagctggcaaagttctattttctgacctggatgtttattgtagaaggatttatcttataattcaccatcctat

SEQ ID NO: 115419 - DNA, 180 bp, Homo sapiens
ttcttttaaaattagggctggggaagatacaaagtcagagaagcagctgtgtagcatggtggctaaggtacaagctttgcagtcagccagacctggattcaagtctgggctctgtcatttactaactgtgtgactttttgtaaattatgaagctagctcatctgtaaaatgtggataatg

SEQ ID NO: 115420 - DNA, 631 bp, Homo sapiens
gagatcgcgccaccgcactccagccctgggcactgcactccagcctgggcgacagggcgagaccccctcctaaaaaacaaacaaacaaaatgtgaggggaactttattagatttaaagagatagaacagtcatatacaatgcatgaacctttattataatccagttggggtgggggaactataaaaggtatttgagttactgttaattttctaattgctgttggtgttataaaggagaatggctttattcttaggagatatatactgaaggatacagaaatgaactttgatgtgtaccggttactaagtggttcagttcaaaatacacacacacacaaatgtggcaaaatgttaacacttgttgaattgtttttaaattttatacttttaattttttttgtatttgaaatttttcataatacatagatgatataaaaatgagattggggatgagaaggaactaatatatgagtctatctaggaagaaagaatcattgagataggaggaaatccaatggaatgtggtatcttgggaatccagaggagaaaaaaatgttttgaggaggaaggagtgattatctgtgtcattattttttgatagattgagtaagaagctatatggactcctctg

SEQ ID NO: 115421 - DNA, 451 bp, Homo sapiens
ggaaactgacttactttctggctttgatattttaaatagtgcccttttaaaaaatattattgatagtttaccaagaatgaatgattttcctttgaatatgataataaaggtttcccgatttctaagtgtaattttaaagaattatgcctgtgactaagacatggtttctgtgaacacaagtttctaaatatgcacatagctgcagaatatttccagaagctgaccttttgagctcatgtacttacaaggactcacactatttccagtctcttcccagagggagggacctttgcttttcctcctaccaacatgcctaggatagtaggagtcaccattgaagagctattgagagctattttctccttgttccttttacttgtgcgttaggaggaagaatgagagccaccaaaaattcatttctgtatatccctaatgtgtattctgagccact

SEQ ID NO: 115422 - DNA, 246 bp, Homo sapiens
tagcgggggcgacaagagtgagactccatctcaaaaaaaacaaaaagtggccttgccaaaaaaactaaatccatcaatcaaacctgagtttggtcaaatgtctatgtccaagtactaatttgtaagaaatacagaacacagaataatatgtcaaagtacaccctggagatgtaatcagcaaaatctaaactgagcaattccctaagataagtgtcaataaataaattgcaaggaaaagtaggggag

SEQ ID NO: 115423 - DNA, 678 bp, Homo sapiens
cagcaggttttggggaggtccttggctaagtaatttgcatcatctccttttggggtcaagactgttaagagctcacttgacagataaagtcactgaggcaacagaggtgaattagattgcacagagtgaccaagctggtcagtggcagggccaggattctgacccaaggcctgagggcagttgcaggtgggctggagtgaagagggcttctctgtattcacagggagcatctcccttcagcctcccgcgtcttcccactgtttgatctcttgatcacactgtgtgcaggtcttcggtttaatccccagggctcatgagcactttgacactgaagaccccaaggcaaagggcctgtccctgtgtgggtgtgtgtccctgcatgcatgtgtacagactgtggtcttccaggagagcttcctgggtgactctgaaggggcagcccccaggaccctcaggttcccctcttgctctactcgggagggtcccccagaagagggggaccaggctggctggtcctgggtctttgttccttctccaggcgggggatgctcaggcatgctggcctgtttcccgggaggctcaggaatggccctgggagatatcaagctgctcgttgccagagctggggtctgattcttaacctggaaattgggcatttccaggacctgtctgcgttgc

SEQ ID NO: 115424 - DNA, 749 bp, Homo sapiens
cggctatgtgcgtttaaagatccgtatcagcaagacctgggataggtgagagtagaatctctcatgaaaatgggacaatattatgctcgaaaggtagcacctgctatggccttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcaagacggggtttcacgtgcttagccaggatggtctcgatccctgacctcatgatccgcccgcctcggctcccaaagtgctgggattacaggcgtaacgcgcgcctgctggaaaggtcacttattattcctatagttttgtattgtttgaatctttaatttaaaatgagaatatattcatgtattatttgtgtaccaataacctgcttgtttatttggaaaaagagaaaaatgacataagtagcaaggaaaaaaataatctccaatagtctctacacccatatacaaccattgttaatatttagaatgtttctttccagtcttttctcttttatttttgcgtagctgtatttgtaatatacatccattttagatcctgcctttttgtttaacataaatattttccaggttactatatatgtttcatag

SEQ ID NO: 115425 - DNA, 212 bp, Homo sapiens
tttaattggtttccctccccaccgacaccattcccatggaaaaacagtttgactccatttgcatattcatttcactattactgacaaataaatgttggtttgatccccatttcaactgtttataatgttttcctagctccctcactgaatgaggtaaataaaatctttagtgcatgttcatttgtacatctgcaggaggtatagcctgcccg

SEQ ID NO: 115426 - DNA, 378 bp, Homo sapiens
cttttatagcatagttaattacatgtttgcagagtactaaaaattgcttgaggtgagaaaagactggtgaggacatttgagccaaactgtagtttgcctggtcataagatattgatgttactattcagtctttcaatctttcaacctcattatgtttcaaaaaactgacctctcagacatgaagctgcatgcactgttattttctacatctgtgtctgttttcagaacatatgaggcccaatgaacatggtgtctgtacagagataagatcgacgtgtctccccactccagagggcacagggagctgatcttaaccctgaatgagcctttcaatataagtagagtctgtgaaacccatgaacttccaataaatataca

SEQ ID NO: 115427 - DNA, 103 bp, Homo sapiens
tgtcaggtaccatgcttggcagcagggattcaaagatgaataagaaacagttctgctgggcacggtggctcacgcctgtaatcccagcactttgggaggccga

SEQ ID NO: 115428 - DNA, 511 bp, Homo sapiens
ggaaaaggcaaacaataatggtggaaaacagctcagcggttgccaggggttgtcaggaggtgtagaggctgattgcaaaggagatcacgggggaatttttagtgtgatggaactgttttgcatggtgttggggtggtgggtatatgactgtgcattgttcactctcacagaactgtataccacaaagaataaactgtaatgtatgaaattttaaaatatcaacccgaatgtgggcaatataaggatggaaagcagattgtgacaaatgaatctagctatattagaaatatatgacataactttactgaaggacatagggtaaaacaatgacctaagtaatgttaaaaatggtgctttgagtagaaactaaggctaaagatgaaaagatgtgacatgaatactgtactctagttgtaaatttgtttcacacggggatatgcgttactaattcagaattacattatactatggatgaatgcatgaatgagggaataaataaataaatgtttta

SEQ ID NO: 115429 - DNA, 295 bp, Homo sapiens
aacctctgctttaaataaaggagagcaccatcccccaactcacagacatacatacaattgataattggttgtctttaccccttctcctcccaaattaagatacataaaaaaaaatccataggactttaggggcaattagctgtctaccttgaattaacatcatttagcccttttgggttattttaaagccaaacattaaaccggatatttatattactttatatgaataaggtaggcaacttaaaagcacaaatagttgttcctataactatctcttacgtatgccaaattatgt

SEQ ID NO: 115430 - DNA, 361 bp, Homo sapiens
aacttaaaaagttgaaaattacaaagtaactgaaggaattaataaatataaaaggaaaaaaattttttttaatcttaatagctaaattgaaattttttttaaatcaacaaaacagtaagctacttatagcagtttttaaaaaaagctaatcaaggcccagcacagtagctcacgcctgtaatcccagcactctgggagaccaacgcgggtggatcacttgaggtcaggagttcaagagcagcctggccaacatggagaaaccccgtctctactaaaaatacaaaaattagccaggcatggtggtgcatgcctgtaatcccagctactcaggaggctgaggcaggagaatcgcttgaacctg

SEQ ID NO: 115431 - DNA, 1668 bp, Homo sapiens
acctctctcctgacctgcaggttcatatgtctcactctctttttgacatctttacccagatgtcccataggtaactcaaattgatcccttttcttggtcatgattttccctaagaaatatgccctttgtttgctgattctccctaacctggttagtatcatcaccatctacctaccaggtttcctaaggctgaaacattatcatcctccattcctccttttccctcacccttatacccaggcattcacccagtcctagtgattcactctcatgaagatctcagcccagtttcacctctctattcctactgccttagttaatcttccttcagacctagactattactaggtcctctccttgccacaaaacacacccctacctaatctatcctttaccaccagaattatcacgctaaaaattacattcttgcttaatatctgtattcccagttgcctacgggataaaagcccaaactccttagcagagaatataaggccctagctcccacattatttcagcagtcatcacccactatgttcctcaagactgcagccattaactttttagagttccctaaacatgctgtttactttcatgcctctatcccgttgtctgtggaatgacttccctccttgcccttttcagtgctacaaacccctattctttaagacatagtacaaatggcatctcctggttggcatctttcctgcaggcctacaggcctagtaagtatcttcctcctctgtgctcctgcatacctccattcctttgttatgacatctataactttaataagtactaaaatctgtagtcctacaaaactcaggcatagaactcatttcctttatggctctataatggaactttacccaactctcacgttccccatgaccacagatgtggagaaatttgaatcttgacagttcaaggtgaactcagtcattttcagagttttcatagtcccttcaagattgaaactcagttcctgcaatgtttgccccttttctcctcttttgtctatgctgggagaggcattgtggggagggttgtctggcttatggctcccattgtcctctgcttgataaaccacctgagctttggtcattagcagtctcctgtgcctttcacactcaggtagtgtctgcacaggccactctatgtcttttccatgctgaagaaattcctttccaggccatgtctgtgttcctcctgccacacaggaaatttttgagcatgttcatcctccaagctgaatgcagggtcttgggtagtggtcctcacctgctccagagacttctccagccattgccactctccactcaggtgatgaagctggatgagggactgcacccaccagagtcaggccagggtcctgtctgctctgtgagtccctccaattgttcttattccgagatttccattgttctgccccctcttgactcccagggctctcaagggagtgggggtagtgaagggagccctttcccaagctcccccaagagctctagtcacatcacttctgatacttcttttcccaccagctggaagaaagaactttcatttgtcttgaaatgagaaaaatgttcttagaatattttgtattactctctgctctgtcatttatggtaaacaaaataaaataataaaaaaaaacaacccatgctctga

SEQ ID NO: 115432 - DNA, 174 bp, Homo sapiens
tgcctcgaatttgagttagtaactagttactaaattgttagtaactggttcactaactgttcctagaccatgtagtaacacataaatatttattgatttgattcggttaagaagcaggattaaatatctgctaagtctttctttttttttttttgagacggagtcttgctctgt

SEQ ID NO: 115433 - DNA, 428 bp, Homo sapiens
atggaatttgggactgcttttcccttgagcttcccagcacacaactactaagaaaagagaaagccagaaagggaaattgaaatgcagtctcagattgctttccatcctctaccattctcagctcccagaaacagaagggatgggcttagttctcctttaactttatactaagcccttgtatatacagcagcaagcctcatgacctagagagttcataggtggatggcatcctctctttataatgagaattctgattgagtcctctagcttagttttgaaatgttaagtaggtactgaaagaatgcacccaggcgcacctctggatgcggaaggcatagacaatggggttcatggccgagttgccgtgcgtgaggaagatggcaatgtaggtaaggatgctgggcttgtggcaggacgggcagaagagg

SEQ ID NO: 115434 - DNA, 352 bp, Homo sapiens
ggtagaaagtagggctaaggtatcatcagctactagtaattctagcgaaagattataattcctagcctaagttaataaaattagctctcaggccgggtgcggtggctcgcgcctataatcccagcactttgggaggccaaggcaggtggatcacctgaggtcagaagttccagaccagcctggccaacatggtgaaaccccatctctactaaaaatacaaaaaattagctgggcacggtggtgggcgcctgtagtcctagctactcaggaggctcaggcaggagaatcacttgaacccaggaggtggaggttgcagtgagtggagattgcgctattgcactccaggctgggc

SEQ ID NO: 115435 - DNA, 2097 bp, Homo sapiens
  misc_feature (1289)..(1289): n is a, c, g, or t
ctgttggttgattgaaaattctctttcattgtcaactgaacgctggactgccagacagtcccaaatggcctccctgaaatgcctgactgttggtgccacttgccatctgggagatcagctggagcttttgagcaggacttcatttgtccttcctcttggcttctcctcatcactacttggccttcctcacagactgatggctaccatccaacaaaggacgttccaatgggtgctgaaaagctgtgtaactcttaagacccagacctcaaagttacacagtgttacatttttccaataaaacaattaaataaaaaaattaattttatggatacataatagttgtgccttttatgcgatacatgtgataaattctatttagatattttacccatttttaatcagatctatttgctattgagttgtttgagttccttatatattttgattatgaatcttttgtcaggtgaagagtttgcaaatattttctcccattttatagattgtttcctcactttgttaattgtcactcttacaagattcaatttgttgagtttgtgagatgagattatagtcaaataggtaaatctacctcctgttaactactcaataatataatttatttattcaaaaaatgttaattgctgtgttgaagatatagatgtttccagagaagcagacattttctatgaaagggatttaatacaagaaaatactatacattaaagattagttttttatctattcaaacattcactaattagtttttgccttgtttcacaagaggttaatgtatttattgtggtttatgataaagcactctaaaacaataccataaaatgaagcaagccatcattctagaaagaaggaagagttatgtagagaaatgaaaacactgtattagtgtctcaagcctcaaactgtaccaatgctgtgagaaattcaggaacaaaaagtaatttagtatgaagttatcaacatgatatttctcagaattgtgtggtatgtagcacatgtattttaaagaatgttatgatattctgtgatcatgccaagtacatgagtgggtcattttcttttctcatgagtactttaccttcaatgttgctgaaaacaagctatattctgaaacctaacctactgatcaaactatacatttgcacattagaaaagggcttgcttcgattacatttttaaaaatgtaagcacagttttgtatgcctttgcctagatatttttccattgtcttgagatttgctgaaataagggaatatggcagtaggaagaaaagnacttttgatttgagttctaattttttatcatctttaatatatacagctactgtatatatttaatagtttcctctgtaaataggtagttaaatctgtctctttaccgacttaccattttgtagtccataaataatctcagcattttatacaactgaaaacctatttggtatgagaatgaaataagtaatgttaaagcagaattacatagtttacaataactaatttgttatcatgcttacccaattaccaaaaccttgttgcatgcttgtcgtgtgcgttgtcaaaaattaaaataaagtcttatttctcttaaaatatgaattttgtgaatgtgcctatgactgatggccacacatccttcgtaggacagctgctcatcaattagaccctttcctatcttagggcctttacactttctgaaacttctactgaaaagcctttctgcagacactttcagaactcagcttcttcattccttactcagttcttttctgaaatgttttcttctttgtgaccgttcctttagtccttcaatgtttcttatcctcttccttcgttttttttcctgcacaatatttatcaccatcagacagatcttgtattaatttatcagtctgctgcctgtctccctgtcccataggatgtaatctctgttaccacaggaaataatttttgtttaatattgttcacagccagccttggtggcttatgcctataatcccagcaatttgggaagctgaggtgggaggattgcttgatcccaggagtttgagaccagcctgggcaacatggtgagaccaccatctct

SEQ ID NO: 115436 - DNA, 403 bp, Homo sapiens
aactaagctctgaatgttagggtgtctagcaacttgcaaatatgtttctaagcctaaatgaccaagcctacagaaacacaaacaaaagtaatttaaataagaacatgtccataagaatggaaatgaataaaaccataaaatcagaaggagagaagtatagaagcacctgaagaagggtttggcagttccctggaaatgccacataccctttatgcttttctatgcattactctgcctgtaacatgttttctccagcttctccatccaccacgctaattcaattcttgaagaatttcaagagcctaccactaactctcccagggcagtttattaatcctcttctgtctcacagtatctgtgtgtacaatcccagttgtggcaagaggggcaggggtatcccgcc

SEQ ID NO: 115437 - DNA, 207 bp, Homo sapiens
ccatgcttggggctgtccctttctaggcagtgatctgttcactctccttttaacctccagttgtttggtgtctgattgtccccactgatactctgttgttactggctaacaaatttttgagccttttatcctggtattattttaaaactgttcagttattctcccatgaaaagtgtttctatgataaaacattttatgccaaccgta

SEQ ID NO: 115438 - DNA, 369 bp, Homo sapiens
tgtgggtgcctgtaatcccagctactcaggaagctgaggcaggagaatcgcttgaacctgggaggcagaggttgcagtgatcagagatcatgccattgcactccagcctaggcgacaagaatgagactccattgcaacaaacaaatgaataaacaaactgtggctaatctggcactcaaacaatgcaaagtccttcctgctcttccttcccctttctccagcaccaccactgttccacaggggattccacccgtcctctgctgatgttcacttaaagcccaggggttcttccatcagcttgtggtgaatgctgccaggcctgggactcactcttcagggcagtgggctcccctctggcccagggaaggt

SEQ ID NO: 115439 - DNA, 631 bp, Homo sapiens
agaattatgacatcatctactatttctttctcttgtctcataaatctaaaccatcaacctgcttatttttgtatactgtcacactgtgtattccctgcattgaatgcctttctattgacattgtctgtaaaaattgtgggaagttttctgcaccctaaattttctgttatggggattagatatccagtatccatgtttttccaagtcttacatcagaaagggtaaatacagccctcacagcagcctgttgtttgtcctgcagttgtgtttccatcacattacacaaagcctctttgtcttcgtggttgtaccctgctaataagttttttttaaattatgtaatatgtgtatatacaaatacctatatgtatgtgtgtacacatacagctgatatctactgagattatgtatgcatgaactatagaattaacttgtaattttaagaaaataaattattttgtaaagataaatctcatgtttaagaaggggaattacaattgaatcatttagggatgcctcagcctaagcataatatggaaaaagccataaccaaaagtcattttagagtactgctaggttactcaacctatcatcacatttaattaaaatgtcagtttgaaccatggccagt

SEQ ID NO: 115440 - DNA, 364 bp, Homo sapiens
gcaattctcatgcctcagtctcctgagtaactgggattacaggttcatgccaccacacccagctgatttttgtatttttagtagagacggtttcgtcatgtcagccaggctggtctcgaactcctggcctcaggtgatctgtccgcctcagcctcccagagtggtgggatttcagacatgagccaccgcgcctggccaacgcccggctaattattttatttttagtagattcagagtctccctttgttgtccaggctggtcttgagctccttagctcaagcgttccctcattctctgtccccagaacactgggattacaggcatgaaccattgcatcctgcccgaattttattgttaattgtag

SEQ ID NO: 115441 - DNA, 327 bp, Homo sapiens
gtcagagaaaagagcagggaggaattagttctatcagggcaatcaggaaagggcataacataaaagtgcataatggagctagagtttgaaggaagaatgaattggagttttctagaaaaagtcatacaaggtagtgaggcagcatgtgctaaagggttaaggtacaaaagtgcacaatgaattcccataaaatagggatactatttattcatttgcaaatgtcaaccctgcatatttaatttccccttataaatcctgtctgtatttagcctcttgcctctaaggcagagctgtgaagattactgaccagggactgaagataatggg

SEQ ID NO: 115442 - DNA, 894 bp, Homo sapiens
cagcaagtagatgtgaccctactcttagttatctcaggatggagtgctgcccaagaagtgatctatttcaaaatcctgattggaggaggaagcaaagcttttttgtccttgttattactcttgtcactagctttttattgcccccatctttctccctctctgagccaaaactttcctctttcttttttgctcttctgctcctactgactcagttccagaaatttgcaggcttccctgtttcatattctatttgccctgatgcaaacctccaagtctaactcaagctcaagccttaatgataaattgtggggactagaggcaaaggattggggaaattcaaggagctgtgtcttccaggtaagatggttaatgtgctaaagtgggagaatgaaaagaatttggaatatattctcttgaggctgcagaaaattctattttacttgtctaaagtggattattaccttatcttctctttttgcattctttcaggaaaaagtcttaatctcttcttcctccctgcaaagatgtttcaagtggtctagggtaaggtcatatactcagaaagacaaaagagaaaataaactagtagttttcaaaatatcaccccattacaatggatcctttctcttgctaataagctttgtcaaagtttttcattggctttcttgttctttaaataaccagctcttggatttatttctcaatttatatatattttcatgttctatttcctttgtggtacttttatcttttaaaatattctattttttcaacttaatatcttgaaatgaatacttgatttatttatgttatttttcctcttttttgtaacaaaaatatttaatactatgaattttccattgaatgcagctttggactcatttcttcagtttc

SEQ ID NO: 115443 - DNA, 438 bp, Homo sapiens
gatattttattgcccttgaagcatgtgatctctgtgacccataccctatttgtatactcctccccttttgaaatccataacaaaaacttgctggttttgcggctcagggggcatcacggaacctgccaacatgtgatgtctcccccggacatccagctttaaaatttatctcttttgtactctttccctttatttcttagactggctgacacttagggaaaatagaaaagaacctacattgaaatattgggggctggttcccccaataaaaacataaatcataatgtctgtttttaactaaatattttgtttctgataacttgtataaagctacttgtcttcagaaagtcaatgggatgcgttatgtcaatttttccatttacatagctatccttgatttgatatatatacacaaatgcatgcacatgcacgcacatg

SEQ ID NO: 115444 - DNA, 495 bp, Homo sapiens
ccaaatacttgcctcattggagtatggttctgactttcagagacaggtagaaaaattctaaataccaggatgtctcacaaagtatagtttgtttttattttaggttcattttatttagaggcaagtggacctatgcagtttaaaaataatctttcaaattaatgaaatttatgtgtgaaaacttttagatctacacactcataataggctagatgagtctctcttccaaatacagtgtgtcacttgggagttaattcattaaacctaatctattcatgtactggctagtttagtaatcctttgctccctgctgttattggggcccatgttgaatagtgaagtgtgagtttcacaaatgtgcaataattctatacctttcctgcagcatatcctgagcctataaggtataatagggtattactctagttaataaatggttgtcttttatttttctattttttttttttttaatttttttgagatggagtctcgctc

SEQ ID NO: 115445 - DNA, 198 bp, Homo sapiens
ggactgctgacgaaagttaaactccatttgggagcattcatatttagggcctttcggtcttgcattcatgcctattttaaggcttattaaatttttgagaataagacataatggtgatgttggggaaaaagtgttttattttcttttcctctttttttttttgagatggagtctcactttgttgcccaggctggagtg

SEQ ID NO: 115446 - DNA, 722 bp, Homo sapiens
gttatgtgaattcttacatatggaacataatttatatttctaattttgaaaattattgaatttcttctgttgctgtcttagccatcaggtaccattctatgcattgtaattatattggtcatattaagttcatgtccactgttgtcaaaagtggaaataccatggctggggtgtgtttatgtattgcctctagagctgtagccactgacgaacaggaaactgaaagctaaaagttcaggaaatgtattgtatttagactgtggaaaacatatatatgatactttactgaaaaccatgctcttttgaaaactgaaatatgtatgtatttaattagagatgaatattaaggattcatatcagatgcttaaatatgataatagatacagtatgtgcattgtaggccaggaatattgtgcaatgctagaaaaaaaggcaacagattattgtatgtattcagctatattctttcaagaaacaaaacagctggcacatcaattgaattcctcaaggatgtcttatttccagagaattccagagttttagttttagcttagttccaaggaagaggaggtccctgttttacaggatagcctatttcagtcttagggagttctaatggttaacttctgttttcatacactgaatttaactttgttttcctgtgatttattaatacagtctatagctttcttagagttgagaagaaaatgattaattgatca

SEQ ID NO: 115447 - DNA, 355 bp, Homo sapiens
cccattctaatatacagtttttcattatatataagaaatctgtgtaacccattagaagttatatagaagaatattcaatgcccatgaaaaatgttaatgacagcatattcataaagtaaaaaaattataaactatacagagtataatgtcattttttaaaaaaaaaaacttatcacacattctaatgaaggcctataatgagttagacattatggaaaataaacaggctttgaatccatggactgggttcaaataccagctctgccacttaacagatgtaatcagctttcctaaggtaaagtttgtctcccttctaggggacaataacgttctctttgcagggcaatataagagt

SEQ ID NO: 115448 - DNA, 272 bp, Homo sapiens
agtagagatggggtttcaccatgttggtcaggctggtcttgaacacctgacctcgtgatctgcccaccttggcttcccaaagtggtgggattacagacgtgagccactgcgcctggccgaaaaataattttttttaaagataaaaattttcataagaaataaagaaaaaggagacgttttccagcagattttttaaaaagttggttgtgtcaagtattttgcattactataaaaactataataaatagttgctgagaattgaatacttggtc

SEQ ID NO: 115449 - DNA, 283 bp, Homo sapiens
tgctgggattacaggcgtgagccaccacgcccagccagaaataaatttctaaccaatgcatgtatttggttctaagccccagtaggatatgatcatgttaagagtgataaaggtaatttagcagagaggaagttatagttgaatcatttattttacttccataagtattcaggataataggggctttacagattatagttcagtttttttcttttagatggataagtcccggaattgggatttaagtctcaggcccactgaccccagatcttttgttctatgt

SEQ ID NO: 115450 - DNA, 221 bp, Homo sapiens
gttatacctgcctaattttagaaagataaattatgaatgtcgaaatgaaaggtaagcagaagaatcagccaacattggcaacattatagaaattaatttaaatttgcattaagccaggaacatattgtttgtaaattatgaggcttctatgtacttttgtacagctttaatgaaaaagaatcatacttacttgattaagcattggctttgctaattgtgga

SEQ ID NO: 115451 - DNA, 319 bp, Homo sapiens
aagctttgtccaaaccaccatctcctctcacctcagatgtatcctgcttccacccttgaacccaacagtctcttctccactaacaagcaatgtgatgtttaaaatcctaagtcaggtcacagcacatgtctggccagaaccctttaacatcttcccatctccttccaagcagagctgccagagactctgcagaacgcagcctctcttatgtctctaacttcatcccttctcctcctcttcactcccaagcactgctacagaataatccctcctcaccccttcccctacacttgttcatttaaaacaggcaccaaatttc

SEQ ID NO: 115452 - DNA, 260 bp, Homo sapiens
tgtacccgtataaaattaggattgacttatagaggggaaatttatttggtttattaagatcctttcagatggattttatacctgcttctctatactagccaagtctgtctgagtgaagtggtaatgttatctttaatttacattttaaaacttttacatagttaaattttaataaaaaatctgttcttgccttgggaactaccatagatacgttttcttcagggtacattgagcgaattccccaaattgtattcgtattg

SEQ ID NO: 115453 - DNA, 348 bp, Homo sapiens
ccctgttttagaagattcaatagcattctttctaaacttacaaaccagacacatttgttgctgtgggtgtgtgcatgggtatatgtgtgtgtgtgttctctggagttatgcaaggaagactgttttctttacatatgtgatgatttgcctcattgacaaatttgctctctggttgataaccttcacatccttgtactttttgtatgctcacatttctgggtattatatagagaagcctagaaacactttacatgatgtggtgggatggcatggggttgagatgtgcttctcccctttctgtcctctctggcactctaataattgtgcttttgtttctccaaccacagc

SEQ ID NO: 115454 - DNA, 473 bp, Homo sapiens
acattctactgcccatgagtggtggtaccagagctgtgctgcagtgggctccttggttatctctctttagatgaggacactccagaagcatgaagttaagtgactgcccagttatcaaagcagagagctagaaagtgcagggtcctgcctgctaccccaacccctcccgcagtgtacacatactcagcttaaagccacacctggacctgggctttattagaaagtttcctcctgctttcctcccgtttggtgactgggagccagtccctctgcctgccatgtaccagctgtacaaggaggtgagaagatgtcctctgagaaaagcaaatgccacttctgcaaatgctacatgaggctcctgctgagaccctcactcttcaagttttagagccttctgaggggcttgcattccttctttctcctgctttctgcagagaagtacacaaacacagaaagaaagggccctggctttg

SEQ ID NO: 115455 - DNA, 678 bp, Homo sapiens
gaaagtaataatatgcctccctacggtagaatataataggacttacgggaataatatgagaaaaaacaatcaaccagtcattgttttagattttccacgtgatcagtaaattatctgaagtaaaaataaaagagctagagaaaatgtattaatgtatgaaagagtaaagctataaaactgaaataatatcatatcatctaaacccagcacattttcaactgttagttaaaatatgactccacgtggtcagaaccttccaaagtaatcatagtagcactgataaggaaaatacaaaaaaatgaatacatcagcctatttgtccaatatcagtcatatttcattacttaaaaaatatagaagcctggcgataaccacagatgcagtgaaatgaactcagctcctctagggatggtgcccaaaagtctgcatgtgttgatgtaactagtcctcaattagtatttgaaactactgctttaggctatttggatgattaaatgtacacaaaacaggccgggcgcggtggctcatgcctgtaatcccagctactcggggggctgaggtgggaggatcgctttagcccaggagttctggctgtagtgcgctatgccatcgggtgtccgactaattcggcatcatttgtgacccccggacacgggacaccagttgctaagagggaca

SEQ ID NO: 115456 - DNA, 270 bp, Homo sapiens
tcacctgtgtccattctgtctcataaaggacactgtaggctctgaacagctaaggcctttcttattcttttgtcccatggaaaataatccctccagatagcaataccaggaatagtgccttttctaacccactggtttccttttgagcttacagccaccaaatcttatatctgtttgtttctgttcccctctctgcattgactgctagagagatcagagtcaagcaggaggttacatctagctggggcactgtgctttatgctggtgttt

SEQ ID NO: 115457 - DNA, 375 bp, Homo sapiens
tccttttctagcctgaaatttcaagatgttgactgctttcatttactctcacaatcttggtatttctagaaaatacattacagagatagattatatgaacatgagtgataacctcgatttataattctttaatgaatttgaatcatattctaagttaattttaataatcattccagttgtcaaaaaagccaatgaaatttatataatatttatgatggtaataaatatttgtttcctagtaaatgacatatccacaaaggctgggtgtaacaggttttaggatttcagatgtacagaaaggaaaatgaccaaattaataataaagattaaagtcattggtccaaaaagacaatcagaaccattctacctttatta

SEQ ID NO: 115458 - DNA, 218 bp, Homo sapiens
attccagctcagggtcactggtggccagagcccatcctggcagcttggagcaaagtaggaaccagcctttgacatcattccattacaggacacactcgcacatacacccctgcactcatcagattgagaccatttagacaggccaacgaacctagtatgcccatctttgggatgtggaaggaaaccatattaataataacagaagaaagcccatgtag

SEQ ID NO: 115459 - DNA, 863 bp, Homo sapiens
aatatgggttaaattacctacctaaaagatagagacaggcttaatggatcaaaaatgacccaacaacgtctacaagaaactcacttcacttgtaaagacacacacagactgaaagtgaagggattgaaaaagatatgccacacaaacagaaatcaaaagtaaccaggagtagctaaacttacatcagataaaacagactttaagtcaaaaactgtaaaaaggacaaagaaggtcattatatggtaataaagggatcaattcagcaacaaagtgtaacaattctaaatatgcatgcaaccaacacaagcacatccagacacacatagcaaatattattaaatctacagggaaagatagagtccaatacaatgatagttgagaacttcaatatcctactctcagcactggacagttcatctagacataaaatcaacaaagaaacattagatttaagctgcactttagaccaaatggagctaacagatattttcagaatatttcatccagcagcagcagaatatacaatcatctcatcaacacatggaacattctccaggatagaccatatgttaggacacaaaacaaggatcaacaaaattttaaaaattaaaatcatatcaagtatcttctcagaccacaatggaataaaacttgaaatcaataagaagaagaaatttggaaactgtacaaatacatggacattaaacatgctattgaatgaccattggatcaatgaagaaattaagatggacattaaaaatttttttaaacagaaaacggaaacacatcatgcaaaacctatgggatacagcaaaagcagtactaggaggaaagtttatagcaataaatgcctacaccaaaaa

SEQ ID NO: 115460 - DNA, 686 bp, Homo sapiens
agaaataagaaaatgggagatgcttaacagctaccagttttggaaaatgagaatgcagacagacatttagtaaacttagcaaacctgaggaagctaaatcctaggctggcagtgggaattggagaagcaacctgattagtagctcagaatctccgtaaggcttggtaattgccaactgcaggaacctctggaagtggaggtgaagctaaacacagaagtggttgaaagtctgtttcagaagcagttagagctccttagctccctcagtgctagcccaagactggaggtttgttatttggcgaggatgaaacagagggcctctggactagggaaaacgcagaccttgctgagggtgagctgctgtcatgaaagcagaggagttgagtagtttaaattttggacagtccagcctttttcctcaactcacctcccagatcactagcagccaggtgcttgtcttcctgacaggagattggaagagcgttctgtgggggatgtgatcagcataagaaaataaacccaaaggtactgacttcagggaaccccagtccaactgcttggccacatgcctccacgagcaggatcacagtcaggaagcctcacccaggcatgcagcttttttgtgtcccacttttaaacaaaagcagaaaacgaagttttgctgttcatttgaagaagggagctaa

SEQ ID NO: 115461 - DNA, 342 bp, Homo sapiens
ctcttcagctggtctaaacatgtagctttacctgccacctgtttgttcatgacccccacatctacatggacacttagccttcttttctgagcctctgcctctatggtactgtcatacctactgtatcccacaaataaacttaaatgtgtccaaaattgaggcatcatctctttccctcccctttgccctccccctcccaaataaaacctgcttctcctaccctcaccttcatcctggtctcagttggtgacaccaccatccagaaatttacaggtcatctgggactcctcccaactcataaccctgcatccaattagccatctagtttggttggagagccat

SEQ ID NO: 115462 - DNA, 331 bp, Homo sapiens
aacaaatgctctgtgcatttttattacaaacaccatggtgggcaggtgcagtgcctcaatgcctctaatcccaacactttgggaggccaaagcgtgtagatcacctgaggtcaggagttcgagaccaccctagccaatatagtaaaacaacatttctactaaaaataaaaaaattagccgggagtggtggtggatgcctgtaatcccagctactcaggaggctgaggcaggagaattgattgaacccgggaggcggaggttgcagtgagccgagattgcaccactgcactccagactgggccacaaaagcgaaactccatctcagaaaaaa

SEQ ID NO: 115463 - DNA, 327 bp, Homo sapiens
aatgttagaagttacttcccaagaggaactcttaactcatatttggctattcgggttttccccagaggcattattggctgttgcgggggtgttcagttctggaaataccctaaaatatagtactccaggaatactagtactggtagatagtactccaagaattctctgagaaggtgttttttcttttttcaaacccatccatatgggatgtttttaaggacagaagaactccatatatttgataaattaagatactgtcctcaggactttctatgaatgggcaaactctgagatggctttctaatggtgaagatggatttattcttt

SEQ ID NO: 115464 - DNA, 286 bp, Homo sapiens
tacattactttttatcattctgttgttaaatattatttttgaaagccttaaaatattttaaaattactttcttttcatcaaaactttattttactttcttcttatccttatgattggcattaacagtactgcaaattctagaaaagaaaatctccaaacctgtatgtcttgttagcaaaattaagaataattttgagccaggtgtgttggctcacacctgtaatcccagcactttgggaggctgaggtgggaggattgcttgagcccaggacttcaccagcctggg

SEQ ID NO: 115465 - DNA, 832 bp, Homo sapiens
cacctactagctatgtgatttagggaaacttacttaggttgcctcagttccctcagtcatgaaagggtgtttgctacgggtaggacctacctcaaggttgcctcacaaacaatatttgtaaaacgttaataacagcacccagcacatggtgaacatggatgttaaagtagacccaaagttccctgaaggaaacagaactggcaggagaaacacatgccactgagagaaaatttcaagaagaggaatcatgctgtggcccaaactgagcagcaggtagaggtagaggctgtgtccagccattttcctgacctaggctactatcccttgttcctctggtttgagcattatcagaaaaaaccagttctgaaataaaggaaagagctcttaggaggttcatagcagttctgctatgaagaaaactcctctaagttgctggtaaacaatagtggaaggagttttccagttgtctaggaaagagaaagggcattggaggtgagtgacccaggtaggtaagcaatggtgagaacacgatgtgtccatcatctgggcacaggaggttggcaaaagcaaggcagtagcccaagggtagcgtgaagatttgcaaaggctggtctgcaccttctggacagagcagccatgctgaacagcaggaacagaagagtacatgagaaccggcagaaggatgctgagctgcagctgaaatctgggatatttctgtaaatgtacaatacttgcactcaccaatgggtgaggccagaggatctaaaggtgacattttatcttttaaagttcacttctcaactgggtgtggtgccttacacctgtaatacca

SEQ ID NO: 115466 - DNA, 705 bp, Homo sapiens
gggacttcagtctcactttggagacagacaataaaatgtgcttatcattttagcactttcactacctgacattttgaaagggcgactgattgactgtgtctgtgatagacataaggcctctgcaaggatgtcacatgtaggctcagagctgaggatgagatagaactagctatgtgaataatgggatgaattgcattatgagcagagctcgtagcatgtgcaaaggccctgaggcagaaagcattcggtgtgtttaagacatgatgacagcctggatgaagtgtagccattcaggggtaattgatgaagggtggggctggagaagtgggcaggacactctaggccacggatgggagtttgcattttttccaaaggggtgataaatcatttaaaggttctaagcagaggagtgaagacataatctagtgtacaaatcaaactagttgctctgctgtatggagaatgtgtagaagggatctagagtggaagctggaattccagttaggagggtgcttcaggggccgagtgagagacaccactggctgagatgttggtgttgacaatcaagatattcgagacatagtttggaagtagaatcagtaggtctggcttttggattaggtgtggggcggaacggaaaagcaagagcaaagatgaactcctaggtggctggcttggattagtgtggaggtcagcaaactgtgg

SEQ ID NO: 115467 - DNA, 520 bp, Homo sapiens
gtacaaagcatagtgcctgaacttcctgggataaaaggagagttttccctttcatcaggggactcaggcctccatccttagattgaactttttgccctttagggctgtatattaccttaaatagctaccagctgacacactttgctgcaggctgatgttaacttgaaagtcgaaatgtatggactggtctctccctaatggaacttcagtggtagaagacaatgaattgaaaactcagatcacgattagggtcttgaagctattttatttttgaattctaaatcccaagttagaagggttatgaaaaggagaattgtgtatatttctttcacaagaaataagttggatctttctttgagtcagaatgggcttacaacaaataaacttttctccccatgccagaaactcctcattttagtaatgaataagccatgatgtagcgatttatgtgtaatcacctattgaccttccatatgcttcactttagaggctcctaagaagcttttcttcttttcttttc

SEQ ID NO: 115468 - DNA, 643 bp, Homo sapiens
gcagaaaaccaaaccaaaaaaaaaatgaccaaacaggaaataaaacaaacaaacaaacaaacaaacaaacaaaacagaggaaacactatttagacagaaaaaactcaagaacatcaatatttttacagatagataagatagtgcctctataaaatcggaacagaatactaaaaaaataaaaagaatacttggaaaataaaagggcctcttggaaattaaacacaagattgcagaaacaaagaatgcaatataaaagttggaggtggggtgactaactcatcgcagtttgtcttagcactaaaattcccactcctgggaaacctctctatgctaggtcaccttagttggagaatgatacggtttggccctgtgtccccacccaaatctcttgttgaattgtaatctccagtgttgggggagggacttggtgtgaggtgattagatcatgggggcagatttccctcttgctgttgtcatgacagtgagacagttctcatgagatcaggttgtttaatatgtgtagcaattccccttcactctcctgctccgccatggtaagatgtgcttgcctcccttcggccataattataagcttcctgagacctcccacccatgcttcattgtacagcctgtggaactgtga

SEQ ID NO: 115469 - DNA, 375 bp, Homo sapiens
accccgctctttaggatccccgctgagctgacaggcggccatgaggattaaacaaatgaggtgacgcaggggaagcacttagcacaatgcctgggtcatagtaagtgctcagtcaatgtcagccattgatttatttctcatctacttctacttcaagtaaaagttggcaaactagtttcaagatcattatacatgtaatccagactcaggctgagctcacaaatttgttctttgaaaaagccacacaattcttttgtaagtcttgatctcctgggtttttttttgttgttgttgttgttttaaatcagctatatttagctcttaaatttcatatctcagtttgaaatcctaaagtcatccttccaaaaatacaag

SEQ ID NO: 115470 - DNA, 772 bp, Homo sapiens
gggaagcaagcagaactagaacttgtgatccctaatgtatcttttacgcacacacacacacacacagatgtgtaggtcacgtgataccgaaagaaagggcagtatcaatttttctgataagaggatttttcataaagtagagaaaatcagttctaatcagcactgtctctgactggactggctgttagtgttgggagcaggagagtgggaagcagtcacttgaactctcaggttttctggtctaggttttctcacctagaacaccagggatctgtggagcttccaaatcttgtaaactttatttctacattgcaaatattaaaacgtacattgctgtaagactgatggtacttatagtagataagatctattctagttttaacatccatcattttgtattatttttagcaaagctagtgtttcatctgctgtgaggtttagcaagactgtgaattgagctctagtgctgccagaaaaagagttatcaccactttctattttgagtcaatgataaaattatttgtttctgtaagttaagaataaatgagaactttgccaacagctccttggagtagtaaataataagggtgtgtgctctggtatcactacaaattgctaatagtagtgtttttataacctgtattttgtggtaatttttgacgggacatttatggcagtttggcggaaattaatagagaaattaatgaagttaagttctagaaaattagatatgaatattgtgaaagtgtgaataaattatttattttctgct

SEQ ID NO: 115471 - DNA, 641 bp, Homo sapiens
gcttttctcaagcacagtattttcctattttcacaatatttgtaaagatcaatacttttttttttttggagacaaagtctccctctgtcacccaggctagagtgcaatggtaccatcttgactcactgcaacctccgtctcccgggttcaagtgattctcccgcctcagcctcctgagtagttgggactacaggcacgcaccatcacacctggctaattttttgtatttttagtaaagatggggttttgccatgttggccaagctggtctcgaactcctggtctcaagtcatctgcccatctcagcctcataaagttctgggattacaggcatgaaccactatgcctggccagggtcaatactcttttaaatgcatgtgctggaaccgatcctattttttccctctactgtaagtaacctccaattttcagaactaaatcacaatgtcacaaatgtacttgtatacaaagttttttcagcatttgggattgttttcttagtataaataaatgaaactagaattattgggtgaatgggcatggatgattaagtctcttaacacatactggcagactgggctctacaaatctatacctctacttgaagaatatgagtgttcatttcaatgtacctcattagtg

SEQ ID NO: 115472 - DNA, 430 bp, Homo sapiens
tacagcttagccatgtgacccagaacatgtctgtctaccaagtttctgtatgtgggaggcctggacaatgacggccgcaatttccctctccttaaatagagcttcagggaaagaatccctcttttcagatgagtggcagttaccgtacctgctgggagcgttgcattgaacccagggaccagccaagaggaactaatggaccccgtggaagatcatttgagcctcagctacgggaagagctggatgcaggccggggaagcggattggtggactgcacattcatttaaggttgaaatgcttagcattgtaaaggtgactgtgaattttaagcttcattctttattgacctggcagatcggagagtgctgtgtcttggtgtaatgaagcattatgttggtacagtgaaaaggaaactgccttcctggctgga

SEQ ID NO: 115473 - DNA, 397 bp, Homo sapiens
aattccttctggtgatcaaagaacccacaaaacagaataggaggcagcgccccatgcccttgtcagtgaggcagagtgtaacttgggagtttcagatgagtggcagttaccgtacctgctgggagcgttgcattgaacccagggaccagccaagaggaactaatggaccccgtggaagatcatttgagcctcagctacgggaagagctggatgcaggccggggaagcggattggtggactgcacattcatttaaggttgaaatgcttagcattgtaaaggtgactgtgaattttaagcttcattctttattgacctggcagatcggagagtgctgtgtcttggtgtaatgaagcattatgttggtacagtgaaaaggaaactgccttcctggctgga

SEQ ID NO: 115474 - DNA, 134 bp, Homo sapiens
gtaagaacgtcgggcatgggagtagttctcttgtctctcatattcccagtgaccttggttctgcaagaagtccagtagttctgcccctgctaaagtctgcagagaagggactccatggtaaggtccccttaatg

SEQ ID NO: 115475 - DNA, 610 bp, Homo sapiens
gttataaaacagagtgaaattatgactggttcatgctcaattttaactccacagccttagcctcattgggttgtgtagtaaccaaattaatggattaaagttagaaaatgtgccaaaccataaaccagagataagtaagcagaaaactgcactgtcatgaatggacatcgttctagtcacttctgagtgtgatggcatgagtattctcacatgaaagactattgtaaactcttacatttgttaaaaccaaacacttacagtctttacatgaacattataaacacaatttataaaaataaaaaaaaaaaaacaaaaaaaaaaaaaacaaaaaaaaaaaaaaaaaaaaaaaaaaaaaaaaaaaaaaaaaaaaaaacaaaaaaaaaaaaaaaaaaacaaaaaaacaaaaaaaaaaaaaaaaaaaaaaaaaaagaggcggtcgggcggcgagcgcacccggacgcgaaagaagacatatacacaccaacaatgtgtggtgggggggcgcgcgccgcaacacaagaagaggacacagagcgaagagcagacgagtcctccagcaaataacagccgcgggactcatgcggaggtgggggctaccaccaacaaagag

SEQ ID NO: 115476 - DNA, 445 bp, Homo sapiens
tttcccccaatcacaattctattttacctttttaaaaactctaaagggcaagaattttgctaatcttttctagaaatataaaaacaagcaaatatgttttctaaaacaaaccaaggcttttctcctggggaatttgcaggcatagcacgaactccttcctcactgctatttcttgagaggggctgttaggctgtgctgtgctctgcttaaggacgagaggccaggtacacagcctgagaggccagtcattgtgccatgttgttgtcaggagttcccagtgtccatcttgataaggctttgctaaaacatactaatacaaacttccattacctcctgtgtttctaaataaacataccaagttattttaagactcatgttttcctttataatcatttgaaatttctgcctagtgtgaaacaaccatctagattctcacagaattcat

SEQ ID NO: 115477 - DNA, 408 bp, Homo sapiens
tctgaatcatcggagtcactgggagcttggtgaaaaacacccccaggtggccccgcccctggagattctgagtcagcgcagccgggtgaggccaggaacagacctccctagcaaggacccccaggtgattccaatgaggcgaatttgggaaacacccatctaggccgtgtgtgaggcatcttgtttattcagggcggcaggacattcatccattcatccattcctgaactgtattttgagttattctgttagtgctaagtggtgaggattacacagggtccttccttgaagtacttgacagtttcatgtggatggttagatatataactaaataataaggaatagaatgaccatttataacattgtttctggaagaaaatctgttctgaattccaaatcgccaattta

SEQ ID NO: 115478 - DNA, 460 bp, Homo sapiens
accatctgttaattggggatactaacacttatttcgtaagactgttgtaaggcttaagtgaacaattaaaacaaaacagacacctaaagcataatgactgtgcacattaattgctcaataaataggaatttctccccttttgtaagtgaggaagcaacagttcagaatgtgaaatgatttgcctgagatcagaaggcttgttcccagcaaaggtggggttcaaagcaatggtttctgtggatgtattttttccctagcatccagcctccttcctgttcatgtctacaccctataggctacttatgtcagtagaataaaacaggtgatggctctcccatcgacctgcttgttgaggattttgggacagttccattctaggctaatgctcattactaaagacaatgctcattaataaagacaacgctcttaaggaggtcaccccctcacacggagaaatctg

SEQ ID NO: 115479 - DNA, 712 bp, Homo sapiens
agagacggggttttgccatgttggccaggctggtctccaactcctgacctcaggtgatccacctgcctcagcctcccaaagtgttgggattaaaggcctgagccaccgcacttgccaaagtaagctgaatcttaaggaataagtgaaattcggacatgcatcagaaagaatagtttggccaaaaggagcaatgtgaggaaagacataaaagtcaaagaacccagagagtatgggggaaaagtgatactccactttggctgatgcgtaaaggtattgaggagattagctcagggttagtttatgcagtgccttaaaaaccagactaataaccttagactttactgtctgagtattggggagccattgaatgtgtgtgtgtgtgtgtgtgtgtgtgtgtgtgtgtgtgtgtgtgttttctttttttagtgaagggtgcagaggagtgacttgattagaactgccttaatcatggagaaaatattggatagagcagactgagccttgctactcttgagtatgggcagagagtatcaacatcacttggaagcttgttataaatacaaaactacagacatcatgcaccctagaacttcagaatcagaatctacgttttaacaagttcctcaggtgattcctgtgcacattaaagtttgatcagctctggattagaagactaggcagagaaaccaaaggcagaaaaacctggagacta

SEQ ID NO: 115480 - DNA, 757 bp, Homo sapiens
tgcttgatcagttctgctatagactttgcatgaccttaagcagcttccttagattactcgagctctattttgttatctgtaaaatggttacaataatacttactccccggtgttattctgagtactaaatgagttcttatacccaaagcatctagtacagggcctgcacgagtttgtgttctttcattgagtattgctgttgtcattaaaaatataattttattctcagaaattacattttattactgccataaccttatagaccaacaacaaactgagtaatctctaccttctcttccctgtgtggctggcacttttggagaaaaatctcttaaaaggaaattaaagcagtgcaaccatctgtgatttgtcagggtcatataaaagagctatacaccaccaccaccatcaacaacaaaatcagtatctaagaactagattaatccaggtttgaaaccaccaaaaggagcataaaagggtaaagcaaaaatcaatatatattctgaaaagtatggacagaaggtaaattacagtttgtgtgtgtgtgttttgtggtaataaggaagattaaagtaatatttaaagtggttaagaaatctggacatgggctcaaatgcaactccactgtattccatttgatcttcaaagaaataaagtgctgtttagtttttgatcttcagtcttctcatccaaaaatgggaataataacagacttatttcataagattgtcatgaggcttatatgggatactgcatg

SEQ ID NO: 115481 - DNA, 216 bp, Homo sapiens
gtgtccttattgagttgtaacagttctttatatattttagatacaagttctttgtcaaatgttttgtagcttctggggaaaagaatgaaaaagaaattttaaaagaagacaggcctgggacagtggctggctgggtgtggtggctcacgcctgtaatcccatcactttgggaggccaaggcaggtggaccacctgaggtcaggagtttgagaccag

SEQ ID NO: 115482 - DNA, 307 bp, Homo sapiens
gggaaatgaaagaaaaggagaggggaaatatgtattagcctgaaataataataaacctagggtgcttggagaaagcataaagtgcttggagagacctaagaggcttggcgtcaaaacccttggcttcaatttccacctgttggttgtgtctgtgagcacatctgtccacctccctgggtctgagatgactcttctgtaaaactgggaaagctgagccagatcatctggaaggctccttctagttctgacagtctaagacagctctgtccagtagaactttctgcagtgttggaaatagtccatgtct

SEQ ID NO: 115483 - DNA, 419 bp, Homo sapiens
ccaccgcgcctggcctgttctgctcttttgtttaattctccatggctttgcatttgattggaaactcaagtatgttgggaattcttgagaatttgtaacagtggattctcaacctttttacaactgaggacaacctcattaaagaatatttttcatccacagaccttattttgatagatgttgtctaccaagcaaactgtatgtattccatgaatacaaactgtaatacaaactctattacgtgaagtaactaggactcccgtgctgaattaatataattccagtaaaaaataaaggcatttattgcttagtctcagcagttttactaagagcaaatgtgcagtttttactagatgttttgaactatttaaaataatttaagaatcatgtgttaagactttttagcccccacccctagg

SEQ ID NO: 115484 - DNA, 650 bp, Homo sapiens
gggtagctgggcccacaggcacctgcaaccacgcttggctaattgttttattttttgtagagaccggatctcactatgttgctcagggaggtcttgaactcctggcctcaagcgaccgtccagcttcagcctcccaaagtcttggggattattggcataagctactgtgcctggccagtttcagtcttttaaaatttattggccagtacagtgactgatacctataatctcagcattttgggagaagaaggccagaggatcaattgagctcaagaactcaagacctgcctggactgtaacatactaagacctcatatctagaaaaaattttaaaacttagctgggcatggtggtacatgcctgtggttcctgttactgaggaagctgaggtgagaggatcccttgagcctgggaggttgaggctgcagtgagctatgatcacaccactgcacttcagcctggacaacagagtcaggccctttctcaaaaaaaaaaaaaaattattgagacttgttttatggccatgaatatgttctatcttggtgaatgttccctttgcacctaagaagaatatgtattctgctatttgttggtattttggtaaaaatgtaaaattaggttgagttgttcatagcatcttgcaggttttt

SEQ ID NO: 115485 - DNA, 333 bp, Homo sapiens
ctagggcaccgcaacatttttgcaatgcctgactcaagggaaggaagccaacatttgtgaggcatttaacgtgagccacgtgttgagctgggcccatccctgtggctcccatttgattttgacacaaattcttagagccaagcactgctacagatggttttgggaagtgtagtgagttccccataagaagtgtggctaaaaatcagtaagaaaaggatgatcagtgtgagaggaaaaggagagtaggaaaagagaattcttagatgaagccataaaaatggcgaagaaacctatgcaaagatactcctctgttgtggcagagatcacaagctg

SEQ ID NO: 115486 - DNA, 436 bp, Homo sapiens
gtgttgggattacaggcgtgagctactgagcctagccccttatgaatgatttctttgtgtttcttcctatcctgcctgccctgtgtccagagcccaccttggtgaccacagtagccctcaggcagctgagtgtggcctcatgcagtccgctttctcttctaggtcagcctcttgaagaggaggcagcatgtggtctcactcagaggctcctcaactgggccatgtattagagatgtgacccaggagtaggtgggctctttgaacattcagattcccaggtcttaccgtggaagattctgatttggcaggtgctgtttataaccgttccctgggctgctgctagtttatcctctatcagctcatatctgaggcctctgcagccctaccagtttggtggttttcttatttttctcatttggtgtaagaatagatgtga

SEQ ID NO: 115487 - DNA, 162 bp, Homo sapiens
tatgaggattaaataagactattggctaaaaggtgcttagaatagtgcctagcacagagtaagcacttaataagtgttagctattattgtgataatacatgcatagaagtatatgcatgcatgtacatttaccagtatgtacacatttgcacacacaaaatg

SEQ ID NO: 115488 - DNA, 436 bp, Homo sapiens
cctcattgcactaatgccactgtacaaacacccccaggcccctgcaatttcaaggaggagaaggagctagaggcctgggcagcattgaaagggatgatgggcagcattgagagggatgatgggcagcattgagagggatgataggcagcattgagagggatgatgggcagcagtcccagcaggcaagtggcagagggcagtagggggaggtcaagtgaattaaaagcctgaaatggaaaagtcgaagtgaaaggaaagcaggaagagaatagtagaaggggatggactacaaaagaaggtgaagactgggcatggtggctcacgccagtaaccccagcactttgggaggctgaggtgagaggatttcttgaggccaggagctcaagaccagtctgggcaacttggcaagaccttgtctctccgaaaagaaaaaaaa

SEQ ID NO: 115489 - DNA, 680 bp, Homo sapiens
atgggaagatttatagttctcagcctgtgtacctacctgccccacctgatggccctcccatctctcctcaagcaattgttcaatgacacccatgcagcctcccagttgccatggaaatggcaagaatgcctctaataggaagtaagaatggaagaagatgattgtacagattcctcaagcaattcctgagcaaattctccaattacccttcgcatccagagtcaaggatttctctgggttacaggaacagcactgaggctttcaacatcctcaccctggcaagctggttgcctccttttgcccagcagtgccacagcactactatgcacagcaactcggctcccttctttcagctggattccttttgtgagactgtaattctgaaacacccagtgaaactggaacaggaacaagaaaggggattcttctgtgattgccccaaaccatttgttgtctgcagaaaacttacattggtgcatccatgggcagggcatgaagagagagtccacagaggagcttgaccctctcatcttcccagagatctaaagagcaggtgtggtgaggaccatcactgaggtcaatcagaaatacctgcttgctcctgccttcatgagagatggctctatttagccacacagacacatcctttttctacctaggcctatcaacctaataggaaa

SEQ ID NO: 115490 - DNA, 266 bp, Homo sapiens
ccaagtcttgagcttcttcctcatgttgttaactgctcagctgagttatttcaatggcatgaaagaaacatagaattaaggtcatagagcatggtcctaattcatgcctgctcgccctgctttactgccatcatcatctatctccttgctttcactcaacaaatatttggtgagcgcgatttttttgttaggcactcacccatgctccctcccttcctttctcctctccttcagtttgtttgcctaccagtccatgcacccacccg

SEQ ID NO: 115491 - DNA, 500 bp, Homo sapiens
actgaagatgcctttcattgtccatctaaagtactggactttccaagcaggtgacaaatgatctttctactacagtttaacctcatcctggttggctcctttccacctctcacatctgctttacatgtctctcctgagccacatcttctctgagcagtccttcaacttgggttccctgtaattctctacctaagctccttactgttccctttgtaggaattctctccatccgtggtatcgtatagaggtctgcgtacttccccctgctgtttggttcagcattcaaagcacaatttctggcacacagttaggtgctggacaaaatctcaatgtgtgcaatcctcgtaaactctgcatggcctccttgtctccatgttagagatgagacatattgtcaaatggtaagacagcctgcaggtgggggcagtggtggcacaggacacaacgtcctgaacaggcagtcacctcacgtcacctgagtccaccctgaggccatgccc

SEQ ID NO: 115492 - DNA, 775 bp, Homo sapiens
gggacactggaagctatggagggccttgtcagccacagtaaggaatgtggacctggtcctcagggtggtgaggggatggccccccatccagaggtttctcacaggggagtgattcggcctgtctctgccgcagtcagaaggaaggatgcagtgagagagggaaagtggagaggcggatggcggtgcagtctactccaggtcatgcttcttaccatctccctcattattcatccacagaaaatgattgctgttatatgacacactggttaacaaaggagggggctgtttgcaaacagaaacaaccaacccagggcctccagccatccaaagattctgcacagccagccacccctaaggctaagaaatcccaggtacatgcacaccagtcacagcatacctggactcagacaatgacagtggagaatgaggaacaagagctgggttcaaggaataattagcaagcaacgttggcattacgtagtgcagggacaaaggaggagggagatagcccgtgggattctggactaaattgggcaaatggtatgaccatggttaggcttttgtgtccccgccccaatctcatcttgaattgtaatccccaagtgttgagggaaagacccggtgggagaggatcggatcatggggtggtttcccccacgctgttcttcggatagttagggagttctcatgagatctgatggttccataagcgtccgtcatttcctccactcacactctctcttgccaccttgtgaagaggtgcctgcttcccctt

SEQ ID NO: 115493 - DNA, 629 bp, Homo sapiens
ggccttgaaagatgtgtgtcccagaagctatataaccaggtataagccacatgagtccctcaatcctcctggagaagtgttccaccctggagagctgcttctcttccagaggactttgaacaagaaagaaactatctttcatgtgataggccactgagagctggaagtttattaccacagtacagcctttcctattctgattaatacagaaattggaaacagaagtgagaattactcacaacaaaaactaagaataattgccattggctgagcagtggggcaagaaggtgagaaaatgaatatcatatttgggaaatattaaaatatggagctgcttgtcatgcaatgctcaatgtattatacatttcaaaactgcttaaagagtggattttaagtgttctcaacacaaaagataagtgaagtgattgatatgttaatttgcttgatttaataatttctaaatgtacgcatatatcaaaatatcacatcataccttaaaatgtatacaattattgtcagttaaaaataaaataatacaaaagaagtaactttaaacatttcaaaacatatgtatagaaagcctgttacccatgttcatttgggagacggatgctacctattgaaatagg

SEQ ID NO: 115494 - DNA, 432 bp, Homo sapiens
ctttgggccttttgtaaaagggggtcctgtccccccgtttctcagagggggagacccagcagcgtggagagcgctggggggcgctgcagggtcagatcctgcgtattcaagcactggctgtgtgattttaggccagttatctaacctctctgtgccctagtttcctctgcgaaacgaaattaataaagtcccatcgcctagtttgaaattgcaaggaagaggcttcgaagaactccatttaaaaaaagaacacttgggccgggcgcggtggctcacgcctgtaatcccagcagtttgggaggccgaggcaggtggatcatctgaggtcaggagattgagaccatcctggctaacagagtgaaacccggtctccactaaaaatacagaaattagccgggcgcgatggcaggcgcctgtaatcccagctaccca

SEQ ID NO: 115495 - DNA, 530 bp, Homo sapiens
aaagtcaaggatagtataaggaagtcctggtgtaccctttaactagataccccggttgtttcaaattattattttttgctaatccatagtagtagagtaatgggccattcattcatatgttcattcaagaaaatttcatagcagaacctttgtgcaaaaaaagtggatgaggcaattctttccctgcttcatttctactattagcaattcatgactgatttagctctttggtttgtgaaatggatgactgaaaacctctcctaagttaggaaagtaagtgaagaaggcactttaaaactgaggtgccatcttttttgtcttctctgtgggatattcatttaaaatttttctcgtagtaaaggcaagcacagatggaaggtggtataaggttcagcctcatcccttaacttcagcctgatggtgcttgtgatagtgcttgatttgctggtgatactggcgtagttaagaatctcccagcttaggagagagaacttaacatggcaaaggtaaaaagaggagcaggtttcatc

SEQ ID NO: 115496 - DNA, 599 bp, Homo sapiens
caatcaataacaactagaactgactccaactcaaactaatttctcgttagaaaagtaaatgaattgagtaattaaaagaagaactaaggttaaaacaaaaaatcaaagaaactgttccaacatcaacgggaagctccgcagactaaaacatggttagggcaaatctggtagtcctgagggcaattaaacatgtctatttagatagaatgtatttttatttttggttttggttgctttgtctccctcttatacctaatagaagacactgaatttgtgtcttttcataggaatgcatgtctgtgtttcctatgagctattatttttgcctgcagtgctagcagagggattggctatgaagacagagtttgcctttcttcactgtggcctctctctgggtagctgaggaccagataattccatctccacagctactgcctctgtctttatgaatcacaaagatacagaataaccaaaccctccagtcctgtcacactttgctcttctactttagaaaagctgtttatgtgatttcagattcagaaggtacttttcgagcatactaggccttgacttttaggcagcacaaagctcttctcatt

SEQ ID NO: 115497 - DNA, 210 bp, Homo sapiens
ggggccgcgtcggggcgggcgggcgcgcgggccccgcgggggcggcgcgtggatggatccgcgcgtggcctggatccagcccgagcagaaggggccggccaatgccctgtggatgcagatctgggagacctcgcagggcgtgggccgcggcggctcgggcttcgcgtcctatttctgcctcaactcgccggcgctggacacggcggccgc

SEQ ID NO: 115498 - DNA, 465 bp, Homo sapiens
  misc_feature (358)..(358): n is a, c, g, or t
attttaggccaagtccttctcagcctaaattgtgtatttgaaacaaggtattttctgaacaaggtgtttgagaagtagctattgccatgtaataattacctagcgcttccttcatactctggaagaagaaaatagtgcgttttttttctctcgaggtcataatgtgaatgttgtatgcagtggccatgtcatcagaacaggtgtgccagccccctgcatggaacatgtacatgcttcaggttgtgcggaattaactttctttagataagggataactagcattcatttcagataacagatattcaacctataattgtttttatttaaaacctcttccaccttgaccagggctcctgtnaataaacaggattccctccagactagaaggatttgctgagtacctgttatttgaatttacttttattagttcatagaacctttcaacaacagtgtgagttaggttat

SEQ ID NO: 115499 - DNA, 431 bp, Homo sapiens
tcctggaaaacatgcatttgattgtgacagatgagaggacaggggattcagtccattgctggttcctggggactttctaaactcactaaagccaggggcctctctagtcaaaaaataagcacctggcatgtaagcaataaagcaatcgaggaaaggtgaacttatttgtgagaccttggaaagaacaacagtaagaagggaatacatcctctacctgctcaggatctgggaaattctaaaattgtatcacatacaggaatagtagaaaacacgggagctaagctggtgcctgtgagagacctgctttgaggactttaactcagagtattctggcttcagagccattgtcagcacttaacctccagggctctattagcacagggacattatcaatatttctcacttctgaggagcacccgtctccttgccca

SEQ ID NO: 115500 - DNA, 414 bp, Homo sapiens
gcccaagtaggagctggaattcagaaaacccataaaggtacctagataaaagctagaaagggagtttggaaaagaaaagaaagtaagggtccacgtcaaaaaatcattctacaaagagaaggttggtcaatttttaaggttccatatgacctcaaaggaaaatctcggttatctcccacttcctattaaagcatttcagtattaacggctcaacagtgaacttattgtaaattcagagggcgcagtggcacacgcccataatcccagcactttgggaggccaaggcgggcagatcacttgagctcaggagttcaagaccagcctggccaacatagtgagaccctatctctacaaaacacacacacacacacacacacacacacacacacacacataaaaattagccaggtgcgg

SEQ ID NO: 115501 - DNA, 654 bp, Homo sapiens
gtcattaaagaaagagttataaacaagaccctgatgtgcagtttcagagttttgcatttttgtatccggaagaatcatggtattcctaagagaactcgggcttagagagagtggagaggtaaattctgatggaaaagcaaaagaggggaaaggaaaagtgtgaccaagtggaagtagtctctcaggtgctgaagacacaagtctatgagcttagcagagatgagaggtaaagataatgctctggaggccaggcacgatggcccatgcctgtaatcccagcactttgggaggctaaggcgggtgggtcacttgaggtcaggagttcgataccagcctgggcaacatggtgaaaccctgtatctactaaaatacaaaaaaaaaatagcatggtggcgtgtgcgtgtaatcccagctacttgggaggctgaggcaggagaaccatttgaaccctggaggcaaaggttgcagtgagccaagattgtgccactgcactgcagccaggatgacagagtaagactctacctcaaaaaaaaaaaaaaaaagataatactctggggatcatctgtacagttggagctgtgagagtgaattagttttgtttgagaagggagagttagcaaggggagaaaagattgacaagaccagagtcttggg

SEQ ID NO: 115502 - DNA, 189 bp, Homo sapiens
ccaatattagtaacaatggtagtcctaatgatagacaacaaggacaaagtgttatttctcaagttgtgtggcacatgtgtgtgcaagtgtgtatgtttactggaagggaattaatacggatagttttaaaattaaataaaggcaccattatgtatgtcagaaaattactgataaatcatttttgtctgt

SEQ ID NO: 115503 - DNA, 350 bp, Homo sapiens
aggcagggttcatggaacttgagctcacagtgagggtgaaaattatattcgacagcagaaatgagcaaaaaataacaggaagaggaagttgtgattatagaaaagctctcaaatactactttctctttgaagccttttataatcatcttatgggaccttccccctattctggacctctttcaagatacttttcttatactctatcaagttacatccatgtgtgctcctctttcatctccctgatattgaccacattttgcaattggaaaactgagtcaaaaatgggggatcacctgtagtcccagctactcaggaggctgagggcaagagagtcacttgagcccaggggt

SEQ ID NO: 115504 - DNA, 410 bp, Homo sapiens
aaaattggggtcccttcctcactaactagataaccatgaacaagttactttctctctctgtgccttgacttcttctgttaacctctccacactttggttaccattcttcaaaatggtaaccatttatgggaatgttttagagacaaaatgaattagtatgtgtaaattgtagagaatagttcctgatacaggttttgttctccataaataataactattttcatcatcattaacattattatagtcttcatgttactgctgcctgcttaacatgttactggtggcaaaccaatgcatagagaggttaggtgactcatccaaggccacacagcctgtaagtagtaaagttaagtgtgcctcctcccttatccagggagataacatctgaacagggacccagcttcaaatag

SEQ ID NO: 115505 - DNA, 247 bp, Homo sapiens
acaataatttacaattgagatctaattctaaattattgtggcttgtgggccaaatctggcttgcagagcattgtaaagaatgtgcaacagggttgaggtcaggagttcaagaccagcctggccaacatggcgaaactccgtctctgctaaaaatacagaaattagctggacgtaatggtgggcgcctataatcccagctgctcctcgggatgctgaagcagggagaattgcttgaacccgggacgca

SEQ ID NO: 115506 - DNA, 693 bp, Homo sapiens
aattgttaggcaatcacaggagccacacgtttgagggaatatgtacaagccagagcagagcaaggaaagtccttaaggagactatttcagtaatctagtaatgagatacagaagcagaagattgggtctataaggttttcgattagagataaacttagaaagaacaacgaggagaactttgattatatatatataggttgcaccttgtcctgggcacttaatagtccctaaagagtaaacgtagacaactgctgttatttggaacatgtgttttttgcttatagattaacagtgtgtttttttaacctcagtttgttaacagacatagagaacatgttaaacccatgtttctttgcgcccgtgtgacattgtgaactaagtggaaaagatgtctgtgctaaaggcacccatggagtaaaacatatccacaaatactgtgtttagggaaaaggctagaaatagaaactgagagtaggaaatattgcacctgaggggctgttattgtactgtgttccttctccttctcttcctgacataccctttgttatacctttttcctttcctgaattctttgttatttctttattcttttccactttcattctttttctttcatatctttgactcaggcctgcctgggttttttattggcatgtgtggacattgcttagttctgacccattccattagaga

SEQ ID NO: 115507 - DNA, 696 bp, Homo sapiens
ggaggttgcagtgagctgagatcgcgccactgcactccagcctgggtgacagagcgatactccatctcaaaaaaaagaaaaaaaaaaattagggcatggtggcgcgagcatgtagtcccagctacatgggaggctgagtcaggagaatcacttgaaccccggaggcagaggttgcagtgagccgagatcgcactactgcactccagcctgggcaacaaagtgagactctgtctcaaacaaacaaacaaaaaaacccaccttctcatgggttaggatgttgtgccaatgcagtgagacggtgactagaagatgcagtgtttcttaacaaatgagagtattgagtgtccaggcctgtgctgatagccagggttcttaaactcgaagggaaggatgggcacttcttagcaacaagcagtccattgctacttcaaggaagggtatggctcttgggcacaaacctttcaatatttcaagagaagctagcaatcaggaaattgtagatgaaatgtcctgttttagatgttggtgattgactaaccaccaaattggccagcattctggcccgcgggcctccactttgcgcccctcaagcagtggtaaatttttgggaatgatgttgaatgggtcccgaggctcagagtaggggggggttttcaggcgggggcctccctatggccagcaggtgcggtggagggg

SEQ ID NO: 115508 - DNA, 287 bp, Homo sapiens
gggaatatggcagaaatgtcttttagtttctaaaaatctcctcctcctagttttcataagattatacacattgcaagaattaggtgtccatggagaggggctttagttaaaatggaactgagaagcaaagcagaattgatacattttataccagtaagaacttaaaactgactgaaatgtcatctcaagaagttttaaggtatctaagtaggggactttctatgtgtaagaaactgagccatcttaagaaaattgtaaagtttctgacctgttgcaaaaggctttat

SEQ ID NO: 115509 - DNA, 318 bp, Homo sapiens
aaggaatgagacttcattaattagttttaaagaagtactcagggtgattgagatgacattccattatgttcccctgattaggatgggcttggcagtttgattcatagaacactatgtagaaagtatcttttcctttggcatgaaattagttaaactggcatgtaaacacatgcaattaatatcttccctgtctaccctgtgccagtaacttaaaaaaataaaaataaagagagaaaggtaataattaatctataaagaaaaagacaatagtacataaaagatttaaagatatatttgaaaattggaaaacagtaaatg

SEQ ID NO: 115510 - DNA, 241 bp, Homo sapiens
tgattctccttcctcagcctcctgaggagctggcattacaggcgcccgccgccacacttggcatgaaattagttaaactggcatgtaaacacatgcaattaatatcttccctgtctaccctgtgccagtaacttaaaaaaataaaaataaagagagaaaggtaataattaatctataaagaaaaagacaatagtacataaaagatttaaagatatatttgaaaattggaaaacagtaaatg

SEQ ID NO: 115511 - DNA, 898 bp, Homo sapiens
ggcttcaggtctcctagcaacaagttgtaccatatgaggacggccgctgagccataatggagatatcaatgcctccacctcagatatatgtagaaaaaactctggccattatcaaaccagatattgttgacaaagaggaggagatacaagatattattcttagatccggattcaccattgttcagagaagaaaactacgcctcagccctgagcaatgtagtaacttttatgtggaaaagtatggaaaaatgtttttccccaacttaacagcttacatgagttctggaccacttgtcgccatgatattagctagacataaagccatctcttattggttagaacttttgggaccaaataatagcttagtagcgaaggagacacatccagacagtctgagggcaatttatggcacagatgacctaaggaatgcacttcatgggagtaatgactttgctgctgcggaaagagaaatacgttttatgtttcctgaagtgattgttgagcccattccaattggacaagctgctaaggactatttaaatttacatataattgccaactctgcttgaaggactcacagagctttgtaagcaaaaaccagcagatcctttgattttggctagctgattggctgctgaaaaataatccttaacaaaccaaaactttgtcaccatccaattgtagaagaaccttattaccaaaaaaatcctcgaaaagaacaaatcatgaactatcttatttatacaaaggcggtacttcttacggtcggaccacctcctttccagggcttaagttacctaccagttacactactctattcctaaaaaacacccaaaccacccagcgaaaacaaaaaccccccaaggcggacccggcaagggcgagaacccagggggcg

SEQ ID NO: 115512 - DNA, 319 bp, Homo sapiens
tatttagcataagaaagaagctgcaacaaattataaatattaaaaggttgaaaacaccataaacatcacaaaatttaatcccctcagtattacattaatcaacttcctaactcacttttatgataccttttccctatagtttttaaattgcttatttaattacctcccttaagagaattattttgttataatttctacggcaagaactgaaaggcatttgcctttccctagtatgtttaataaaaattcattttgtattattaatagtttagaaaagaaaattcagcttcacagcttgttattggtaatgagataaata

SEQ ID NO: 115513 - DNA, 835 bp, Homo sapiens
tactgtagaaggaagaaaggcccaatattggaggacaactagctatgtaatataattgtatgccttattcctttaatttgttaatgtactaaaatgtactaatatattttctaatattaaatcatcttcacattcctaggataaatcccacttggtcatgaagtttttttactgtattattggattctgtttgtgagtactgtatttaggatttttacatctgtgtttattaaaaatatacttgttgatgcaaaaagtagtaattacactttacatttatatggtattttgcagtttttaaaataatttcatacacattcctcctgagaataaatgatcaacaagagaggactatagttttgaaaaagtagatattaagtgtacaaatagaaaatatctacaaatgggacaatataagtttttttggtcacctgaggactatagttttgaaaaagtggatattaagtgtacaaatagaaaatatctacaaatgggacaatataaatttttttttttgtcacctaagttctagagggccaacagtgagactgagattgaagtaaagattagtgtagagaaaagaatacaggaggttgaaaaaggatttttgatcaaacaaacccagggagagatgctgtcactctccagggtcccagggaagaatgggattacaggctttgtgaaatgtctagcactgtactgctattctagatattttattaatacaatgtctaaacaacctggtttgaatttacaagtaaagctttcctagttattaaacaatatttggctttgtgaacttctgttttgattccttattaatctgcatatacca

SEQ ID NO: 115514 - DNA, 395 bp, Homo sapiens
tgtgactagtagtaagtaaaacaaaggagtttctttatgatgatgcaacagttctgcatattctgattgttgtgatggttacatgaatcaacacatgtgataaacttttatagaatcatattcaacacacacacacacacacacacacaaagcgtgcatgtaaaaactggtgaaatcaaacagggtctgtatctgaattcctagcactgtaccaaccatcagttaactggtttttggcaatgtcctgtgattatatgaggtattatcatcaggggaacctccctgaaggatatacagacactctgtactacttctgcaactacttgtgagcctatttcagaacagaaattatattttaaaaaagcaggaactatgcaacagagggacagctactc

SEQ ID NO: 115515 - DNA, 238 bp, Homo sapiens
ttttttctttctattctttcattctctgtttcatttttatccaccctaatatttatgtcctttcttccttctgcttgatttgggtttagtttgcttttctccttttagtttcttaaggtagaagattagttgacttgggatctttctttttgtccttttttttttttttttttgagacagggcctcactctgtcaaacatgctgggatgcagtggcacaatctcagcttgctgtaacc

SEQ ID NO: 115516 - DNA, 398 bp, Homo sapiens
gaatgaaagaacatgtaaataagaaggaagatatcccacgttcaagaatttggagacttaatcttgttaagaagacagtactacccaaagtgatccatagattaaatgcaattcctatcaaaatccaaacgatgttatttgcagaaatagaaaaacccattctaaaatccatatggaatctgaagggagccaaaacaatcttgaaaagaagaagaaagttagaggactcacagttcctgatttatttcaaaagttactacgaaactacagaatcaaaaactgtggggctgcgtgtgatggctcacacctgtaattccagtgctttgggtggctaaggcaggaggattgcttgagaccaggagttcaagaccaggctgagcaacatagccagaccccat

SEQ ID NO: 115517 - DNA, 335 bp, Homo sapiens
  misc_feature (16)..(16): n is a, c, g, or t
gctgttcagaggatcnctcccgtatagacatcataaatatgtgtcattttgagatgtggaagatacattcctataagataaacatataaatgtaaattattgaaagaaggctatttacataggggtttttttggcttaaggtttataggtctcttaaaatggctacatgtgttacataatttcaaattcatatttgggcttattttttaaaagcatgaaaactatagaactcttcagaaacgtatctatggtgagaaaaagaatacttagaattttcaaagatgcggtattctaataaaaaataacaatgctaattttatctgaaaaatacatgt

SEQ ID NO: 115518 - DNA, 549 bp, Homo sapiens
cctaggcgacagagcgagactccatctcaaaataataataaacagttagttaccagccataaaaataatctgttttctgctatgttgaatattgctctttttcaagagcttaaggggtatgtctctcctgtcttctctctgtccctaaaaatgagctacgttgtcttaaaagatgaaagggccaaggcctggagcagtggctcacgtctataatcccagcactttgggaggccaaggtgggcggatcacttgaggccaggagttggagaccagcctggccaacatgacaaaacctcatctctactaaaaatataaaaattagcctggtgtggtggcacatgcctgtaatcccagctattccagaggctgaggcaggagaattgcttgaacccaggaagcagaggttgcagtgagccgagattgtgccactccagcgtgggtgacagagcaagagtctgtctcgaaaagatgaaaggtcctagtaaaaactgcttagaaggccagctgcagtggttcgtacttgtaatcccaacactttgggaggctgag

SEQ ID NO: 115519 - DNA, 926 bp, Homo sapiens
atagtaaaaccaggatgttgacattgaaactgtcaaaagacagaacatttctaccagcacaaggatccttcatgttgccctttatagcccaggcacttccctcccacccagaaaccctccttaacccctggcaacatttaatgttttccatttctgtagttgttacttcataaatatgatacaaagtaaatcatatagtatgtaactttttggagttagcatttttttcactgtcagagtaattctctggtgattcattgttgcgtatttcagtagttcgttacttcttattgctgagtaaatccatggtatggatgtgccacagtttgtttaatcattcacctgttgaaagacatcaaggttatttcaaggttttggctattatgaataaagatcctataaacattcttgtgaacagttttttccctctggcatgcatgctcagaatcatatttgctgagtcttatattatttgcatgctgagttttaaaagaaactgccaccagagtggttgtaccagagactgtcaatccagtttctctgcatccttgccagcatttggtgctgtcaatattttttattttagctattcaagtgggtgtgtagtgatatctcattttggcttcaacttgcataatagttaatgatgttgaacactttttcatctatttatttactgactttatatcctctttgatgaaacgtctgttcatgtcttttgatcattttctaattgaattgtttgtggagctttttttactgttgagttttgagaatttattctatattttattctaggaaatagtcctttgtagctgagtgcagtggctcatgcctgtaatcccaacactgtgggagggccaaagcgggcagattgcttaagcccaagagttcaagaccagcctgggtaacatggcaagacccca

SEQ ID NO: 115520 - DNA, 788 bp, Homo sapiens
aggattcatgatgttacacattttaaagttctttgcaagctatagtaatagttccaggtaaataaatggaataataaattctgtaaaaattataaaaacctagtctgttgataatgggctcttttaggtagagtctagggtaggaaatcaaacattatattcatcatggtacttgaaatatatttaagctgaagctgtacactccatcatgtttttgatatatttttccttggcattacttgaaaggcatgctcatgaaactggatttggatctgtttcatgttttcacttgcgttctctgacccctacttagagggcaccaggtgcttcctattctaaccgtttgcaaattcaagacttggttggagggccattcaggggactggtgtggggttagataggatctggacacagcgactccctcgctcctgctccagtattttgaccttaatttgaacagttcaatgaactggcaactgaagtcgttttttcccactgaactagacctttcattgttttgcagaggaagatgactcatagccaggttctaccattgtgctaaagtgaaattttagtctaggactaaaggaacacaggccaaactttctgtctgagctgcagagtattgaaacttagattgtgagctgggcaggaattcctgtggccctctgtgtggagttgctctcaaggaaaaggagcatttaaatacgtttttgactccaaatttaatttttagtaatatagttcaaatgtcctttaaaatatcttaagtaatcagactgttttct

SEQ ID NO: 115521 - DNA, 577 bp, Homo sapiens
tcgtcttttccagatacagatatttattggcccataaatatctacacaataaatagtatccaaagcaaagtttttaaaatcgaatgcacactgcataatagtctctcttgagaattaacacagaaaataagtagaggaaagcaaaggaagctggatttctgggaaagcctacattcttgtgtcagactttggaagaaaaataaagtgttaccacagactttgttctccgtgaaacccctgagcagcaggattgagttctgacgtgaatgctgggaggtgtttctcagtgagggcacagggcactggctgataaaacctggggccactggcctgtttcgcaattctggttgagttgttaatatttacatatgtggtttccctactataaggtctctttagtttccaagtttttagtcatccccaaagctcctcttatatccatccacagaccagacagtgtcagcagttcctttctatgaagcagacacgggcattaggaaagccttctttgcctgagtccgtgtattgccacctaagctttccttgtctggtctggagcaaaccagtcttctgtaga

SEQ ID NO: 115522 - DNA, 231 bp, Homo sapiens
tctaaactcatctggcaactaaacatgaccaacatgaatataaagctgttcatggctttaatttatcccattttgtgtgttttgctgcagaaatattaactttttaattacaaagattgctatcccagatcccactggatgaaatgcggaatgtacactctattactactttccaaaatctgaaataatctgaattccaaatgcctggccccaggggttttggataagggt

SEQ ID NO: 115523 - DNA, 525 bp, Homo sapiens
gcagggaactgggggacaatggacctacaattgaggaagcagaagttgcacaggcctcaggagaggcagccaaggatttacaataagcggaggaggagctagagagggcaaggagagtaagcagctgggttgtaaggtggggagatggagcaaaactacgtgccagaggagctggggccagtactccaaaaggagaccaaagactgggtaaaaccaaactcagaacaagagctgagttggatatgagtcagtaacaggctgggctggcctgaggaccaagggatgagctgccccagtgagatgctagaggattcattcattcatttattcacctgatgtttactgagttgcctgctatgtgccaggcactggcacagagcagtgggcaagactgataaggttcctgccctctcagagcttatctcaagttagggagatggccaataaaaaagcaaccaagtaagtaatggagaaaatctcagaagtgatgtgccacagaggaaagatgggaaatgataggaacaa

SEQ ID NO: 115524 - DNA, 371 bp, Homo sapiens
tcttgcctctttggtgtcttttaagccaacccatgactggctgtgccagtacagtgtggttaccagactgagaagatatttgcaggaactaggagacagagggtataaggagaaagcaaacaatgggcagtgttggaaacttaaattccaattgtgactgtcactgtcttgcgtgtgatgttggataagccccatttcctctctgggtctcatttccccattgataaaacatggttaataatatggtgctatttccttcagaaaattgcttggcggtcaaaatgagataaaggatgctaaagaattttgtaaattaaaaagtgagtttgcaagaactctgtgttcctccatgttccacccaccaacaccaa

SEQ ID NO: 115525 - DNA, 340 bp, Homo sapiens
ataggtagatccgtgtatacctagactgacaagcatataagcatgaacatatggaccagcacgatggtactaacggtacgaagactgacaaagagccagtgttggaaacttaaattccaattgtgactgtcactgtcttgcgtgtgatgttggataagccccatttcctctctgggtctcatttccccattgataaaacatggttaataatatggtgctatttccttcagaaaattgcttggcggtcaaaatgagataaaggatgctaaagaattttgtaaattaaaaagtgagtttgcaagaactctgtgttcctccatgttccacccaccaacaccaa

SEQ ID NO: 115526 - DNA, 344 bp, Homo sapiens
acacctccgccccagcatcatccccaccgtcagcagcaccttcatcaccaagaagcagttgttgaatattcatgggtgctgtgctgggtgttctctggctgagtagatggttggggacctcctaccatatggatggaggaagaaggggaggaagagagagaaccacaaagcagtggaccctgatcacaagggaatcatcttcaaaagctaaaaagaaatcaccagaccaggcgcagtggctcacgcctataatccaagcattgtgggaggccaaggcgggcggatcacttgaggtcaggagttccagttcagcctggccaacatggtgaaaccctgtctctact

SEQ ID NO: 115527 - DNA, 190 bp, Homo sapiens
aaaacaaagcaaccccagcccattccctgtgcctcaggacacagacagttggacccagttaattgaaatttaagcttcgggcaataggatttgtacaaacaccaagaaaatagcaggaggatgctgacagcatgcaaatcgatgagatgggagccctttaagacaatcattcagtttgggcagcccaggt

SEQ ID NO: 115528 - DNA, 564 bp, Homo sapiens
acttaggatttgagcatctttctgttatgctgttgccccactcctattgcaatactccccttcttaagaaagtttttctagactaatgtctagattaaacttcttttctttgacaataatgatgccatgacttggacaaaatgcccattgcctctgggtcctgctttcttcacccagtgctgccttagttggactccttgtgcctctccttggctggggaaatcagaatacacagtggtaagtcatgatttctaatccagtgctccagacgtctgtctgttgtagcacagtgagaagttgacttatatttctctcatttttgtcattttcttctgtttttccatctttcccttctgccttttttgagtgtggtgaaagcccctcattctctcctgagaatcatacctgagttgaaatcccaaagcctctagcaccagcaggtgtcccttccattatcatgagaaaccgtcaatttggctgttgttctccagaaccctcaactctggggtatgctctgtgttactatggtaataattccacccactttcttccaaaaaaaaaaat

SEQ ID NO: 115529 - DNA, 482 bp, Homo sapiens
gacgctctctctgtggggaaatcagaatacacagtggtatcccacttctaagatgcctgatctgaaggacagtaaaacaactgacctttgccagcatgtaaaacacatggtttaactagtcctccaggaacaacactgagcaatcctgacctgggactactttactcggccatctcctacttgagatgctccttgtctctctgttcaaggacaccttttctgagcctttcttgaacaagagtggaggaccgatagggcgattaaactgtccttgacacaactttaggttggtttgcctaaactactaggttctcaatctatatgaacctcctccagcattctaatttgtttgctctgtcttagacccagaatcccaccccatgtgcctaaccatagaccaatcttcctgccttaacttctctgctaccaattttgatgtagcccagtaagtttcagcatcatccctcaccaccccacagtcc

SEQ ID NO: 115530 - DNA, 509 bp, Homo sapiens
acttaggatttgagcatctttctgttatgctgttgccccactcctattgcaatactccccttcttaagaaagtttttctagactaatgtctagattaaacttcttttctttgacaataatgatgccatgacttggacaatccttgtgcctctccttggctggggaaatcagaatacacagtggtaagtcatgatttctaatccagtgctccagacgtctgtctgttgtagcacagtgagaagttgacttatatttctctcatttttgtcattttcttctgtttttccatctttcccttctgccttttttgagtgtggtgaaagcccctcattctctcctgagaatcatacctgagttgaaatcccaaagcctctagcaccagcaggtgtcccttccattatcatgagaaaccgtcaatttggctgttgttctccagaaccctcaactctggggtatgctctgtgttactatggtaataattccacccactttcttccaaaaaaaaaaat

SEQ ID NO: 115531 - DNA, 805 bp, Homo sapiens
acttaggatttgagcatctttctgttatgctgttgccccactcctattgcaatactccccttcttaagaaagtttttctagactaatgtctagattaaacttcttttctttgacaataatgatgccatgacttggacaaaatgcccattgcctctgggtcctgctttcttcacccagtgctgccttagttggactccttgtgcctctccttggctggggaaatcagaatacacagtgatggagtctcactctgttgcccaggctggagtgcagtggcacgatctcggctcactacaacctccgcctcccaggttcaagagattctcctgcctcagcctcccgagtagctgggactacaggtatcccacttctaagatgcctgatctgaaggacagtaaaacaactgacctttgccagcatgtaaaacacatggtttaactagtcctccaggaacaacactgagcaatcctgacctgggactactttactcggccatctcctacttgagatgctccttgtctctctgttcaaggacaccttttctgagcctttcttgaacaagagtggaggaccgatagggcgattaaactgtccttgacacaactttaggttggtttgcctaaactactaggttctcaatctatatgaacctcctccagcattctaatttgtttgctctgtcttagacccagaatcccaccccatgtgcctaaccatagaccaatcttcctgccttaacttctctgctaccaattttgatgtagcccagtaagtttcagcatcatccctcaccaccccacagtcc

SEQ ID NO: 115532 - DNA, 456 bp, Homo sapiens
ggctggagggagctcactggggcactctgtggtggcgccctgggtggcaagcaagtgacaggccactagccaggacctgcccatcagtcctatcatgcaaacaaacacccttcaagaggctactgaattgcaaagggagaacggctcgatgctaatcagagcacaaagaagaaaattagagggtgcaaaagttgctgttttcacagaattccgtggagctttgaaaacggaaaggctgtttgtgttcataaccaccagccctgtctcctttgaagttcaggccccgccttcccctgctatggctgccctccttcttggctcttgaaaatggctatgataggtgtattctcttccccaaagagtggggaatgtcaaattacgttattatgtttattgttccagagtgcctgccgagagcagtcatctccaatttggaagagagtctgctgcacctga

SEQ ID NO: 115533 - DNA, 574 bp, Homo sapiens
gggacagacaagaaccctgtctttagctgaactaaggaaagtcctgcaacagcaatagactaaacaaagactattgtgcctagttgaactattttttatgcttcttcaggtaaattgcttatatgtgtaggcaaagtcattgttttgtttgccctcagaaaatctcctgtgttattcccatttagcagaaaaatagaaacagagaagatcgagtttccctgcttaaggcaaagaaggctgttgatatgactattcttgacttttcactggacttttttcaacaagactgtacatcattaggacagggacttagtcacatcatcactcttaaaaacttaaggctgtctctgaccttatgaatcatcttccgcaggggaacattatgtattcagttttggaccacacactatttttgaggcactgatgaaagctctggaccctcctccaagaaaaatgcacatatgcacccaccaaacttggcacttacattcagtggcatcatgaacctccgtccgcagacctcctgggggccgatgccttctggccaagaatccctgatctaatgaattttaaa

SEQ ID NO: 115534 - DNA, 206 bp, Homo sapiens
tggtgtggggaggccccttgctcagatcagcctgtgccttccccaggccccggcccatgcacctgcccttccgtaggtctgagcacctgttcttccacgcccaggacgacctggtcctgagtttggccgggaccccctgctatctgccgtccacaggcctggtgacagagaaagcagtgccctggaacagcagcccggctgtgggg

SEQ ID NO: 115535 - DNA, 125 bp, Homo sapiens
ctcactctttcttttctctttaacattcctctgcacagcattacttgcctcttcacagaaaacctatccaaccctctagaacaagtgcttatcattattttatcaagttccggaaggagcgagac

SEQ ID NO: 115536 - DNA, 598 bp, Homo sapiens
tcagcccagctcctgatttggtcaaggttgtaaacgcctttgtgattgccaggggtcattttacacagagagctacgtgcagcgtcgtagctgagcatctgtgtcgtctgtgttctctgtgaccttgaactcataattattgctcttttgttacctctgttaagcagtattcttggccgggcatggtggctcaagcctctaatcccagcactttgggaagctgaggcgggcggatcacgagttcaggagatcgagaccatcctggctaacatggtgaaagcccgtctctactaaaaatacaaaaaaattagccgggcgtggtgtcgggcgcctatagtcccacctcccaagtagctgggactacaggcacccaccacacctggctaatttttatatttttaatagagacggggtttcaccatgttggtcaggctggtgttgatctcctgactcatgatctgcccgccttggcctcccaaagtgctgggattacaggcgtgagccaccgcacctggcctaaaacagcgttttggggcaggaaatgacaagagaaaaacatggtgaccaggtgagatggtggtcagggaatggcatctgg

SEQ ID NO: 115537 - DNA, 420 bp, Homo sapiens
tttgcataatttatgtcctcccctctcccttggtgtcttggaagagaaggctttgctaccagttagctgactatggaataaatgattcttcctttacttagagccttcttagtcatggccttgtcaaagaagaaagcagcataacaccgctaacaattataataaatagtttagcttggtgagagagaatgtggctttgaatctcgatctctcgatgtctcttacatacacattcatggtactaccagctctgggtactttattacagacatagaagcaagtagccttatttcattgtcacctgagcaacaggaagagagggtgaacatttgttcagtgcctgttatgtggtagatgtcttggttcttgtgttatttcattcacttccccaaacttcctacaagatgggtattattactg

SEQ ID NO: 115538 - DNA, 137 bp, Homo sapiens
aggcccactgtaaccactacttggctaccatataagtttattcaaagccttggtactctgtgattaataggtggcaaagccagccaggtttgtgtctctgcctgtagggtggcaagttcccctagccatgagtcggt

SEQ ID NO: 115539 - DNA, 385 bp, Homo sapiens
ccaagcctactccacacccacctccatcatgaagccccttccatccccatcctaaaccatatttgtcatctgaaactctgaagacactcttcaacaagttccatttctacaaactaaaacttttccctaaccacaaacccattttaactatgtttgattcttttttcagctgaggagaggaaatgactcctctctttggctgtcatcttccactggagttcagtaattctcctagtttctggaagatgaaacgctctacatcttccatgcctgtggtttatatttcaccaagtggtgtcagcgctgacagagtaacctcccatttttattgagccgcacacaatgtaattgatgacatctgctggggctgatattttaagtgaag

SEQ ID NO: 115540 - DNA, 396 bp, Homo sapiens
gcaattaggtttactcacagataaacacagactgcaacaaggttgggtatataggccgcagtgctgtgagctctggaaaaactgtgttcattaaacccttcttggtatagtcccatagaggactcagaataatcatgtagaaacagtcacacaaaacttgcttgtgtatcttttggaaaaatgctgttaaggacaaaaagtctatcttgtcacctctagcaaaaagcatcaaactaatttcccaagatttaagtgccatgaaatactgacatcccctgaggaacggacccgctttctcctcagaatcagtgcacatcatgtaacttaccatgattctctgggtgtgatggtggccaaagattttggacacaagctgacacttaatgtagccaacag

SEQ ID NO: 115541 - DNA, 218 bp, Homo sapiens
tgacagtgaagattttttttggaaagaaaatcatttgacaaagcatattttgacctttgatttagatattaatttgtagaaaaaggcaatatgctatggctaaattaatttgattatgatccttaagagatacattttactttgtgaatgctgtatatacacatataggaaactaaaaagttttatgaaacaatattccaatattttctgttatattt

SEQ ID NO: 115542 - DNA, 328 bp, Homo sapiens
ttacctacttgccttctcgaatgctgtggactgtccaccacctacttccccagactgtagactgccaaatgcctgtttatcttgtatcgcttatctcttggcgtcctccaggaagccttcctgagctccccgaggtggcccccggctcccttccccatgcctccacagcactttgtgcaggtctgcaggacaatgctttccagaccgtcttctaatcattcatgtgtctgcctcacccagtagactgccagttcctcagagcagcgttgtattccacactccccttgagcatagctcctggcacacaggagaccctcagtgcctgctg

SEQ ID NO: 115543 - DNA, 298 bp, Homo sapiens
atacatccggttacaacctctgcccttaagaaaatcaagttgtctatcgtaagtttaaatgtacataaatcagaccagaagaggcaactggcaaacagtccatgaaacagcattctataaagtcttatttccatatacttatcccaaattagtttgttgcccaaattattattttttttttttgagacagtcttgctctgtcacccaggctggagtgcagtggcacgatctccgctcactgcaagctctgcctcccgggggttcacgccatttttctgcctcagcctcctgagtagct

SEQ ID NO: 115544 - DNA, 806 bp, Homo sapiens
gccagcccctaagggccaggctgaggcccatgtttccagggcgaggacccagccaggatggctcagcactctgcaggagtcagacactggctccaggaccctgacactgcaagctgacatctgatgcacctggccacaggtgtgcgacaggtctcaaaacagtggaggttagagacggaaacccttttccacaatgcaaacccagagaaagcagtaactcagggacactgtggattgtcccatctgttctgaaagatggaacaccactgtttcctgtacttcttcaattatcagtaaaccgtttctggtatatagttctaagatttttatccacatgtggactcacgcattcataaccacaatcaggacacgcggcggcttacgtggcccctcacacccgtgctgctgtgcccccagcaccccggggatggctcctcagggatgggccgcgggaaggaatcgcaccgcgcggatcctcccgatctgggcccctcttgcacggaggcccctgggatgcagtcacgtggcagacgtgtcggaagtccacggctcctcactgcccagacactgcccctgcagagatggacatggcgtgctcatctattcacctgtgtccctgccagcagaacagagtcccaggtggccacatcctggccagaaccagtgtcccgaccggcatgtgggcaggtggacatgggtctgcccatgggtttcggcttgcctttctctaattgctaacaacaccaggatagccccagctgccatcctttacaccctctttggcaaactgtctgctcatttctttt

SEQ ID NO: 115545 - DNA, 393 bp, Homo sapiens
cacttccttgcacattacctctcctcagagatgccttcaccacttaattttaaagtagctgcccctaatcttgggcgcttgctatcccatcacccccttgaatttggttgagagtactcagcaatatctgaaaatattttaggtactgtatgtctccttccagagaaaacaattcataagggcagtgacctcttccacattgttaggcctagcacctagcagcaagccggcactcaaaaaacattggtgaataaataaataaaggtcatttacgatacaatctctggcctaggtggttcaggggtttttaaaacaagcagaggaatgcacaacgtgcagagaagaacattctctgcaagataagtatctggaccaaggtgaggtggagaggcc

SEQ ID NO: 115546 - DNA, 274 bp, Homo sapiens
tgtgtgcgcatgtgagtatatttatatgcatgtattgtgcctatgtgtatacgtgtatatgtacatatgtatgcatgtatatgtgtatatgcacaagtatgtctacatgcatttatgtgtacgtgtgtgtgcatgtgggtatatttgtatgcacgcattgtgcctgtgtgcatgtgtgtatgcacatgtttgtgcgcacatgtgtgcctgtgtgcatgtgtgtatgcacgtttgtgcctgtgtgcatgtgtgtatgcatatgtgtgtgcctatg

SEQ ID NO: 115547 - DNA, 871 bp, Homo sapiens
ttctctgtaccttacccacttatacttgcgattgcggccgatcttggtttatttccattgattttttatgtctactttatacagtactacagtgtttttatcactgtagctttatagttaagttttgaagtcagaaattatgagtcctccaattttattcttctttttcaatattgtttggcattttggagctccttgcaattctatatggctttgagggttaactttctcatttcttctaaggcaggtaaagtgctctccggacgtatcatctgctagagtagcacgggctgcctctatagactgccacgactggaatagctaatacagcatgaatgcagaatactgtgtgacggagcttaagtgatacagtaactacaccttagcgtctagaatgcgacaggacaaagcacttgattgtgataacattgatctgtgttcagctcttctggtcgttatagacagtgagtggccaactgttgatggtcgcacaggaaggtgtatacaatttgggggagtgtaaggatcagattttgcacgcttacccctatcgcgactcacaattatgacgtctcatatcggttggtatcttgtattattgccgcctcttatgtctgctctttaaccgaatagtcaaagagaaaagcggaagaagatagtcttagtcgaaccactatcctgccatgagtagtagcagatcgcgcgtttctaaattagtccatccctttatcactatcatttgcgatagcggtggcggccgagtcgggaatctacggccggtgccgcagtttcgggagtataagtgtactgcgaagcttgctgcggtataatgtacgtatcattacttgatccttttaacatctttactact

SEQ ID NO: 115548 - DNA, 274 bp, Homo sapiens
cctgacctcaagtgattttgctttgttgttacagtttataatgacccaggtaatcaaagagtggagatggggtcacttaatcttacacttttggggctgtgttccaggctctgtgctgacaactttttgtgtattatctcatttaattctcaacagccaacctgtgagggaggtgctgttattgttcattttacaaatgagcaaacagaggcatagaaagataaatggctgttcccagggacatttagctggttgatctggaattgaagctcca

SEQ ID NO: 115549 - DNA, 199 bp, Homo sapiens
ctcccgactgttctgtcagctccactgctgtcctgcttgatccaatttccacaccaaaactctaatcatgtcaccctctctgccatcctaaccccactgaaccctctgttggttttctgttgtttgtgagatcatctccatatccgagacctggccctcgtggccctgcatggctggcccacccaacctccatctttgt

SEQ ID NO: 115550 - DNA, 351 bp, Homo sapiens
gctatacatgtgataaaatcgtatagagcaacataaaattaataacaaatacatacacacatacaaatacatgtgtatgtgtatcaacctgaataagctctgtgggttgcagcaatgccagtgacccagttttgttattgccctatagttatataattgggggagggagggcaaagagtgcctgcgacctccctgtacatttctttgcaactttcttattataatttttttcaaaataaaaatacatatacttctctaagaaggataataaacctagaaggaaaaactgaaatgtgagaagtaatggtgagaaaataaattagtaaacatgtttttggaaaacctaaatga

SEQ ID NO: 115551 - DNA, 139 bp, Homo sapiens
agttcaggtggagggcacaggaggtggagacagcagagaagagcttcacagagaacatctaggagggacagctgaagaagcgctttggggccgggcgtggtggctcacgcctgtaatcccaacactttgggaggccgag

SEQ ID NO: 115552 - DNA, 679 bp, Homo sapiens
ggccgacgcgccgagcgcgggtttccgctcggggcgggcgatagagacagcgcgtcgcgcctttagcttctttcccagactccggcccagctcctgcgatctccacagcagcctctgaggccgcccccagagagcatcaggatggctgaggaaaagggtggaaagcaagtcctggaagaatctgcatttgaagaaatggaaagagattttcagggagttctccatgaactttctggagacaaaagtttggaaaaatttcggattgaatatgagaggcttcatgctgtcatgaaaaagtcttatgacaatgaaaagcgtctgatggccaaatgcagagagctaaatgcagagattgtagtgaattctgcgaaggtcgccactgcccttaagctctctcaggatgatcagaccaccattgcatccctaaagaaggaaattgaaaaggcctggaagatggtggactcagcctatgacaaagagcagaaggccaaggagacgattcttgctctgaaagaggaaatagtgaacctgaccaaactagtggagcaggggtctggactgtcaatggaccagcatagcaacatccgagatttactgaggttcaaagaagaagtgacaaaggagagagaccagctcttatcagaagtggtaaaattacgagaatccctagctcagacca

SEQ ID NO: 115553 - DNA, 319 bp, Homo sapiens
cttccttcatgaactgtagagcttcctatggagagcatttgtggtagccacgcaaatcctttagtaaatctttcattctctttattaaccttggaataatttgaaaggtttttgaattgggactatttcttttttttttcaatccactcaacatttattaaattccttaataaatcattggaggaaagcagtgatatttttgagaatattgcaattaattattgaggatgagaagaaatgtttgacttaggatattatagataacttaagggcacttaaactttttttcccctatgtaagaaataagtgccttggaaaa

SEQ ID NO: 115554 - DNA, 826 bp, Homo sapiens
catgtaattctgtgttacttaatttccctacaaacagtattttcttactgcttaatctcagatgttgagagtgatttaacatttataaaatgtgttctttttcttcatgtatgtggctttctgtaatgatagggagaattattcacatacactaagaaaaaattactcacaagctggccatggaaatctgggccccattaggttgactgggagagcagtgattttatgtgtgtgggctcttaataatttctgcttccccaggccagcttcgccttgttcttaaagaaaaaccagtgtgcactcagtggttctttgtttgaccatatctcctgatgtgttgttttatgcttttggaaatatgaactctgaactcttgattttctgtggaataattaaataagctggtctaagtagcatggtctttaagcctatagtaaatgttttattcatacagctcacttttgtatattaatatttttaatgagaaataatactgatgtttttacttttggaaattttgatttcttttgccaaaaaattgtttttttttctttttcaaaaaaggcctacctctttgtggttagaacaactttgaagagcatctttcttagttcatgtgctaaaagttaatgtaatagaagcacaaagactgtaaccgctattactcgactaaaaaaatagtttctaaaagtatgagatgcataagaacaaaatctataattttagttatgcatctgaatgtctgtcaccatgatgacaacttttaaaagaaaataaagacagaactaatgccactttaaaggctcaaattatgaatgtggagata

SEQ ID NO: 115555 - DNA, 453 bp, Homo sapiens
gaccttcctctacacaaacaagtcttgttcccacactgccttccctggtgtcttttcatcatagtcttaacagaatcacctccgataaaagcactgcttctagagaatgtgcccagggaagtgactgttcccccattctccttccccctttccctcatagatacttctgtacccaaatccgtattgcttatgtgacttgcaagcaggtcaaaaagatacctgaattttaaatactctgtgggggccagaccatctgatccctgcagccatttctatgatcccctggctgatccttttctatggagggaacttctcctcacctaacccatgctagattgctttctttcagtaccagagtctctgagaaaaggaaaaggcattctgacttgcagttagaatgttgcactgggagtctggactgggcatggtagagctggtccagacaaaggcaag

SEQ ID NO: 115556 - DNA, 416 bp, Homo sapiens
atgagactcagggccaagaaattggtaaggaagacaaaataacatgaacaaacatgcacaatgataggtttcagagcagattatgaaagtcattgtgagtcatcggtggtagtactgttgtttaaaaagaaacagtgtctgccaggcgcagtggctcatgcctgtaatcccagcactttgggaggctgagacgggcggatcacgagttcaggcgatcgagaccatcctggctaacacggtgaaaccctgtctctactaaaaatacaaaaaattagccagcctggtggcgggcgcctgtagtcccagctactcagaaggctgaggcaggaaaatggcgtgaacccgggaggcggagcttgcagtgagccgagatcacgccactgcactccagcctgggccacagagcaagactgtct

SEQ ID NO: 115557 - DNA, 288 bp, Homo sapiens
tatgtagaaatatgttttcttacatctgtctgtctttcttgcacaatcctcaggtccagacctggtttattatctctgtttcctgatagcacagtgcctataacacagtgggtgccaactaatgtatgaaatagaggccgggcacgttggctcacgcctataatcccagcattttgggaggccgaggcggtggatcacgaggtcaggagatggagaccatcctggctaacacagtgaaaccccatctctactaaaaaatacaaaaatttagccgggcgtggtggtggg

SEQ ID NO: 115558 - DNA, 222 bp, Homo sapiens
gagaattgcttgaacccgggagacagaggttgtggtgagccgagatggtgccgttgcactccagcctggacaacaagagcgaaactctgtctcaacttgagttgtagagcctggactagagccagcctcatgttccctttaccacttgcccttggagggagagatgcacaggttaagagcatcttattccgtcttttctttcttttctgggccagcaccctt

SEQ ID NO: 115559 - DNA, 335 bp, Homo sapiens
taagtgctatataaaagtgttagctattatatactaggcacatgctaagaactttacattcaatttctctaattttcagcaaaagatcctacagggaagtaggtgctatccccattttacagaaatgaggaaagagaggctgggcacagtggctcacgcctgtaatcccagcacttcgggaggccgaggcgggcagatcacaaggtcaggagttcgagaccagcctgaccaacatggtgaaaccccgtctctactaaaaatacaaaaattagccaggcatggtggcacccacctatagtcccagctactagggaggctaaggcaggagaatcact

SEQ ID NO: 115560 - DNA, 691 bp, Homo sapiens
agcatgtttttcctcctccaggagacattcctccgcggatcagaccatgctccttccacattgaaagcctgtgctcacactttgaatatgttgactgaaagaccttcatgagccggacacgctccttggtgttacacttgcaggagttgccgatggaggcctgcagtactctcggagttgttggcagctttaaaggtagggtccagaagagtcatatatatttttataatctatggattataaaattgataacaagataatgtcctaggaattataagcaccccaaaggtggggtttttttagaaacccaattgtttagaaaaaaaaaagttctttctttttgtgaataggatataagaatttaatgaatcttatatcctatatctttgaaaatgttctcaaaacttgattcccaggtaggactacacaaacagtggtagagagaattgcatattgccatttgataacaatatcataaaacaatcctgtctctgaaattttgtcacagtggccttataaacctatcagtggcagtagatggatcaaaaaacaaaataaaaaggtgtgcaattgacaatgtttgtgcccccaaccccaaatccatacatcaagcccttaatcccaatgtgttgatatttgcacagtgtatcctttgaaaggtaatcaggtcatgaaggtggagcatgtgtgc

SEQ ID NO: 115561 - DNA, 222 bp, Homo sapiens
aaaaagtctgtaatcaccttgatctggcacttctaggagtttatcctaaagccatggttctcaaccaggggggattttgcaccccatccaccccagggaggacatttggcaacatccgaagatagttttgattgtcagagctggggagctgctactgtcctctagtgggttgaggccagggatgctgctgaacgtcctatggtgcacaggacaatccttaca

SEQ ID NO: 115562 - DNA, 455 bp, Homo sapiens
agacatctgagatcattcttggacgaatgaagagaggatttcaacaggtggagcaggaaggggaaagcacaggattccaggaggagggaaaaacataggcattgatgtgtgttgactagtatttctgtcatctcaggaatttgcccttagtaagaatcctcaagtgccttaaagttaggaccttaggaaattgtgttctctttcaggctagccaaggctaattaacatttttggggtccagtgatttcttataatgtttcctggttccataatgtatacaaaattgaggtattaaattattaaatgatgataaaacactatgctgctttaggggaaggagtacagatgtctgcaattcacttcgaaaggcatccaggaaataaggtgatagaaggatggatagagggatagttagaaaataaacaagtttaataaaatattaacagtagaatcca

SEQ ID NO: 115563 - DNA, 402 bp, Homo sapiens
ttgtgtttttagtagagccggatcacctgaggtcaggagctggtcttgaactcctggcttcaagtgatctgtccatctcagcctcccaaagacctgggatcacagacatgagccaccacgcccggcacaaaatttaaaaatttaaaggtcattatgcttctggtatcatcttggcaacagctttcagaaagtctacacaagttgtgttcacagattctgccttggtttgtgtgttgcttgacccctacaaagaaatcctaaaaatcatttgggcgtctcctccttatggagccagtgttgcttttcattcagtggctggtgcttccttaaatattagtcattctgagattatgcaaatatctgtgccttccagccacgtaccccaaacgaaattcagcccaa

SEQ ID NO: 115564 - DNA, 426 bp, Homo sapiens
tgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagt

SEQ ID NO: 115565 - DNA, 869 bp, Homo sapiens
tgtctgtaaggtcataatgagcaaacttaaatgggaaacattaatttggcagctgacaacataaaataaatctagctgccattagcaaggacccttcttaaaatttttataaaagcacagctttcaagtttattgcacatctctttaaaaatgtatttcaaagtaacttcagagacatctatttggcacactcaaacttttggtgatgaaattcccttttgccactaaaattcattatttgaatctccatggtaaattagctttatgagttagctattgtaattatttttctgtgaagcaaaggcaggagtagagacaatttcatcatcttatcatcatttgtatgtggaatcactaaagagtttacccatgtggaaccatgaaagtccctgatttacccctctatcagtaggcataaacatatctaaaccacccaagaaactgtacattaatattgcttctaagacctgggggttggggggtagcatccccacagtcaacaatgttaaagtgatgaaacattttaaataattttaatgttaaaataattggagccatttcttgtttgattattttcacactattggtccttaaactgtttaaatttggttcagaaagtacagagcgggccgggtgtggagggtcacacctgtaatcccagcactttggaaggccgaggagggtggatcacctgatgttcagagttcaaaaccagcctggccaacatggtgaaacctcatctctactaaaaatacaaaattagccaggtatggtggtgcatgcctggaatcccagctacttgggaggctgaggcaggagaatcacttgaacctgggaggctgaggtttcagtgagccaagatcactcca

SEQ ID NO: 115566 - DNA, 261 bp, Homo sapiens
aagctatgcatttactctcacaacatcagtcaactcacatgcacaaggagaagcgtctctcaatcggagcttagagccaaaaattacaaatggcagagacttgagctatccataagataattttaaaaatccttccactctacactcccccttctctccgaccccgctcctatagcatacattttggttccactggttgccggcttatccatttggcggtaactgtctggtaggttaatgcccaacaataggcacttgtat

SEQ ID NO: 115567 - DNA, 424 bp, Homo sapiens
agagtgaaatttcctctccaacaaaaaaatgtgaagggaatgaatgtccttttatttctttggcagggaggagataatgaatcagatagttgtaatgctgaactgaaatcttcatttccacagtaaattttttcattcttgtccaaggcccaaggatgtgaccttctcttggattttcctgattattatgagaggcaagtcgttagtgttgcagtgtgactgtgagtataagccctgaactcctgtgcacttagagtccctgctctgtcatttgcttgaattacttatctcttctaggctttagttttcttatctgtaaaatggaaatcatggtcgtaatcatttgagtgtttcctggcaccaagcattgtgctatatgttttacaagcattatctcactttaccttctcagtacccctattca

SEQ ID NO: 115568 - DNA, 525 bp, Homo sapiens
cacatacaccaatgtgtatataaatagaactttaaaaatggaaagggatcatactccttagtgtgctgttaaatgtttaacaaatggctggcagggaggggccatcctgatttgtagcatttgccaatttctgtggtgtaaacactcccaccatggctggtttcaaagtatcaacatgatgtcaaccagcttgcaaacttcctgaaattttaacaatcagctcttgggaaacatcgagagccaactccagcaggctgccaactacattttgttttctaattagcctttcttcctcacgctatagtacaaacgtcttcatgcctaaacttttcaaaagttgtctttctcaaattacttatttgagtcaaaattgttttcctttgggaatctggaaccgattgtaaatactgtcctctagttagaatttgcctgtttctcatgttccatagatccttgtctgagtggggagtggatccacacttttttattaggtggctggaatagagatgtaattgaaaaaaaaaa

SEQ ID NO: 115569 - DNA, 343 bp, Homo sapiens
tcccaaagtgctgggattacaggtgtgagccactgcgctcggccgactatttttcttttctcttaaactttatgtaatatgtagagatgagatgtcactgtgttgcctatgctgttctggagctactgagctcaactgatccaacccccttggcctcccaaagcgctgggattgcagaagtcagcctgcttcgttcctttggaaggctgagtcatatttcattacaagcacttttttttgttttttgttttttgttgttttgagatagagtctggctctgtcacccaggctggagtgcagtggcgcaatctcagctcactgcaacctccgcctcccaggttca

SEQ ID NO: 115570 - DNA, 441 bp, Homo sapiens
tattcaaggagagggcacatagatacccacttctcattaaaggagcattgatgtcacattgtaagaggaacatgtgagatggcttatattactggggccatctttggacaatccagttggttacacctgccattgggcctaattgttaggggtttctaagggattctagattaacctagagctttttcccctgtatttttctatatctagtttctgagaataatgaaatgtattcccattaaggactatcttacccatttttatcctagaattcatctcctctgggggtaaaccctgtggtaaacatagatgatcaatattctaaaggtcatgtaattcaaccagacaccccttgggataattttctccatgaccccaccactctgaagtgctcattcagcctattcttggatacttgtaataggagacagagatgtgaag

SEQ ID NO: 115571 - DNA, 542 bp, Homo sapiens
gtgtgtgtgtgtgtgcacgcatgtgcatgccaaagtgtgaacctgtgttcctgagcccaagatgaatgactctggagtaaccgttgtttgatattagctgtacttcctctagctgcccagacagctaagagttattgtccctttgtggcagctcactcccaaggtcctggccttctggcagctggtttggggacttgagtagtagggggagtaaaaccatagtggttgtcgtaggagcagcctgcagtttaccttctcggactctaggaaaaggatttgctgagcaaattagaatgaaaatacatattcatgaggaaatgtgcatctgggtcatgaacgcatagttatcacaaggcagggatgttatttgtttgggatcaaatattaatatgctaatttgaacagttcttatctctgtgaaagcaggtaatgtaagtatctctagtaggtaatactttcttgcctagttccagttaccatggcaatcagtcagctagggtggtgcccaccacatgcatgcacccgtaagatcctctagagcg

SEQ ID NO: 115572 - DNA, 363 bp, Homo sapiens
gtgtgtgtgtgtgtgcacgcatgtgcatgccaaagtgtgaacctgtgttcctgagcccaagatgaatgactctggagtaaccgttgtttgatattagctgtacttcctctagctgcccagacagctaagagttattgtccctttgtggcagctcactcccaaggtcctggccttctggcagctggtttggggacttgagtagtagggggagtaaaaccatagtggttgtcgtaggagcagcctgcagtttaccttctcggactctaggaaaaggatttgctgagcaaattagaatgaaaatacatattcatgaggaaatgtgcatctgggtcatgaatccttttcctgcagtttaccttctcg

SEQ ID NO: 115573 - DNA, 423 bp, Homo sapiens
ggtcttctccatattttaacaaggcttaactcataatgagtggtattatataaactattagaatagccaaaaatatactttcttgtgggcctaaaaaatgtctaataagatgagcaaagctgttatttttaccttattaaaaaaccaatgtgaaccaaataattgaaaatatgagatataagttaacttttaaatttccctgttgcatcatttcagaagtttttgttctgaaaacaaaaactttttacacaaatttcgttttttttgtttgtttgtttgttttttgagatggagtctcactctgtcgcccaggctggagcacagtggtacgatcttgactcactgcaacctccacctcctaggttcaagcaattctcctgtctcagcctcctgactagctaggactacaggtacataccacca

SEQ ID NO: 115574 - DNA, 277 bp, Homo sapiens
acaaagtctctcccatcttaaacaaatttcctttcatccctgcttctccatcaagtgacggttccaagtctcattagcaaaagctggggctgagcgcctaccacctgtcaggccctgggcttggtgcttgctgtgcccatctcatttaaccctggtgatgaccctattgggtaggcaccatggatacgatgaggtagctgaaacttgaagacaccagcgtccttgcccaaggtcacagggtggcagacccaacattccaacccaggactatctcctc

SEQ ID NO: 115575 - DNA, 560 bp, Homo sapiens
ccatgatcatgccactgccctccagcctggggaacagagtgagcctctgtctcaaaaaaaataaaaataaaataaaaaacagaaaaggagaggagccaagagtgagagcagtgcctggctgcagggctgaggctcatttgaatggtgtctctctctctctctctctctctctctctctctctcacacacacacacacacacacacacaaatacacacatacacatacacgagaacagcaggttctacaagcacaagcatcagggtctaactcctggcggctgatgcagctgaaaataatcaggccttgggatgtcccatgggcagtgggagccccgtagacacatagagcccagagcacacatgtggctcatgcagccacacacgcacacacacacgcacacatgcacttagaatcacacttcagtgctctcagctctgccttggggtccctggggtccaaacgcagaatgtggagtgcagtgcttcctacagcctggccgaggctcctgcggacaggcaggtgactgtcaagccccgcctcctccgtgcctcctcctcc

SEQ ID NO: 115576 - DNA, 569 bp, Homo sapiens
gacagagcaacactctatctcaaaaacgaaacaaactaaacaaaacaaaaaaaaaacctttgggctatagtgcaaaaacaaatctgtatatctcgaattgtgtaactggtacgtacctggacaggaacaacttctgaatcatactggtttgtttggatcatcttggattgttgctgagtgaccctgaggaagtattgccgtctactgttcggggttgctaggaagaaaccagtcctctctataccagggaagaagagtagctgatgtgagacagtgggatagtaataagctaaacgagggggagagaaagagatttaaatgacagtcccaggcaaggctgtcatcatgggatgtaagtgagactgttaagctcctgagtcatagaactttacagctgggaagttatataaatattcatatatatgtcagtttccacttctgtggccctgacaagatgcctcagggcctgcagcttggggatccaggctgtaggagttgaagactgttcctttagggcatagccaacaggatgaatttcagccttttaatcattctgtttgagattcaga

SEQ ID NO: 115577 - DNA, 654 bp, Homo sapiens
aaaaacatttgtatacatttgaggttaaacgtacacattaccgacttctttctcccagcacacaggacatcagctcttaggaagaaggtggataagaatttcttcctcaacctcccttatactttcaacttttcatggcttattgggtataaaagatcattgttttgaaagtgcttatgtgagaaatacttccatgcaagtagaaaaaagcgcatgtatttcctcgtattgaagcattaggaatagtttattttattttgcaaaccccaaatccatttgtttaatttggcaatattcgtcttttggccatgtttaattttctttttccaacattttgaaagatccaactctatccattttttagggcagaaatattcaattgcttctttttttttagttcagaaaaaaatatataatgttaagtatgactgtgaagaattaacttgtgtttgaattgatattttgctggagctttaagtaacagtttaaactttattgtcgggagtagacacaataaatatcatcttttcacacccaggagattcggggccagctatatctttctcagttcttatttcattgtccatataattgaataaaatatctaatgtaatattaaggtcacagatttaaaaatacagaacttggggaatg

SEQ ID NO: 115578 - DNA, 352 bp, Homo sapiens
tgatttcttaaattttccaaaaaggtattattgcaaacatataggatttccccccattttaaccttaccagtttcaaaggaaagtaaaggtactggattacatgaagacagcatgtgtgcgagtgcacacgcatgcagggtggcaggtagagtgtcttaattcctttttcttactacccaagtctcacttcacagaaatcattaggtaaaggaaaaccaacgaggagttctgcagttttcttttaataactgaggctgaggcaggagaatcgcttcaaccctggaggtggaggttgcagtgagccaagattgtgccactgcattccagcctgagcgatagagtgagactcca

SEQ ID NO: 115579 - DNA, 341 bp, Homo sapiens
tttagactcaaacttctagaacactgttctgacccagctgagctattgaagatagttttcacggcactgctatccttgattgacctcctaagggatctgtctctcttgagaataggcctcaactctaatttccttgggcccaagaccaagagtgggcaaggggagcctagcctgcaccttgccacctggtgttggccattatcagggtgccaggagctgaagtggcacatgttagtgtctacagagtgccacgtgggtagtgctaggtcttccaggaggctcagccactgatgactttaaggcatgcaggtctccagcatggctgcaggaaaactaagaga

SEQ ID NO: 115580 - DNA, 3655 bp, Homo sapiens
  misc_feature (673)..(673): n is a, c, g, or t
  misc_feature (850)..(850): n is a, c, g, or t
  misc_feature (1102)..(1102): n is a, c, g, or t
  misc_feature (1167)..(1168): n is a, c, g, or t
  misc_feature (1294)..(1294): n is a, c, g, or t
  misc_feature (1297)..(1298): n is a, c, g, or t
  misc_feature (3362)..(3362): n is a, c, g, or t
cacattttagtagcattcacttataatccaagacattttggcaatcccctccctccgtttttcccattttcattgtacatagagcctatatgaggcattacagaggatactaaaatgaacgaaaatcataaaccctgcagtcaagaatctttcagtctaatgaagttatgagtaaagatgaatacaatgaggaatagtaaataactttgagataaagaaactaaagtatatcataagactgatgcaacttgacacagaattgtgattatttttgatgtctccagttttgatagtcaaaggagacactatcaatagatattgcaagggcaacaggcataaactaatattatcttggacaatttgatatatagagtcaccctactcttaagtttctttacttttgcttttactttttattatggacattccatactgcctgtaaagactgagataactatttaagtacccatcttccaacttcaactattatcaccacgtggccaatgttgtctcctctataccccctaaatccccaccctcatttactaaaagcaaatccaaagcattttcttgattcatcaaccagtttttcactacttcattctttttctctcctgattccttacttatcacctttccaacccatctttttatttttacttccagcactgcngttctgatctaactctgccaggacacagatccacagggtcagccctgcatcctgagcagcttagagggagaagccagaccagcagtgcctcacaccttgtcctcttctgctctggacagatggctccataacgacagcttcataatggcagtggatgggaccctcgtgtacatcagngtcactcttctgctgctctggcttggggtatttttgtctatttccggctactgtcaggctgggccctcccagcatttcacttccccggaagtggtgatccccttgaaggtgatcagcaggggcagaagtgcaaaggctcctggatggctctcctatagtctgcggtttgggggccagaaacacgttgttcatatgagggtcaagaagctcttagtttctagacacctcccagtgttcacctacacagatgancgtgcactcctggaggatcagctcttcatcccagatgactgttactatcatggttacgtggaggnngcccctgagtctctggttgtgttcagtgcttgttttgggggctttcgaggagtattaaaaataagtggcctcacttatgaaattgaacccatcaggcactctgccacatttgaacacctggtttanaanntaaacagtaatgagacacaattcccagctatgagatgtggcttaacagagaaggaagtagcacgccaacagttggaatttgaagaggctgagaactcagctctggaaccaaaatctgctggtgactggtggactcatgcatggtttctggagctagttgttgtggtgaaccatgatttcttcatttactctcaaagcaacatctcaaaggtgcaagaggatgtatttcttgttgtcaacatagtggattccatgtataagcagttaggtacttacataattttgattggaattgaaatttggaatcaaggaaatgttttcccaatgacaagcatagaacaggtcctgaacgatttctctcaatggaaacaaatcagtctttcccagctacagcatgatgctgcacatatgttcataaaaaattcacttataagtatacttggcctagcctatgttgcaggaatatgtcgtccacctattgattgtggagttgataattttcaaggagatacctggtctctttttgccaacactgtggcccatgagttaggtcatacgttgggtatgcagcatgatgaagaattctgtttttgtggggaaagaggttgcatcatgaatacttttagagtgccagcagagaaattcaccaattgcagttacgctgattttatgaagaccaccttaaaccagggatcatgtctgcataatcctccaagattgggggaaatctttatgctaaagcgctgtgggaatggtgtggttgaaagagaagagcagtgtgactgtggatccgtacagcagtgtgaacaagacgcctgttgtctgttgaactgcactctaaggcctggggctgcctgtgcttttgggctttgttgcaaagactgcaagttcatgccatcaggggaactctgtagacaagaggtcaatgaatgtgaccttccagaatggtgcaatggaacatctcatcagtgtccagaagatagatatgtgcaggacgggatcccctgtagtgacagtgcctactgctatcaaaagaggtgtaataaccatgaccagcattgcagggagatttttggtaaagatgcaaaaagtgcatctcagaattgctataaagaaatcaactctcagggaaaccgttttggtcactgtggtataaatggcacaacatacctaaaatgtcatatctctgatgtcttttgtgggagagttcaatgtgagaatgtgagagacattcctcttctccaagatcattttactttgcagcacactcatatcaatggtgtcacctgctggggtattgactatcatttaaggatgaacatatctgacattggtgaagtgaaagatggtactgtgtgtggcccaggaaagatctgcatccataagaagtgtgtcagtctgtctgtcttgtcacatgtctgccttcctgagacctgcaatatgaaggggatctgcaataacaaacatcactgccactgtggctatgggtggtccccaccctactgccagcacagaggctatgggggcagtattgacagtggcccagcatctgcaaagagaggagtttttttgccgctgattgtgattccttctttgtctgttttgactttcctgtttactgtcgggcttcttatgtatctacgacaatgttctggtcccaaagaaactaaggctcattcatcaggttaagaaaatgtctctaacttaatattccatgcattagtacactttagtctcttggcagtagaaacattagtacatccctgaaactgagcacatttctgaccatttccagaaagctgcaaagatcttcccttacattagtaccacaaacattgtcattaagttcaagttattcttaacatgtttctatctattgtttattgttttaagcagcaaataaagctacatccttccctccctttagtccttgttgtgtttcttgtgcatagagatgacttatgggaaatgtatgagatgtttctgcctcagagtgtccaggggtgaggcttacctctctactgacatttatcaatgtgggaaaattacttaaattttctgatgntctgcttcaaaatctgaaaaggggtagggttcataataatatttgtcccacccaacttcttggttttatttggtaaccaaaagagagaaataagtgaatttttgttaagtataaacagattgttatctgatgaaatctcctgatcttgctccctgtgtgcttcctagctctttgtcttaatttggcagtttggatatccttttggagcatttgcttgcttcacataccaaaatataatctccatgagggtggggttgttttcatctgttttgctcatcattgtatccttgata

SEQ ID NO: 115581 - DNA, 398 bp, Homo sapiens
cccgtggacctcgcctgcgtcctgcatgtttgagcgctgccccttgtggaggccgccagcactggtggctgcagggcctgtagtgtggcacgtccagagacccggcctggagaacgggtcctggatgtctccgtcatgttttacgttcgcttcacacggacgcagcgatgtctcagatacctcggatcacacagagcacgtcgccaaggcttgttttgtctgttcctttccacctgtcttacgtggataccaggagatccgccacgactcccgtggccccgtccacactgcgcggcgctctccggcgtggccgccaggtgccccttcgagggcaggtgtgagtacagggtggtccctgtggagaagcgcctgcaggcgagtgagccaggctgtgccct

SEQ ID NO: 115582 - DNA, 422 bp, Homo sapiens
taaaagacagggagaaagaaaaacaaacaacaataatcgtggagtagtgatattgacagactgaactaagaaacagtgtggataagaaactttatgctctacagtactgcagtcagcagaataatggtccctctaaaaaaggtaccacaactctatctcttattagtagtgtgatttggggcaatttaaaagccctgatcctcagtttcctcatctgtaaaagaaaaaaaaaaaagaatagcaatgtcttaagtcaggatccccaggatcaaaccctgagatgaagattgtctgcaagtgatttattatagaaatgctaccaagaaaaactcatcaggtaccacagtaagcaagatagggaagaaggtggtttcaggcaaaatattaacatcaatataattctataggggagcctcagggtg

SEQ ID NO: 115583 - DNA, 701 bp, Homo sapiens
gggacagaacttggccacagttcacaggatgaacaatttccattctctggtgaagagcaaagacttagggaagtgggttcaaaagaggctcctggtagcttgggattgctgcagcgtgcctggctctgaactcagggaaacacataacttttgctgacttactagaagggatgttacaaaggatgcagatgaagagatggatggggagaggcttgggaaaaggggagcaccaccctccgggaaaaccatgtgttcatcagctatctggaagctctccaaatcccatcaattttgggggttttaatggaggtttcatgatgtaggtgcgattaactacatcactgggcactggtgaccaacttaaccttcagcccctcccagttcccgaggctggggggtggggcagaaagtcccaaccctattactatgctttggtctttctgtggaccagccccatcctgaagttaccagacaacaaacagtagcatataaaaagacacttaacctcttcgaagattccaaggattttaggagttgtatgccaggagatggcaattaagaccaaatgtatgtttcataatatcaagcatcttatcctccaacaaaatactcctttgcctgtcctgtagtttacctaggcttgggaacatctttcgatcatttctctaattcattgtctcttaagctcaatgtgcaccaga

SEQ ID NO: 115584 - DNA, 1572 bp, Homo sapiens
cacatataaaataagagttatgttcagaaaatcaaccagacataagttttgtgtgcatttttttcataagtaattgctacctatggaactctatgagactaagaggattgtaactagtgaaaggaaaagaaagagaaacagctgaaaaccttgtgtcaacatgtattcctaggttattttgagggtcctagcccagagttcaaaattgcttaaggtctactgttttatcttaaattaatgtgggttttacatcccacactgcaaaatgtttttgtttgtttgtttcagatagggtctccctctgtcacccaggctgcagtgcagtggcccaatctcggctgactgcctcccaggttcaggcaattctcctgcatcagcctcctgagtagctgggattataagcgcctgcggccacgcccacctaatttttgtatttttagtagagatggagtttcaccatgttggctaagctggactcaaactcctagcctcaagtgatctgtccacctcggcctcccaaagtgctgggaatacaggcgggagccactgtatccggtctttattttttaatattagtactttttaaacatttttttttaagtcaagatctccctatgttgcccatgctggcctcaaacacttgggctcaagcgatcctcccaggtagctaggaatacaggcatgtgctgctgcgccctacttgaatgcattttaaatgaccgtaaaatcgttcaccaattttctacctgtcttagtgattagtgggtaagatgtatagattgcatcgggtgtatcaattttagtaaattaggctcagtgggagagaactgaaccagagtaaaacgttcagcatctgtttcttttctattaaccaggatactgagagcccaaactcacagaaatatatgcgtacaaatggcaacatataaaaaaaaacttatttaccagattgtgttaagatcagtattaaagaatatccagaattctactaaagatgtggaataatgtatcattttgaggcctttattgatccaagactcacctattttcattgaattaacttggatgtttcacagacacatcaaactcaatatattcaaatctaacctaagataccactaactgaattttccttatctcccgttccctgcctgttccttttcccctcccaaatttatgttccttcttaaaacccttcagaagtatctaattgttgtaaggatctgttcctaaatctttacacagtttacaaagccctgcacaatttggccatcttttttctcctcatatattgccattttctgcctcaaacactaaggagccttttaaaacttcttccagccctcttttatttgtggtctttttactctaagcgtggttttaaaatacttaagagcactattaaccccatcattaacaacaggtataaaaccagttggtattgaaatgcaggatgtaaataaatgtagaaaagataaacattgagaatagtattcatatgctaaatttgcatatgtagatgaaatgttcaacagtagaaatgactctgaacaacagaatgaataatgaaat

SEQ ID NO: 115585 - DNA, 922 bp, Homo sapiens
tcaagaagcatcctgagttgctgggactacagatgcatgccatgccaccatgcccagataatttttaatttttatttttttgtagagacagggtcatgccacgttgcccaggccagtcttaaactcctggtctcaagcagtcctcccacctccgtctcccaaagtgctgggattacagacgtgagccactgtggcctggccatctgtttcttttctattaaccaggatactgagagcccaaactcacagaaatatatgcgtacaaatggcaacatataaaaaaaaacttatttaccagattgtgttaagatcagtattaaagaatatccagaattctactaaagatgtggaataatgtatcattttgaggcctttattgatccaagactcacctattttcattgaattaacttggatgtttcacagacacatcaaactcaatatattcaaatctaacctaagataccactaactgaattttccttatctcccgttccctgcctgttccttttcccctcccaaatttatgttccttcttaaaacccttcagaagtatctaattgttgtaaggatctgttcctaaatctttacacagtttacaaagccctgcacaatttggccatcttttttctcctcatatattgccattttctgcctcaaacactaaggagccttttaaaacttcttccagccctcttttatttgtggtctttttactctaagcgtggttttaaaatacttaagagcactattaaccccatcattaacaacaggtataaaaccagttggtattgaaatgcaggatgtaaataaatgtagaaaagataaacattgagaatagtattcatatgctaaatttgcatatgtagatgaaatgttcaacagtagaaatgactctgaacaacagaatgaataatgaaat

SEQ ID NO: 115586 - DNA, 1083 bp, Homo sapiens
ctaaggtgaggaggagacagaatcagaggtcaagacagtgtgagattcataaggatatacacacagatcaatggaatccaaaaacagatgcagaaaggcaatccaatggagaaagaaaggtcctttcaacaggatacaaaaagcactaaccagaaaagaaaaatcaatacactggactttatcaaaattaaacctctgctcttggaaagactaggagtaaatatttgccaaacaaaaatctgagaaaggacttgtatccagaatacataaagaacttttacaattcgataataagatggcccaataaaaaagtggggaaagattttaatagacactacaacaaaaaataaacatacagctaaaatacatagaaagttgttcgacatgcggctgggcgcggtggctcacgcctgtaataccagcactttgggaaagaagaaagatactccacatgcaaatcaaaagcccaatgacataccactacatgcctaccagagtggttacagctgaaggccgaccatagtaagtactgtccaagatgtcaccctgtcacacacggctggggactggtgaagtgttacaaccacttgggaaaccagcatggtggttccttataaagttatcccagaggaatgaaaacttacatccacaaaaaagactgcaaagatgttcatggcagctttattactaacagctccaaactggaaacaacccaaatattcctcgacgtgggaacagataaacacactgagatatataaagatagaataatactcagcaatgaaaaggaaatgaactgctgatgccgacgacatgggtaaattgagagaagccagacacaaaagagcccctactgtgtgatgatgacatgtacacggaattctagaacaggcagaaccgactgatagtgacagaaggcatcagtggttgactggggccggggttagatattgtgggggttgactgcaagggtaagaaggtttttgtttttttgtttgtttttttttcttttttttgagatggagtctcactttgtcacccagggtgaaaccttatctcaaaaacaaaccaaaaaaacccaga

SEQ ID NO: 115587 - DNA, 777 bp, Homo sapiens
gtccaataagtgtatagacccatgtaaccacaatcccagttaagatttagaactctgttgtcacctcaaaagcaccttcttaggctgggcgcggtggctcacgcctgtaataccagcactttgggaaagaagaaagatactccacatgcaaatcaaaagcccaatgacataccactacatgcctaccagagtggttacagctgaaggccgaccatagtaagtactgtccaagatgtcaccctgtcacacacggctggggactggtgaagtgttacaaccacttgggaaaccagcatggtggttccttataaagttatcccagaggaatgaaaacttacatccacaaaaaagactgcaaagatgttcatggcagctttattactaacagctccaaactggaaacaacccaaatattcctcgacgtgggaacagataaacacactgagatatataaagatagaataatactcagcaatgaaaaggaaatgaactgctgatgccgacgacatgggtaaattgagagaagccagacacaaaagagcccctactgtgtgatgatgacatgtacacggaattctagaacaggcagaaccgactgatagtgacagaaggcatcagtggttgactggggccggggttagatattgtgggggttgactgcaagggtaagaaggtttttgtttttttgtttgtttttttttcttttttttgagatggagtctcactttgtcacccagggtgaaaccttatctcaaaaacaaaccaaaaaaacccaga

SEQ ID NO: 115588 - DNA, 756 bp, Homo sapiens
attgtacattgcaaatacacacagtacctcatttgtcagtgatgcctcaataaagctgtaaaaaagaacccttcaattataagggaaaaaagtgcgagcttggtggctcacgcctgtaatcccagcactttgggaggctgaggcaggaggatcacacttttttcccttataattgaagggttctgttaacttctttgattgtgctagtttctcgggtctatacacatgtcagaacctattacattgtacattgcaaatacacacagtacctcatttgtcagtgatgcctcaataaagctgtaaaaaagaacccttcaattataagggaaaaaagtgcgagcttggtggctcacgcctgtaatcccagcactttgggaggctgaggcaggaggatcactggagcccaggagttggtgatcagcctgcacaacatagtgagactctgtctctacaaaaaaaaatttaaaaattagccgggggtggtgactcgtgcctgtaggcccaggcactctggaggttgagtggggaaaatcacttcagcccaggaggttgaggctgcagtgagctaagattgggccactgcacttcagcctgggcggaacagtgagaccctgtctcaaataaataaataaaataagaataaagtagaaaaaaactccacaccaaattgggcaaaagaagctgggcatggtgactcacatctgtagtcctagctactctggagaccaaggcaggaggatcacttgagcccattag

SEQ ID NO: 115589 - DNA, 641 bp, Homo sapiens
ggaaaggcaggtagggtggggtgggcaggagggattttgaaggggcaaggggacatgagtgatgagtctgttaacttctttgattgtgctagtttctcgggtctatacacatgtcagaacctattacattgtacattgcaaatacacacagtacctcatttgtcagtgatgcctcaataaagctgtaaaaaagaacccttcaattataagggaaaaaagtgcgagcttggtggctcacgcctgtaatcccagcactttgggaggctgaggcaggaggatcactggagcccaggagttggtgatcagcctgcacaacatagtgagactctgtctctacaaaaaaaaatttaaaaattagccgggggtggtgactcgtgcctgtaggcccaggcactctggaggttgagtggggaaaatcacttcagcccaggaggttgaggctgcagtgagctaagattgggccactgcacttcagcctgggcggaacagtgagaccctgtctcaaataaataaataaaataagaataaagtagaaaaaaactccacaccaaattgggcaaaagaagctgggcatggtgactcacatctgtagtcctagctactctggagaccaaggcaggaggatcacttgagcccattag

SEQ ID NO: 115590 - DNA, 727 bp, Homo sapiens
caactagttagggctttatgaagacaaaacttaaaggaccatggcgccaaacaaagccacaaagacggcttgaaaatgctgtctcgagaagtcaagtctaccatggcatttgatttattacttttgtagttgattttacttatttttaatatattggcaggtgtgcctactctgggaagtattcatctttaaagaatattagttctctgttcatttattttggtttttaatttatttgcttttttgaatctcagcataaccaggttgaatctcttttcaaaaatattattaaaaggtagcaatttttaaaaaattgagaataatttgtttgaaatgtactggcatttatatgccttgttaatgcatttctgaaatcaagactttgctgaaatgtttatacgttgaataaccgtatcagacatttagtggaagtatagttttacaattttgtatagaatttcatttccagataggttttagtatgcaaaatataagcctatggaggattacttctatgaaatgttacttctatgtgcatatgtataaaaaattcagaaattgttttaatcctatatgtatgttgtattttctaagatgtatgttcttgttgatgattaatgtatattgttatttcaaggtacaaagaatttatttatggtttaaggttttaaaaagttaaattattttaatataatagcattttataaatttattttctcctatgaag

SEQ ID NO: 115591 - DNA, 296 bp, Homo sapiens
ctcctgctaatctgtagtactaaagtcacttaccttaagggcacacatacatgtagatgatgctctcatacgatgtttattgtgcagctactactctatgccacgtgttttgctgcccacaggaaatacagagataaaagacaaagactttgccctggagaagctcatggtccaatagaggagaaagacaagtaaaccaaaaactactctacaataccataaactgctatgacagagattgggtactgcagtgataaaaggacaaaggggtacctaatttggggcaggaaattggg

SEQ ID NO: 115592 - DNA, 533 bp, Homo sapiens
caagtgacatgattgaggtctgcacactagtgatgggggctggcacttcatctcataacattgaaagaaaaagcatttcccccctcagtctttgttgaatttctctgatgcgtcttgatttacgttacttctgtgccggaaaaccttcttgcgccttccgtcaccttcaggattaagttcagattgggcatgccagtttgcacatgatctggcccttgcctacctttccagtttatcttccactgtatatccctgcttccccgccttccccctcacggccttacctctgttctctgtagctgccctgcacctgcctgttcaccctgttccctttcctgtgctctgagtcgtgcagtcagtccttcaaggcccattgcaagtcatatctacaaaacaggagccgcctggatccgcccactacccccaggacttgtctcaccttcctctgatggccatggtactgaaagcgtctgctctcatcgtccccctttatagtctaaacatgttttctgtctgcttccaccgtcactgaa

SEQ ID NO: 115593 - DNA, 420 bp, Homo sapiens
tgagacagggtctcgttctgtcacccaggctggactgcagtagcatgatctctcaacgtgcagtggtgtgatcttgactcactgcaacctccacctcctgggctcaagtaatctaacagcctcagccaaccaaagtgctaggattacaggtgtgagccactgtgcctggcccagcaaatttctatacaggaccagagagtaaatattttagggtctatatttggggctctataatttctgtccaactctgctagtgtagaaggaaagcagaatagacaacatgaaaacaacatgtttgtgttccaacaaaaaaaggacaaaaacaagtttttggcctataggtcaaaatttgctgacccctagtctggaccaaaacaatgcaccagtccaaagaaaactacattttttcagaaagccctc

SEQ ID NO: 115594 - DNA, 287 bp, Homo sapiens
ggacagaaattttagggtctatatttggggctctataatttctgtccaactctgctagtgtagaagtaaatattttagggtctatatttggggctctataatttctgtccaactctgctagtgtagaaggaaagcagaatagacaacatgaaaacaacatgtttgtgttccaacaaaaaaaggacaaaaacaagtttttggcctataggtcaaaatttgctgacccctagtctggaccaaaacaatgcaccagtccaaagaaaactacattttttcagaaagccctc

SEQ ID NO: 115595 - DNA, 586 bp, Homo sapiens
tactctatgaacttagcttctgtctctgatctgacagaatgtctcacggtgacctttcccacatagccctcttgggaggcattgtggtgaaaattcccattcccttcaaaaaataattctcactggggaccaggagcacttgaacagtagacggataaactccaaatagttctcctatcttgattatatctttaagttcataagacaaaaaaatctctttataaagataataatgaaagtaggagaaaatgagagataatcaagaagcaaataaaatttgtgacctaagtttctcaaaattttaaaaattgtgaaccgtctaatggctataggtacttatattggttacaaatttcatataagttttcaaagatgtatcacagtttatacaacatagttttaaaacattttgttttacagcaattaaaggattgatactgcttataaccttttgccaaagtagatttggtttgatcattgtgtatcaatgtgtgtcaggagagcctgggtaatgctgatgtacaataatctctaagtcttggagatttagagtaacaaagatttatttcttgctcagactacatgt

SEQ ID NO: 115596 - DNA, 270 bp, Homo sapiens
agtgcctgacctcgtctgacccctgatgctggctgtgggcccccatgatgcccgcccggaccccacccagtgccgtcccaccatttgggggtgggtagcgtgcagtgaccactgtggcatccacaagtaattcctgagccaccttgaaaatacggacagacaatggccgggcacagtggctcacgcctgcaatcccagcactttgggaggccgaggtgggaggatcacgaggtcaggaaatcaagaccagcctggccaacatggtgaaac

SEQ ID NO: 115597 - DNA, 432 bp, Homo sapiens
ggactctccagtccttcagttacacagacagaaaagctctttccccatgtggatccacacaccatgttccctgggctctcattcatcccattttccagatgaagagactgaggctctaaatgataaagtaatttgcccatagtcccagaccatggcaaacctgaggcctgagactgggtctatctgcacccatggcctgattccttaaccatcaaacttctttgtgcccccaaaacagtagctctagaaggcccaggcctgccgagactaggcaatcagaaacacagggactgggtgaaaaattgatctggtgatccaggccaggagaagtaaatcatgggccttttctgggaactctgggggaaatgtgggctttcccatgagaattgagcttctaggactcattgttgacgtcatgagggaaagactgtc

SEQ ID NO: 115598 - DNA, 706 bp, Homo sapiens
ggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgta

SEQ ID NO: 115599 - DNA, 537 bp, Homo sapiens
ttattatcataaaaatcaatgacaacaacaacagctgacttgactgagcgctgctctgtgcaggtggtggtttgtattactgtattagtacaccgaatgctcgtaacaacagaagcaagtgattcccacttgacagatgaggaccctgagctaaaggcgagcagcagaactggctcagtgcctccccttgaaccaccacattacagtgggtcatttcacaaatgatgccctgaaatccggccacccagctgaacgcatggaactaaatccatttcccaccaactgcctcaggtacgcacagtgtgctcgaggcactgcagacactcagagacagccaagtcccagggtacatcaggatcccagccctgccattctgcactccttccatctcctcatgaacatgggccgcagcacctccttcagctcccttctcatcgatgtcacccagacactgctccattcaactgtgatgctgtcaaggcatgccctgggcacgcaacagcagctctggaacatccctacctgtcagggcgccaa

SEQ ID NO: 115600 - DNA, 224 bp, Homo sapiens
ttcagaaaagaatctttaaattttaggagcaggtaaagatttctgaataatggcttaggagctaataaaccaagagtcaccaataggaagaggtattaccaaaaccctaattctttcaatttcaagtacacagtggtctgtgacaaaaaaagtttaattaaacagaccctctcaaactatatttccttctctgcctagttagcatctcctttttctccccaaca

SEQ ID NO: 115601 - DNA, 721 bp, Homo sapiens
aggctcatttgctactctggtcacttactgacaggacctgtcagcttctgactcttcaaaggagtcagacagtcggagaaggagacatttcaggtagggagcagctgtggggtctggcgtggtaaaccttgctggcttgtttagatcctagattttagccagaatacttaaaaagttcatctggatggtagccagtgcatgtcccacagagtgcaatggccatttccacctgtggctttcgaggccgactgtcttggctcaaagccagccctggcacttgctctgtaatgttggtgagttgatgaacctctctgtgcttcagtttcctcatctgtgtaacggggataagaacaatacctaccttgcagggttatcagtgacgattacatgcacaggtaaaactagtttgaacagtggcacaagtgtccaataaataatactagtatgttaacaattggtagtagtaacatcacccttctcctggttaccctgatgtgtgtgacaccaaccaggcagccttctccagcctattttcaggcaaagtgcatggggcccacctccacctcccttagcttgaccacagcaaaaactaacttcactaataatgtaagggaaaggcccttggatttgagtcagccagaggttcaagtgctggatctgcaccaaaaggacaagtcagtttttcctctcgtctgaaaaatggggatactgctccctgtca

SEQ ID NO: 115602 - DNA, 236 bp, Homo sapiens
aatatcatttttaagcagcttagaagaaatcagactaagcagagagaagagactaaaagaaaaaaaaaaaaaaaaaaaagttgttaaccatatgatagacatagaaggtgaacatctggccgggtgcagtggctcatgcttgtaatcccagcacactgggaggccgaggcaggcagatcacctgaggtcaggagttcaacacaggccagccaacatggtgagatgccttctctact

SEQ ID NO: 115603 - DNA, 417 bp, Homo sapiens
cccgggcctcacgccatgtccacaagacagagaagagaaacttgctgagcaatgtgttttttctcttttcctttttttaaataaagccccgcagtggctcacgcctgtaatcccagcactttgggaggccgaggtgggcggattgcctgaggtcgggagttcaagaccagcctggccaacatggtgaaacccctctctactaaaaatacaaaattagccaggtctggtggtgcatacctgtaatcccagctactcgggagactgaggcaggagaatcgcttgaacccgggaggcgaagattgtggtgagccgagattgggccattgcactccagcctgggcaacgagagtgagactccatctcaaaaaaataacaaataaagcccctgaagggaggcttctctgggctgcaggtgac

SEQ ID NO: 115604 - DNA, 312 bp, Homo sapiens
tgagctgagatcatgccactgcactcccgcctaggcaacagagcaagagtccgtctcaaaaacaaaaaaagaaaaacctcatctccattagactcactgtgtaatttctctttggcctattctgagttcctttgttaaggcttccaaggtgctgcctgcacccagtgctgtgctgtgaatagtgacctcagactggttctctatttgtgtgtttgttcttgcaattctgtcatggacattaatggaaatatttaggttttagtgaaataatttttttttcctaggagaatgaaatcaatgggcccagtagac

SEQ ID NO: 115605 - DNA, 608 bp, Homo sapiens
ctcgtgccctaaaatgtgttttctttgatatatgtaggtgaatatttactgataaatttcaggttttataaagtttttttacctttcagatttaaagagctggtacttaattttatgctatttacttaatagcaagttactttttaaaaattgtgctttacattctgtgaaatgcttttgcattctctaatgtgattgatcttcagataccactatgaaatagtgtcagtgattcccattttacagagggtaaagaaattatttggcctatcaagtgacgtggctaaaaactgaggtctctagtgttttctttctacagtgaagacatttattctaagtgaaaattaaataaaagcattgaggaaagattggtgaggtcaaattatcacccttacagatgtgagagtgttttgaaaagtagaaagtagagtacaaatgtagggaataatatccagaaggcatactacattaagagaaataactcttcaagccttgttggttagttttaaatttaaggagaatcgttttataaatgatgtatttttggaagcatgacctataaatatagtctgaaaagaaatgttaagtttgatttgacagccatttta

SEQ ID NO: 115606 - DNA, 532 bp, Homo sapiens
tgccccagaaggagcatggcagctggattccaactgacctcactttttccctgccaggagacctggggcaaggcttgcagcctgccaaaccctgtaaacggagattatcagaaaacccatccccggggctagacgagacttaaatcaggtgctgggtagaaaacaccctttctaaggcactaagcactgcacaaatgttcttttccctttaattgccctccctttaattgtgagaaaaataatgatttggggtcagaatgtatactacatactgatctttctagaccatcattaaatgtagaggtagaaacaactcaaatgtccatcaactcatgaatggagaaagaaatgtggtgcatccatacaacagaatactatgcagcattaaaaaaatgaatggcacataccacatgggtgagcttcagaaacatcatggggaatgaaagaagccagatataaaaaggccgcaaactgtatgattccattcatatgaaaagcccagaatagggagacccacagagttgcccagagc

SEQ ID NO: 115607 - DNA, 404 bp, Homo sapiens
gtagagatggagtcttactatgttgcccaggctggtctcaaactcttgggctcaagcaatcctcccaccttgatctcccaaagcactgggattacaggcatgcaccacagtgcccagccagtagtgattattgtgactgttcgtccccacatggaatgtcagaaaccctctgaggatggtcccattaacaggctaatgtgtggcagaaggtggtttcgtgaaaggccaggaaggcagtggtccgcgtagtggtcatagtcacaccatcttacacaaagagacagcttgagtggatgtagtctttaacaggaggggctctgcaaggacaacccactcctcccaccctagaatctggaattctagatccctgaaccctgcttttaggcagagatggctcagagaag

SEQ ID NO: 115608 - DNA, 575 bp, Homo sapiens
gttttaaaaacaggctaatttagttggaagctggtaatttctttttcttcttttttttagggacagggtctcacttcgttctgtcacccaggctggagtgcaatagcgcaatcatggctcattgcagcctcaacctcctggtcttaagtgatcctcccacctcagccttccgagtagctaggaccacaggcatgtaccactatgcctggctaattaaaacaaaaaatttttttagagacaggatgtcaccatgttgcccaggctgatcatgaactcctgggctcaaacaaatgatcctcccgccttgtcctcctcaagtgctgatattagaggcatgagccaccacatctggccaaagctggtaatttctttctcaaccaggaggttgaggctgagacagagtcttgccctgtcacccaggctggaatacagtggcgcagtctcggctcactgcaacctccacctcccaggttcaagcaattctcctgcttcagctcccaagtagctgggattacaggtgcctgccaccacgcttggctaatttttttgtatttttggtagagacggggtttcgc

SEQ ID NO: 115609 - DNA, 292 bp, Homo sapiens
tcatactactgaattatgacaatttttgtagtcacatgaggaacacaaagaacatgaagaaaaaatgtgaagttatttaaaatctatttcttcaactttactaaagacatagctgtagaataacacatcttcacagaattctaaaactactgtataatcccttcttcccctttttaatatccttcatacaagtcataaaacactaaaatttacatagtagacattaacattttatacaccaatatctgaactacatggtccataaattattcttttgttgttgttgttgtat

SEQ ID NO: 115610 - DNA, 401 bp, Homo sapiens
ggagtgctgggggtagagatggatgtcaatagggctgaaagtggggatccgggggagcccagagtaggagtccgaggaggctcagagcttggagtcctaaaaggctcggagtcggggatctgaatggttcagggagggaagaagatttgggagtcagcctcagagctaaagatctcagggtgctggagtgaaggggcgctcaggaggggaaatccgaggggcgtccaaatggggggatccgaggaggctgagggtggacatgtctgaggaggctcagattggggtcacaggagtgcacagaatgggattcggtggggggcgggggtcgctgagtgttgatagccgggctcacagttgcaggtctgaagcggggtctcaaggtgtttaaaggggctctggag

SEQ ID NO: 115611 - DNA, 309 bp, Homo sapiens
gtttctgacacgtgcctctggagcccggctgctgcatttctgggggaagcggcttcagtgcaccccccgggctccctgctgggtggcagacacggggaatctgggcctttttgttttttgcctgtgtgggtctgtttgccttgaggatcctgctatcttcagcattagcaacacccaccgcttgatcatgggtcccaagattctggtttggtcggctcgagggccgcccgtcctgaccgtgggcttgggagggcgccccggtctcatcctcaccacctgtgtatattgtgtgtcttttccatcgcgggc

SEQ ID NO: 115612 - DNA, 361 bp, Homo sapiens
attacccatgggcctgatttcaacccagcttctcacttagcacccaacgcaactgaaccacatgactgtatttcactaatacacatagcatcttccccctttcctcatatttctattcttccaattccaaacctagaccacacttggtttatcgatggcagttcttctaaacccaatcaattttcaccagctaaagctggatatgctgtcatgtcccacacctccattatcgaagctgctgcacttcctccctccactacttcccaacaagccaaactgattgctttaactcgtgtgctctctctcgctaaaggaatgcatattaacatttatactgacttcaaatatgctttccacatcc

SEQ ID NO: 115613 - DNA, 356 bp, Homo sapiens
ggagatggctggggctaagtcaggcagaatgtgttcaaacctgtttttctctgacctgagattgcggagggaatattgggaaggtatagttacctggtgaggagagccagttttgtgaagaatcaagaatgaggagatttaatttgttatgcagatgtctgggaaccacagcagattatcaggagagcaaaattgttagtcagaattacatcgttagaaggtaatccttaagttttgtagatttctagaatgtaaggaagctctcagaggtgccataaggtgagtatggcctaaggatgtggctatggcagtgtagcaaaatggacaactatgaaaaatgtctagagaaaagtgca

SEQ ID NO: 115614 - DNA, 231 bp, Homo sapiens
ttttggattaaccgctgaaactccttccttcctttctcccttgtatttttcaaggtgagggagctatgtgaataactcatttagtttaaatgcacatttttaaaaattatacttaagtcagagatttgcttgtgcatgttaatttgtgatgggaaagtgttagtatttacttcagaaaaaaggaagctaaagacgaggaaagaagagaaagggcaaagaatttggaagcat

SEQ ID NO: 115615 - DNA, 278 bp, Homo sapiens
ggcttgggaaaacagaatggccctagacatgatattagccaaaaaaggtggagtttgtgttatgatcaaaactcaatgttgtaccttcatcccaaacaatactgcccctagtgggagcataacaagggccttacaaggccttactgctttatccaatgaattagctaaaaattctggagtcaatgaccctttttcaggatggctagaaaggtggtttggtaaatggaaaggaatcatagcctcaattcttacttctcttgcagccgtaataggtgtag

SEQ ID NO: 115616 - DNA, 1193 bp, Homo sapiens
tgtgacttagaggacagggatggattccaaggttcttcattcattttttaattccagcaaagcacagagtttgtacgtgttcagtctgttgacagtgggtccctcggccaaaaggttaccttgaatctctggatgctgagtctccactcttccaagagtaactgaagatgtccataataaggggtcgtgaactgaggagatgatatagttactttagaaggaacagtagagttctggggaatttggcacgaggcgcccttggacattactctctggatacaacggagagtgtgccaaggcttagttagtgctacattaaaataaaaaatgtatgtggcaagggctgtaccaaaatagagtccacctcagactatgggaattagggtgggcggatttggagaaacttaaaaaaaataactagatttggttaggaaattaccatccatagaatatattgatttatttctttttactttcttaggtaccacatgttttattgcaaaccttcttaggtttgggctgttaattaatctgacattttactttctgtatttcctctacttctgtctctttgctagaattacagtgctactctttagaaagaaatctaactttccgtttagaatttaggaactatgaaattcagctaattctggaagggtacatgccccagattcatctgctaaatagtaccagcttaaccagaaccaattagggcaaaagaggaaggagccctactttcttgctatcctcttaaaaaaaatattcagcagcaccagcatttcaaagcatctctgatattacagaggtcttcaattatcatttggaatgtggatgagcaacaaactaaaacttctctacatgttcagaaagatactttcctcctttataaaataacaaactagtagaagttgtttcaaatatggctttattttttagggttgtgaaattaatgaatctgtggtgtggagttaatactgtaacacttttttttgagctagaaaataacattcggtatcagagaaaatggcaaattgccaatcataaaagttttcaataagaaatgactccagtactttatataatgtttgcaatagccctgagactcggtccccaaattcatttcttttgctaaaaccgtcaacatactgaagacaacaattttaaaaagtaaaaaataaaataaaataaaa

SEQ ID NO: 115617 - DNA, 440 bp, Homo sapiens
agaggaagcttagcaacgttacatatgtcttccttggaatctaacaagggccacagaatctaaaggctctctcttcattccttccttccttcctttttttcttttttctttctttctttctttctttctttctttctttctttctttctttttctttctttctttctctctctctttcctttctttcttttcttctttctttctttctttctttctctttcttctttctctctctttccttccttccttccttccttccttctttctctttctttcgtcatggttgagaacacagaaggcatcaagtttgatgccttctgtgttctcaaccatgacccattttacaaatccatgtgctcaatgttctgtgactagactaacaagcaccagtcacacccttaaatctttttgtctcttaggttgttctagcccagaaatct

SEQ ID NO: 115618 - DNA, 307 bp, Homo sapiens
agagtggtgcacggccacggtttacgagcctcaacgtgcacttcatgagcaagcaagtttacagccccttttacaggaattggtgcacattccctctgcttgcccctgtccctgcccacatgaaaacacagggattttttgctactactgctgaagaaaagttagaggacaccttgacctcatgattttgctgagcacttgctttcttaacagtgtgctttctggacccttagtttattttttatttttttaattttttttttttttgagacaaactcttgctctgtcgcccaggctgtagtgcagc

SEQ ID NO: 115619 - DNA, 265 bp, Homo sapiens
attttcttcacacttttttttttctacttagacaagataattccaaattgatttgtcttccacttcactgaggtttttctttggcctgttcaaatcttctgttgaaaccctctagtgaagtcttcatttcagttattattctttcacatcttctgtttggttccttcttatcatttgtatctcttcattgatattctggatttgtttagacattgttttcttggtttccttcatctctttgtccatggtttccattagctctttg

SEQ ID NO: 115620 - DNA, 1872 bp, Homo sapiens
ggcggcgtgcgcgccgtgagccccgccgcctccgccagcccgagctgcccgcccggcggcgactgcgccggccgccgcccagcaagccgggtcgcggagcctcgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccctgcggggaccggcactgctccccggaccacatgggggtgcagcaggtgctggcgtaggcggcccagccctcctggggagacgtgactctggtggacgcagagcacttagttaccctggacgctccccacatccttccagaaggagacgagctgctggaagagaagcaggaggggtgtttttcttgaagtttcctttttcccacaaatgccactcttgggccaaggctgtggtccccgtggctggcatctggcttgagtctccccgaggcctgtgcgtctcccaaacacgcagctcaaggtccacatctgcaaaagcctcctcgccttcagcctcctcagcattcagtttgtcaatgaagtgatgaaagcttagagccagtatttatactttgtggttaaaatacttgattcccccttgtttgttttacaaaaacagatgtttcctagaaaaatgacaaatagtaaaatgaacaaaaccctacgaaagaatggcaacagccagggtggccgggccctgccagtgggcggcgtgtgctagcaaggcctgccgggtgtgccgcagtcaccacagggttctgagaacatttcacagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaaggtgtgttaggaaaact

SEQ ID NO: 115621 - DNA, 1938 bp, Homo sapiens
caggcgcgctgctgataagagcctgcgggtttgcagagaagcgcagcagcgcgcaggtcctcaccagagctctggtggccacctctgtcccgccatgctgctcaccgacagtggccaggcccacagcaccaagaggcttgggccacaaagtaaagggtcgcggagcctcgccggccgccatgtggagctgcagctggttcaacggcacagggctggtggaggagctgcctgcctgccaggacctgcagctggggctgtcactgttgtcgctgctgggcctggtggtgggcgtgccagtgggcctgtgctacaacgccctgctggtgctggccaacctacacagcaaggccagcatgaccatgccggacgtgtactttgtcaacatggcagtggcaggcctggtgctcagcgccctggcccctgtgcacctgctcggccccccgagctcccggtgggcgctgtggagtgtgggcggcgaagtccacgtggcactgcagatccccttcaatgtgtcctcactggtggccatgtactccaccgccctgctgagcctcgaccactacatcgagcgtgcactgccgcggacctacatggccagcgtgtacaacacgcggcacgtgtgcggcttcgtgtggggtggcgcgctgctgaccagcttctcctcgctgctcttctacatctgcagccatgtgtccacccgcgcgctagagtgcgccaagatgcagaacgcagaagctgccgacgccacgctggtgttcatcggctacgtggtgccagcactggccaccctctacgcgctggtgctactctcccgcgtccgcagggaggacacgcccctggaccgggacacgggccggctggagccctcggcacacaggctgctggtggccaccgtgtgcacgcagtttgggctctggacgccacactatctgatcctgctggggcacacggtcatcatctcgcgagggaagcccgtggacgcacactacctggggctactgcactttgtgaaggatttctccaaactcctggccttctccagcagctttgtgacaccacttctctaccgctacatgaaccagagcttccccagcaagctccaacggctgatgaaaaagctgccctgcggggaccggcactgctccccggaccacatgggggtgcagcaggtgctggcgtaggcggcccagccctcctggggagacgtgactctggtggacgcagagcacttagttaccctggacgctccccacatccttccagaaggagacgagctgctggaagagaagcaggaggggtgtttttcttgaagtttcctttttcccacaaatgccactcttgggccaaggctgtggtccccgtggctggcatctggcttgagtctccccgaggcctgtgcgtctcccaaacacgcagctcaaggtccacatctgcaaaagcctcctcgccttcagcctcctcagcattcagtttgtcaatgaagtgatgaaagcttagagccagtatttatactttgtggttaaaatacttgattcccccttgtttgttttacaaaaacagatgtttcctagaaaaatgacaaatagtaaaatgaacaaaaccctacgaaagaatggcaacagccagggtggccgggccctgccagtgggcggcgtgtgctagcaaggcctgccgggtgtgccgcagtcaccacagggttctgagaacatttcacagaagtgcctgagacgcggagacatggctggtgttaaatggagctattcaatagcagtgacgcgctctcctcagccaccaaatgtccctgacaccctccccagcccccacagataacatcagctgaggtttttttcagtatgaacctgtcctaaatcaattcctcaaagtgtgcacaaaactaaagaatataaataaacaaaagaaaggtgtgttaggaaaact

SEQ ID NO: 115622 - DNA, 245 bp, Homo sapiens
gtcaacttcccactatggccagagatgaaattataaagtattctaagtatgccactccccaaattaacttggttatatttttattggtttttccagtatttatatcttgattaattgatttatcaccattaaagaatctatttgattcctgtataggcatccctctatcccttatctctcatcttctttgtcctatggacttttgttacagtaattctaaattgccatgatttacaattgatttc

SEQ ID NO: 115623 - DNA, 906 bp, Homo sapiens
atctaggcagatgtttgactttagtaagatccactattcactcatatgttcattcattcaatgtatttggagggacggggagcatttactgtgtgtcatgtactgtactagatgttgaatatacaatgagatgcaaaatagacacattccatgacctaaaggtgtcaactgcagaattaagtttcagaagcaagacgctattcttcagtctcagtgaagactattaagaataagtgcaggctatggattcaaagaaactttgagagtaaatagagtgttatagtggggactatgccactaaaacaaatacatactgcatttgactttgtatagatccatgaagcccctgacctaagttttcatctcttcaattggtaacaattttagtctcagaatggtagtaaaccaagacattctttatacacattaatatcattgtttttaaatgtttattctctactgtgttcatgctggaatatcttaagacaaaactgcagaggtaatatccatgttccattttatcttctgccctttacaagccacctttcattatctataaaaaaaagaagcagttttgtacatttaatgacatagttagaaagatatcgaacaacaacaacaagaaaaccatcagcagtttgtccaggcatgtagctcagtgatagctaatgtaattaaaacctaaaggtttttccttattctcctctgtacgtgaacttggtaacaggtgggttattcttgaagactcattttgcagacttcctattcacaactgtatgtaccttattctgaaattttctcaccagttttgatcccttttccctttacaatacgcattttggtgactatatattgttaactttgcaaattactcttatcattgattaaattttaatctcttattgt

SEQ ID NO: 115624 - DNA, 479 bp, Homo sapiens
gtaccttcagacttgtctaacccacagcccatcatatctctgggtgtttctccagacagctttgggagagaaagcacaagactatgcctttctatttactttagatcataacagtgagcaatgagggcatttaaagacccccaaacaggggctgaatttgttgaattgcttgactcacctctcagcaaatgccttcccatgtgtcctcttcccagctgaactgtgagctgcctgggaaagccagtgcctgactcttcgtatctgtgttcacagctcagagcacagcagggccacttagtaggttccaataaatgcttattgaacaaatgaatgaatttaatgatttgtatattttactaatagttcttgccctccttaggtgatgttagcacagcaaagcttggttaaattacactaaggtagtggttcttaatgtgtgattcctggaccagcagcatcagcatcacctggaaacttgt

SEQ ID NO: 115625 - DNA, 201 bp, Homo sapiens
aaaaattttgtttgtttttgtcatactcatattattctaaggcccattgattttagaaagaaaatctgttttataaacttagcatattaaaagcaaatgcatagctccattttcttagaaatgcgtgaatacataaacatgttttactgagagtaggacttaatttatatgtattaaactgtcagaatatacaagttcttt

SEQ ID NO: 115626 - DNA, 326 bp, Homo sapiens
gctggcaacgttggctttgtaatttcagctgagatgaagtacagaagattgttagttcttagaacataattttctgtgataggcagaagcaagctgcaatttggtggcatgcaaagcggggaggattcatttaactggatgcatatggaaagctgactccacggacatagaattccccattcagatctgatagccaccttcccctttactcccttatttatcattctgagagcaaagtgtttgtcaggtacatgtgtgggaaaatattgtttgctagtagcaatgttcccaaattcttactcacttagccccatgaaggttgcctg

SEQ ID NO: 115627 - DNA, 546 bp, Homo sapiens
tagtgactttaaggaagatgagtaggaatcatggtagaatttatagtagacagagtagcacctgtacctatcagaaagatttgctttctccctctattattaaagataatcctccttaatgatttgaaggagaaattgggcactataatattgcccagagtcccttcattattcctatttagaataacagggaaggagcattacttctgtttcattttagttaagatgggttacttttcctagtgctctcccctttgttaagtgcagttggccctctgtatctgtggatgacacatccatggatgtaaccaacctcagataaaaaaatttggaaaaaaatgaaaaacaataatacaaaaataaaaatacaaatttaaagaacaatgcagtataacaacattgtattaggtattataagcaatctggacatgatttaaagtataggggagaatttgtataggttatatgcaagtagtacaccattttattttagagacttgagcatctgtggattttggtgtctgcagcaggtcctggaaccagtcc

SEQ ID NO: 115628 - DNA, 285 bp, Homo sapiens
gaaatccttcattctatccatgagcttgttattcttgagaaaaaaatttactttgagagtctgaggaatgataagtttgttacattccggaatctagttttggtgttgtgtccatcctttagatagggtgcagctctgttttaccatagcaacaactaacttttatttccatagccactgactgcactcctgaccctgccaaccatcttgcaaatacatcctcttgcttagaagaaccaggggaggggtggggcatggtggttcatgcctgcaatcccagcactt

SEQ ID NO: 115629 - DNA, 508 bp, Homo sapiens
gtggaatctttcagttataataatcattgatcatatgctaatgtctgtcaagaactatgaagagtttgaagttttaccctatttataggctgacaagttaacttggcatagtttaatggcttatggtagaagtcattgaaatgacttggtcatagatgaagaacgatgcactgtgtcagtagccagacagtcagcatttgcatcagatttctgagctccagtttgcataggtcattgggaagaggtccaggtgaaacctgcacaagtagtgaaatcccaagcttagagaaactcagatcttttataatgggtcataaatacgctttttgctctgggacatgtctttcttccaggacccttcactatataactatcctgaaaagattggaacaaaggcttccagtgcttctcttctcaagacaggcagaaaatcaagagactccatggagagttgtcttccaaaactgtctagtgaattttctcagtttcccttttgttatttgcttaa

SEQ ID NO: 115630 - DNA, 779 bp, Homo sapiens
atgttttcttctaagagttttatagctttaactcttacacttagggctttgattcattttgagtttatttgtgtatatgctataaggtaggggtttaacttcattcttttgcatgtggatatctaattgccccaaaaccgtttgctgaaaagactgttctttcttcactgaattttcttggtatcctgttgacacattcattcttatattaaaataaatacgtattctctgtgagtcagaatgagtgagtcaattgtaagtttgttgtattgcttttaaaactgagtagatcataaaaatgtctctgttgtttcatctataaactgagggtgatactactttttggtagcataatttaaggtgtaaaatatcttgctgaaggcagagggctagatcgtattacctcccaatagattggacactagccttaattgtaaacctctaattgatgccaatgtggttgaaagacttttgagtctgaccaacatagatccaaatcttgactccattacttactaactgcgtgaccttgagcaagttagttcttgggaactggtttattgtgaggattgaataggataatgtataaaaatatttgacaaaattactgagatttattcattcatttattcatccatccgtccatccattcattctggaaaaacttacggagtgcttaaaaaagctaaaataaattgaatagacaaagtccgtgctctcatagagtttactttgtcctggggacacagataataagcaaataaatcaataaatatata

SEQ ID NO: 115631 - DNA, 125 bp, Homo sapiens
acctcggtaccctattattaagaacctggttaatatttggaagtctacaatgtactcttaatgtcttgaagtataatattatttacagttcttagaatagttaaatcttcatatggaccctcatt

SEQ ID NO: 115632 - DNA, 360 bp, Homo sapiens
cagagctccctgggcaaagttggtataaatgagattgtttcaaagggagctcacgacttaaagagtcctggccaggtgcggtgactcccgcctgtaagcccaacactttgggaggccgaggcaggcaggtcacttgaggccgggagttcgagagcagcctggccaacatggttaaaccccgtatctactaaaaatagaaaaattagcggggatggtggcacgcacctggagtcccagctgctttggaggctaagccaggagaattgcttgaacccgggaggcagaggttgcaatgagccaagatctcgctgctgtactccaacctgggcgacagagtgagactccatctcaaaaaaaaaa

SEQ ID NO: 115633 - DNA, 852 bp, Homo sapiens
ctcgatttgtggttggctgaggtggaggaacaaaatggcggcgccggcggcgtgaccgggccctctggcccacagccgttggtagcggtggcagcagtactgctgccccaactcgctgtgccccctttctcagcccacgacatcgccacgacagcgaggcagcgaccgccaccgagaaagaggtggtggcccagcctggaaccttgagaaaccctcgcaaactgtggcctggcggaaatcctggtgtgctgcagggatcaggctgactccacgccctgtaacaccgggaaacgcctcggtggccatttccagcagccctcatcctcagccttgcgggccggtgggccccggaggcctccatcctcccctagaggggtcagggctgagcccagcctccatctttgcctctcaggatgacaaacaacagcggctccaaagccgaactcgttgtgggagggaaatacaaactggtgcggaagatcgggtctggctcctttggagacgtttatctgggcatcaccaccaccaacggcgaggacgtagcagtgaagctggaatctcagaaggtcaagcacccccagttgctgtatgagagcaaactctacacgattcttcaaggtggggttggcatcccccacatgcactggtatggtcaggaaaaagacaacaatgtgctagtcatggaccttctgggacccagcctcgaagacctctttaatttctgttcaagaaggttcaccatgaaaactgtacttatgttagccgaccagatgatcagcagaattgaatacgtgcatacaaagaattttctacaccgagacattaaaccagataacttcctgatgggtactg

SEQ ID NO: 115634 - DNA, 169 bp, Homo sapiens
aatgatctctctcaggatacctgattctgtaactatagctactctctagtaatagaatgaaaactttggtctcctgccagtcgaggcatgtcggaggaaaacactggatctatttgatgtcctcacatgaaagtaaattccaaacaaagcaaatagttaaatgttcaaa

SEQ ID NO: 115635 - DNA, 484 bp, Homo sapiens
caagcaggtgatattatcaaaattttacagctgcaactcagacaaatccagactttggaaggatcagcataaaggatccttctaccacaagaacaaaatactgcaaaatgaaaaagggaagacagaccgaatgatcagaagtattcctcagaactgataatgttaaatcatgttaagtagtttcctagttatcagcatagtgaagtagggaggtgggtaagaagtagggaagttggccaggcgcagtggctcatgcctgtaatctcagcactttgggaggccaaggctggcagatcacctgaggtcaggagttcgagagcagcctgaccaacatggagaaaccctgtctctactaaaaatacaaaatcagccgggcgtggtggcacatgcctgtaatcccagctactcgggaggctgaggcaggagaatggcgtgaacctgggaggcggagcttacagtgagccaagatcgcgccactgcactc

SEQ ID NO: 115636 - DNA, 546 bp, Homo sapiens
cgaggagcagggaagaggagaatgagcatcatgggccttcaatgcccgctctgatagcccctgaggactctcctcactgtgacctgtttccaggtgcctcatatctcatgactcagattcccgggactcagacagagtccagggctgaggaactgtcccccgcagctctgtctccctcgctagagcccatcaggtgctctcaccagcccatttctctactgggctcctttttgactgaggagtcacctgacaaggaaatagatcaaaacagccagcaagaggaatccaggctgaggaagggaacagtgtccagccaagggactgaggtggtctttgccagtgcatctgtgactcctccaaggacaccagattcagctcctcccagtcctgctgaagcctaccccatcacacctgcctcggtatctgccaggcccccagttgcctttcccaggagggaaacctcttgtgctgcacgtgctccagaaactgccagtgcccctctctcaatggatgacccatctccctgtgggacttctgagatgtgcc

SEQ ID NO: 115637 - DNA, 401 bp, Homo sapiens
aaggtctataaagatagaaaatacctgataaaaaggctacattttgaggaatggcaatgaagcctgtgagaggacgttttcactattctctttctcttgaaagaaagagaaagaaggaagggaggaagaagggactgggagtgttggtaatagataacccttaatatcccattcagatcaaatttctataattataatgtggctctctgcctctggaggtcactcagtaacaaagaaatataactttaaaaatagccaaagtaggaaaaataacaatcattctcataaatctgcagtttctttctttctttctctctctctcttttcttctctctctcttctcttccttcctttctttcttctttctttctttcttttcttttctttctttctttcctttc

SEQ ID NO: 115638 - DNA, 235 bp, Homo sapiens
ggcccgaatagacagagaagaaggaaggaagagaagagagagagaagaaagagagagagagtaacaaagaaatataactttaaaaatagccaaagtaggaaaaataacaatcattctcataaatctgcagtttctttctttctttctctctctctcttttcttctctctctcttctcttccttcctttctttcttctttctttctttcttttcttttctttctttctttcctttc

SEQ ID NO: 115639 - DNA, 872 bp, Homo sapiens
aggaaaggtataagaaaatgtattttcctctcttctctacctcatggctttccttgaaattcaagtataatatagatgatgtaatttttatggatggcttggcagactttctctcaaaggtttagactttgtggaccacgtgatttctattgcaactactcagctctgctgttgtggcacaaaagcagtaaatgggtcaggcacagtggcttatacctgtaatctcagcacttcaggaggccaaggctggaggattacttgaggccaggagttcaaaaccagtctgggcaacatagcaatactccatctctacaaacaaatactaaagttagccagacatcatggcatatgcctgtggttccagctactcaggaggctgagatggtgggatcgcttgagtccaagagttcgagactgcagtaagccatgattgattgtaccagtgcactctagcctgggtaacagagtaagaccctgtctcaaaaaaacaaaaaaataaataaagcttccaggcatggtggcgcatgcctgtaaatcccaaagtgttaggattacacatgtcagccactttgcctggccagaaatttttattgttaggggctcgtaactgtaggcaattctggagcatcaagtgctttattaagaagcatttattgagtacctactttatttcaggaagtatgccaaaatgctgctgaatagcaagaaattaaatgagacttggttcttatacgtcagatgccttatggtctagaggaatggtgtacaaaagcaaggtgcaaattattttcataatactaagacattatttgacttttggactatgttgacatttgcattgaaaaaatgataggtataatcctggttgtatc

SEQ ID NO: 115640 - DNA, 435 bp, Homo sapiens
tttgatcactcctgaggggccaggatttattttaatgcattttaggggaggagaagatatcctaagcctggcaaaataaaaataacacagattaaggaaacaatgaaacattattttaaaagaaatgcacttcagttaatattattctatgggatctcctgagtcctttgaaggcagagcttatcttagaaaatatgtctcctttagtgggcaggaggttagttaagcaacctcacaccagatcacagattatactgaaatgatcctaataaggaaagactttccaaagctatactcattttagcatgaataaatggattcaagtcttatttgtgggattttaatttccaactttgaatttgcaaactatcaaattccttcaaagacacggtgtgcagagaaggctctgagtaataggattgcttatttttaaag

SEQ ID NO: 115641 - DNA, 413 bp, Homo sapiens
tgagtctgtgttcacctctgcagagcattgtaacatattttacccttaattatattatttcatcactatttcttttcccttaactgtgttctaataaacatgcttatttctggaacttagggactcattacactctgcattctttcattgcataaaatcaaactctcaatcaatatttaccccagcagttctccatcaccacaaaagaaagagaagaaattgcataggtaaacccaaagggaggatgaggcttaggaaaaagaatgaaaacaaggagccattaaatgtatacaggtttctcaaggaatctgtaaaatcttcccctgtgaaagacatctaactaaaggaaaaatggtcttgaaatgtttattattcttcaaacactgtcttctcctgacaccagatagtctgga

SEQ ID NO: 115642 - DNA, 654 bp, Homo sapiens
  misc_feature (282)..(282): n is a, c, g, or t
  misc_feature (285)..(285): n is a, c, g, or t
  misc_feature (287)..(288): n is a, c, g, or t
  misc_feature (293)..(293): n is a, c, g, or t
tgggccggggggagggggaaaaaaagaattttgtaaaaaaaataacccttcaagggtgttcatttaactttcaccatactttctcttttctggtaaaagcatttccgaaaaaaaagaacagaatgtttatgggagacatgcataaactgaattcaagaatattttttccataggaataaatgtgaaatgagatggccataggagttctcaaagtacatatgtccacatccattatagcatgtttttcctttatgctcctttttatttctgagcattatctcnaantnnatttntcagatttctttaaatgaatggcacagcatacattggggccatttggcttttttcaaaagattttattatctcttctttgtctcataattactgatttggtggcagttttttaagcactagccttattaccaccacttaatgaaggcttggatgatattattattatgatagaaaaatacatgattttataagtagtcatgagtgcatcaaataacagcacaggatacaacaaaatcacttgcagaagacctaacgctcataaattctagggaaataaggcaataaacaaaaaggaaaaaaaatatttatttaaaaaaaaggaaagaagttaaaaagcatcagtgttgtaagaaaaaaaaa

SEQ ID NO: 115643 - DNA, 103 bp, Homo sapiens
ctgccagaggggaaaggcctccaggacagaagctgagccctagaaagaatcacatgagccagatgtggtggctcacgtctatcatcccagcactttgggagga

SEQ ID NO: 115644 - DNA, 480 bp, Homo sapiens
ggtacaaaccaggttaacttttaatacatcttgttaacttttaatatagattgaatgtctatatgatgatgtttaggatatgttaggttatataaaatatattgttgatttcacttgtttctttttactttttgaaatgacactaatagaaaatttaaaattatatttggcttacattataattctaatctgatataaaggactagcaatagactagttgcttgttgagtgttttgactgtggaatgaaaatgccttatagggttttcctgtatcttctgatacaggaaattgtagagcaaaggatgtaagtttcttgtgaactagacagtggccccgaaagtctgtgtaggattttcttgggtcctgttcaagaaggccttttagatggatgagaagacctcaacagggattgaccttccagattcccaggagctgagaaaagagccaaaaatggccagttgagggtgtataccaagca

SEQ ID NO: 115645 - DNA, 752 bp, Homo sapiens
gcttgtctgggagcgtctgctgttactcgaagtcccagctttgcctccgtctttctccctctaacccaagacaaagagcagtgtgctggattcctggctgttgctaaattctggactgctccacgcccctgggtttggcttctgtgttcttccacccattctctgcattacatttcctccctgtgaaatgtcttgagtcaattctgtctctcgactagaccacgcctgcaacactaactgttccgttcggacagaaggttcctgagaacacactggcgctgctgcgctccacaggactgctgctcacagggaaaacagagacagagatggagaaggagactcctgagttcatcaagaaacaccttgatccagccttgcttggaacgttggggtagatgaacaacaggagaatggacaagacatcataaaggcggtaatcatgcttccttcggccagaaacggtccccatcccatctattgatgagaacgcagccatgtgaccacatctccttgccaggcaggctgggcaatgtggcttcaccacgtaccaaggaaggaggagcagcaactggtgagcatacagcgcagcacccacttgtggtgccagaccatcaggtaaggccagacacagccgggcagcctggcagcaaggacaacgaaacctggagctggtttatcggtgacgagtggaatctgtttcctgaagagcctgagaaggcaaagagcctcctctgcgggaagacgggagtgag

SEQ ID NO: 115646 - DNA, 410 bp, Homo sapiens
cagtgagcagtgtgagtggtcatcagagaatagctatctttcataatgataagacaggccaggcagcctcatgcctgtaatcccaccactgcgcccggccaggcatgggtttttatgaaacaccgctggtttcatacaataagatcaacatggagcttccttctttggaagcctctagcaaggccaaatgaatgtggcccagagaaagggagaactgaggcatgatatgtgggtttacctcaatcccaaactaaagcctaggagttggacactaaatctaagctacagatgcttttgcctgactttgtcctatgtgcttcacttcctgtcaatatctagcaagtgtaatttttgcagggggaaattaaggggtcctcaacctggccatacttaacaactaatagcaccca

SEQ ID NO: 115647 - DNA, 404 bp, Homo sapiens
tcactgctttcactccactttgaccgatgtccaccggggactgctatccatccatggtctgatattcacctggagacagatgttcaactggggtttctaatgacagatggggaagccaaggtgaagcagaagtcatccctgaagtcttcccttagaagccgtttgcagccttttctgagacagtcttgctctgtcacctagtctggagtgcagtggtgcaatctcggctcactgcaacctctgcctcctgggttcaagcgattctcctgcctcagccttttgagtagctgggactacaggcgcctgccaccacgcccagctaatttttgtatttttggtagagatggggtttcactgtgttggccaggctggtctccgactcctgacctcaggcgctctacccg

SEQ ID NO: 115648 - DNA, 378 bp, Homo sapiens
tcaacatctgaactctgtaaaattgctttaagctgcaagttacaaatctacaaaaatttaggttgaagaacacagactaaaactacaggcaatgaaacaagttataaaaggagatatgatttacataaatagatgctataaatacagaaacactgtgaagacaagataatccatctgcacattggaatagatattaaatctcacgtatatgatttgaaaattctactttttgttccagagacaaaagatatcaaatatgtattagacagagaaacttgcagacaattacaggaacacctaaacattaaagtctgagttcttctgcataatatttattcattctttctaaggatctgggccaatttttttaagtaggcg

SEQ ID NO: 115649 - DNA, 360 bp, Homo sapiens
ctggatggcacagacagcaaaggagatggtcttccgggatgacaggaggtggaccagcatcagaggcacaaaggtgggcgtgtagcagatgtccagggtagagaggttgcccaggaagaagtacacgggcgtgtgcaggtggatatctagcacgctcaccgccatgatggctgtgttccccaggagggtcaccaggtacatggctgagcacagagggaagagcagatgctccagggctgggtagccagaaaatcctttcagaaagaactcggacacctctgttctgttgagcggctccatgctgcagagttctgaagagatggtccacagctgggatggaaggagagagggtacagggtg

SEQ ID NO: 115650 - DNA, 370 bp, Homo sapiens
acagaccgtcacataaccagtctgcctcatcctcctcatctgtaaaatggccagaataaaagtgtttactcataggaaaatccttatttgaggattaaatgaggtcatttaatccccagagtggtatatagcaaaaattaagtccatggtcgatggttatttaattcattaggtaatttatttcataaaacaaacctgatgacaagagaatagaacataaaggacaaaaatcttcaaggaaagtagcaggggctcagctgaagtataaggagtaatactgtgggggatgtgccagtgagtaccaggaggaaagatgccttgaaaagatgcggggggagagaaagagaagagtccagagatctcatcattt

SEQ ID NO: 115651 - DNA, 245 bp, Homo sapiens
taaggactgtaattttgaaaggtttactgtgggtaaagttccatcagacagcattatacgctacagagaaatcttttgtgaaagaagagttggccgggcgtggtggctcacacctgtaatcccagcactttgggaggttgaggagggcagatcacctgaggtcgggagttcgagaccagcctggccaaaatagtgaaaccctgttactactaaaaaaatcaaaattagctgggcgtggtggcagg

SEQ ID NO: 115652 - DNA, 330 bp, Homo sapiens
ccccagcctgtccccgcccactcttctccaagtcatctcctgcatacctttcaagccgcagcaccctctgcccactagccctctggacctaccgcagactactgctactagtctactgtcagccagacccacaagcttcctgagggcaaggactgtgccacttttgctttgttatctggtgtccaatttatagaagatgctccataaatacctgctaaattaatgtaaaaatgaaaaaaacttttcctggctgaggcaggagtctaaactgagctgcaccagacacagctgcaatgtgccccctacagtgctgaagagagagaaaatcac

SEQ ID NO: 115653 - DNA, 529 bp, Homo sapiens
ggctgcattcaccgcaaactgatagaagagtccttgagttttaaatgaacatttgtggtggcctggcagaacccccatggagtggttttggtgatggccccaaagagaggctcctatgcctgtggaaaggggaaggaaaagtgggaaggacttcgtattgtagtgtaagtgccagcttagccactgtagtctagaacatcaggtatactgttaaggttacagactctaagccctggttcacagacagcatctctggacatgctccaagcctgggggaacttactaccttgaagggaagggccttgggcagcacccagtgctgtgttggcttcaggtctgacccagcacagtcccagtagtggtggtcacaggggtgcttgcatcaccacatccccaggtccaggtgtctaagtgcagagagagaaagtctctgcttatttgggagaaagtcagagaaaagaacaaaagtctctgcctggtaatccagagaattattctggatcttatccatgtccaccaaggtggtacc

SEQ ID NO: 115654 - DNA, 1653 bp, Homo sapiens
gacccacgcgtcgctgcagaagatgaagctttgagtaacattgccagagaggcacatggatggagtgaaagccattatcctcaacagactaacacaggaacagaaacccaaacactgcatgttctcacttataagtgggagctgaacaatgagaacacatggacacaggaagaggaacaacacacactggggcctgtggagagggagcacagtggggtgagggagagcatcaggataaatagctaatgcatgtggggctaaatacctaggtgataggttgataggtacagcaaaccatcatgacacgtgtttacctatgtaacaaacctgcaggtcctgcacatgtatcccagaacttaaaaatcagtgagatatttttcagttaaaagatttaaaaatgaaaacgtagatacgactctacagtgagtgatcttaactatttgcacaaatgaagcattttggaaacaacataattgtagttgaaatttgaaactacccagaatgtttcctttcaaaattggagggatttacccagatttctgtaagggaggaaaatgccaccaccttctagtctccttttgtgttgtcactaagtatttgaacttttttttttaatgtgatgctttctttaaaaaattgtataggattctaacatccagcacttgctgagtgctgtgtagcaaacactattctaagcattttacatgcattaattcatttaatccttataaaatctgcagtcagtttttttatctgcatttggcagatgcggaaaccattgcacagaaaagttaagtaacttccccaaggttacgtagctaggaaatagtagagccaggattcagactctgaagcttggctccagagtctgtgcatttaacctcttactatgccagattgtttctcaatcagtcttctctaattccaccattaatagcttattttttgtttttcagtaacttttcatgactttgaaagcagtttcacatcttgattctcacaaaagtcttgagctaagtaggatagatattattactagccatgtttacagctgaggaaacagatgatgttcagatagctctctaaaatgtatcagaagcaaggctaacattcacccatttgaagtcattgttcatgttccaggagaggtgggctttggagacttacagggatttggagaaaaaaattcagatggcacaatatcattaacctaaatttgaagacagtactagcaacacctttttttccccctctcacaagtatttatattagtccccaaattagtatttttggttaaatgtatcattgcagatccaaagttttactttttgtatactgtttattgggttgtataaagtcctctctcattccaaaagaatatttttgctgtcaaaaggtctccgagtaaatggaagatatagttgtttgacatcagaaaaagatgagttaaaattcctagagtttatctactacatgttggtgtttatgctcagaaaaatttaaatatttgtcctcaactaccaaaaacttaaagtggttaaacataatcatattgtaagatttaattaaaaatttttgtactaaagggaagttgctaggaaatagagcagtaatttttgttaatttggaaaccatggcaacacagtaaatatt

SEQ ID NO: 115655 - DNA, 602 bp, Homo sapiens
ttccttcagagggtctgtgtattctctcagctttcctggtatattcctgcagtagttctggagcaaaagcatgatgcaagtctccacatgctactcggtccacctgagtgtgagctgcaacctaatcctgcctcctatcttgccattttcccaataacagtctctccagaacacaagtattttaaaaactaacccagtaccatattctcactaatcaaagatgagttaaaatttgattgcttatttttatgtttcttacattgaatgtttaattaatgattttaaatttttttgtgattaatagcaaagatattcaagtccatacatttttctcaaaatacaactttaactacatcttataactttgggagagccatgatagttatttttattggtcttttacatgaggcatggactgaggctgtgtaagagagagaatccatttaggattataaaagaacaaaagtaagaaaaaacagtattgctctttctgagtaactcattgagattaaaatctgtctctgaggcttctgtaacaagcaagtttttctcttcacagaagcatttcaggggcctgaggctaatgctccgcaaaggatagg

SEQ ID NO: 115656 - DNA, 587 bp, Homo sapiens
catcctcagttggtggggtggatcttgattcaattcagatatgcctttcaagctggccctgctgagctgggccggaaaggcacttggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtagggaggtgactcacccgcgagtgtctcacctgtccaaagtgtgtgtcacctgctctgtgttcacccactgggttcatcagaggggcacttgaacaaaacaggaatgtcactggagaggggaacatgtgctgtccccaagtccttccctgccgtttagagtaacacgaggccctgtccgcatatcctcacccccatctggcctcgtgtgtgtgccagaattatcaggaatctctccattctaatttcagccattctctgtgaagatgaaaggttaggggcggggagtggacaccctattgaaatagaaatggttcttcatatgtcagaaacagtccagagtaatctgggagt

SEQ ID NO: 115657 - DNA, 600 bp, Homo sapiens
tggtgggatggagtggtctcagatgtgtctgggacatctggggtgcagaatctgtatttctgggccccctctccagtcatcatcctggagccgatgaaggcaggggcttcctcccatgtgcattttgggagtctgttctgccctgtctcaggtaacccccaagagggaggagtctctccgtatagaaggaggaaacctgccagggtggcggggtgcggtccaggccacagcctggctgctgaggcccacccacaaaggacagagctgaggagctgatgggcatggagtttgattcgtgtgtcgtgtttcataaatgctgagcagactaccccaggggaagcccgtttccaggacaacctcagaaggggaaggagccatgagggcggctgtgtcggattttagctctatggacgcagtggccccgagacggtccccacacacagcctggtccccacacacaggctggcaggacagaggctggttgctgccctgtcgtatatatggtgcttctgggtcctctgggccttcatggtgaagaagagaagtattgtgtgctgagtcactcaggccagtggcagatgcccatccaagagccaccca

SEQ ID NO: 115658 - DNA, 515 bp, Homo sapiens
gctgtgatcgcaccactgcactccagcctgggcaagacagtgagaccttgtttatgtacatatatatctatatttattttcattcttacaaaacgatattgcaaaacttttacgtctgcagtgattgaaatttcactcaagcattgcagacttgtattttctatattcaatatcctacagcttctttgatagcaaatggcaaagtaaaattgttagactatccaaggagacacaggtagatgtaaatttgatccttgtttctcagtgaggctgataacaatgttgatgaggtttggtttggttttcaacaatcgcattcttattaccatcattttgtgtgaccatggtagttgaagaggaaacttaaacaaatggaagattgtgatggctcctttaagttttgtaataataatatgctgagataagatgtctttaaggttcaagggttctataatgctgatgtgttctactagtgtgccttccatcaaggagctaatttccttgccttcagtgaa

SEQ ID NO: 115659 - DNA, 388 bp, Homo sapiens
atggagcccaagagagatcccaccacaatcaactctagggattaaataaattctcttggcttgctggaatcttacattaaatattcttggaaataagtaggccataggctaatgctaagaaatctttcataataaagatattcaggttgtaatgtaactgtcattataggatttgacctgaatagaaagaggaactaaacagagctttctcaacagagctctttgaggatggagcgtgctgaatccccagggggaaagagcagctctttcacggaactttaaagatgcccacctctcctataagaagttcttgctgtgaaaaccagagagaaaaaacgctcctgggacgtaaaaaagtacacggacttcagattcaaaggatttagag

SEQ ID NO: 115660 - DNA, 574 bp, Homo sapiens
gtttagatgggaagtggatgggtctgaggaatttgaacaaacaccgacagtgaaggagagtgacctgagcaagcagtagtggggtaaatggaaatagacaaaatgggaatcagcagagatatggaggacagaatacaatgaggaggccttgaccgtcagtagcagagagggcagcagaagcctaattcccaaattccttagatggttttctgatttccaaattagtttcccttttaaatttattgtgtcaggttcagcttatgaggcctcaatacttttcagtcttaattgtatattgaaaatactttttgtttactaaatgctttttacattaattcagtgtgcacttcgtaaggataatgatgatttgagttagtttagtattcaacagcttcctctattcctttatatgatctctgtatttaatagctgtggcataaagtttccaactaagtataagtatcaagttttctttgtgatgttttctgcaaatattgaaggatgacctggattgtcctagaactttgttccaacagattacatgtgttcataacgaataaattgctcaaagata

SEQ ID NO: 115661 - DNA, 365 bp, Homo sapiens
gcaaagcccattgccactgcagaagaacgttcgtgaatgttaatgctttgtgtgtttttggaaagttggcaaattttatttatttatttatttactttatttatcttttgagacggagtctcactcctctgacggagtcttaccctgacggagtctcactctgtcgccaggctggagtgcagtggcgcgatcttggctcactgcaacctccaccgctgggttcacgccattctcctgcctcagcctcccgagtagctgggactacaggcacctgccaccgcacccggctaatttgtgtttttagtagagacagggtttcactgtgttagccaggatggtctcgatctcctgaccttgtgatctgc

SEQ ID NO: 115662 - DNA, 178 bp, Homo sapiens
ggcgctggtcgtttggggagcgggcgcagggacaagggtgctgtggtgtctggtaggttggaaatgcctttgctaaaaaggaaaagcctccctttaagctagacccggtgggcactcacccccttcctttcgtgggactttcattctcccacgaaagggctgcggtattttcttcttt

SEQ ID NO: 115663 - DNA, 368 bp, Homo sapiens
aactatatttgctgattgtattattaaattaatattttctgatagtctacttatttcttatgctgtatatttgaaagcagtacaaagtcgagtatacccgaaacaaattgaatgttttgcctagatttctttttttcctcccctcatatactgttttgccttaagaaattgttttcttggcatgaaatcactaatcagaaattccagtcaattctaaagtgacattctccccacatgctattggtgttaactataattaatcccaacagctgttgtcttcttttatgtgtgacatttgtcaagaagtcatcctcgtagtgtcagctaattattttgtatccggactgttttattcaaactagaaaata

SEQ ID NO: 115664 - DNA, 320 bp, Homo sapiens
tcactcggacctgactatcctagaaatcgctgtccctaagtcagagcaggcctggctctgaacttaggccctgtctttgctctctgctgtttccagacatctaggctatatctgtcttttcagagatctgggtgggatgaaactgaagctggtcattagggcagtgtcccataaagctggggaagctggttgtacactcctgtctcctccctgtatgtaggacacaagatccaagatccaagttgctgtttcataatgagcagtaccagctatggggacggggtgatgcaagcaaaatgaaactgtttttcctactcgtt

SEQ ID NO: 115665 - DNA, 295 bp, Homo sapiens
tccctggattcacatttggctggattgtcaggaaaaatatgtgttctgggtgccacctgatcttttcatctagcttctgtcctcaggtaaacattccctgttaaaattctaaatgttcatctgcttcctctaaagagattggtaaaaaggcataaaacacctaagaatcagtgttacttgtaatgagcccagggctgccgcagggagcaccatatacatagaataccaggtgagtgagtggggccctcagggctgaagtattatgctctaggccagaaaaaggatattttctttt

SEQ ID NO: 115666 - DNA, 360 bp, Homo sapiens
gtccaatttccctgacagggctcaagcagccttaaaagcagccgccgccattctccgacaattcgctctatcagctatcccaatcataggttctgtgggcacaataacctccttctcttcgcctccactcctttgtatctcccatcctgtcgggctagtcggggccccgactagcccgacagggaggaggcagggagggcaaatctgcactgcacaggaggcgtcactccacagtcacggtaggagcagatgggatgaaggagtcgtctgctttttggtttcgtatcaaagcaagcgggtcaatgccatatatccacgggtgcaagctggttgacaacggagctgtcgggctagtcgggg

SEQ ID NO: 115667 - DNA, 367 bp, Homo sapiens
cgcaagggtgttagttctctgaatggctcatcctggccgtgtccactcccgtgaggccttgtgtgtcagtgtagggtggtgtatgggcccatcctggcttatttttcattccagaccatcagccagggataggacacagattctttgctccatgactggaaagagtaacaacactttgcccttggagaatgtgttcacttccacaggcctctacatctggttcttttacctctgtgttctcttacaacctgctttgcaggtagaggggtgagcattgcactcacattcctctctggggaaaccaacacagggctggtcacccagtaggaggtaaaatcagggcagatggcaagtctccatatgacaa

SEQ ID NO: 115668 - DNA, 373 bp, Homo sapiens
aaggaatatttgttaactaggtttcaatacaaaactgtgtttaaattcaagcatgcctctgcatggatgctcactgcacacagttggtggatcgtccagagagggcagagaatagtaagatacagaaccattgcaacgatcaccaggcacccatcagcgtgggtcccgcatgacagaacagtgcagtgcagtggttaaaggcactgactctgaagtcaggctgcctgggttgaaatcctggctctgcagctccatagttcttaaaccaaggtaaatccaaacttcacaactctgtatttccctcacttcaaaaattatttctcctatagtcttttccatcttcctaagtaataagcctagaagtaagtcatcc

SEQ ID NO: 115669 - DNA, 373 bp, Homo sapiens
gccgggggtcccgggacagcggcctcctcggcgcaggaaggtcccgccccaggccctgcagcgcgggaggtcaaggtccccaaggggacctgcttcctccatctcaaaccgccctggcgtcccccgggtgcctcccaggcccccagagggagctcagaaagcccagaccccacggcccgcccctctccctgctctgagctggaggcagagtccgggtctgcggggccggccctccctgtatccctgtgagagggtcggggacccggggcgtctgtctggcttcccccagccctgctctcagctccctgggagcgcaggatttggactcgcggactagctttcggagccacctaaaggaaatctcaggcggccc

SEQ ID NO: 115670 - DNA, 644 bp, Homo sapiens
cgcagtggctcacatctgtaatcccagcactttgggaggccaaggagggtggatcacctgaggtcaggagagttcaagaccagcctgaccaacatggagaaaccccgtctctactaaaaatacaaaattagccgggcgtggtggcacacgcctgtaatcccagctactaaggagggtgaggcaggagaatcgcttgaacctgggcggtggaggttgccgtgagccgagatcacgccactgccctccaacctgggcaacaagagcgaaactccgtctcaaaaaataaataaataaataaatcgagtcttttgttcagaaagcatttcccaaagcgacaggccattagatcatgtagcgcccaggaaatagatacttacgttacaagctatgttgaagtcctgcacgccccggcttggatgtacaatgaggagtctgtgtgcctggctgcctggccagcccagcccgagcctcctaccttctgaaaatacacttgctggacatagcagagaaagctggtacatctccagcccttcagggcttcttgggacacactgttctggggaaaaccctttcatcaaaaggcatgtggggggctcacaaggaggtgaaggagtgaataggatgtgcctggcctttaatgaccc

SEQ ID NO: 115671 - DNA, 555 bp, Homo sapiens
ctaaggcagttttgtaaattggtgtgggggcagcaagtacaagactccaagcatcccctctggtggttggcagaggatttcagtctgctgggctgacgaagtggagaggctgccctgggcttcaaactggacctggtactacctccaaccctgtggatgtttgctcctgtagcatatggcccaatgcacctgattgccttagttttccatggaaaagacaagaaggtggttttcactcctctaccatgtttattcagcctcgttaactccactgagtttgctctgataggccagaaaaaaaataagttatggttaaggtgtaatgtgtccagaagtgcccaaattgttgttttttgccaggatggggaagtccactgagatgtaaagatctaagctgagattgacctttgaatcttttcaacaggtattcattgaatctataggaagtctggtactatgtgaggttttagggatgggtttggagctgaacagagaaaaaaagaagtaaaagaaataatccctgttcacaggagttagtgtgtgagacagagatat

SEQ ID NO: 115672 - DNA, 161 bp, Homo sapiens
aggtagtgaaaattgccaagtttcttcagctttcctagtgtgactcatctccaggagagtaggaagcaggtgggtctgaacacagaaatccacacgacttgcttctgccctctgcacagaagcgcgttctttatgccaggacctcattcccttccacacag

SEQ ID NO: 115673 - DNA, 190 bp, Homo sapiens
gtttatctgtaggttcaatgcaatcttgatcaaaatccccataaactttttttgggggaaggaaggggtaattgacaagttgattcttatttcatatggaaatgcacagggattcaaggttgcagtgacccctgtttgcaccactgcactccagcctgggagacagagtgagaccttgtctcaaaaaaga

SEQ ID NO: 115674 - DNA, 1434 bp, Homo sapiens
agggagagagggtcgtcacttcctgtcactaggactacagtttgtagtctctctcagggagagagactacaaactgtagttaaaaaaatcagaggtggaggtcagggggttaggtccagaagaaaacctctctggagcccaccctgcatctctacgtcttggaagagtctggagtccaggcaccctacagcaccccccacagcaatcatccgtgctcccacccccaccccggcctctgggaggctctgaggcaacagtgggggcctgtggggtggggtgggattgagagaccagctgcagagacatctttgtgacccaggagcaccactggtccctcatctgccaccgaggccaaggaagacccagagacctgcctcaccagtgctgccgttgtgctgaaagacaaccatgaatgctgattttctgctgccgtattatacggcccagagtggctccagcatgagcatgttcaacaccaccatggggaaactgcagcgacaactgtacaagggggagtacgatatattcaagtatgcaccgatatttgagagcgactttatccagatcaccaaaaggggagaagtgattgatgtgcacaaccgtgtccgtatggtgaccatgggcattgcacgtaccagccccatcctcccactcccagatgtcatgctactggcacgaccggccaccggctgcgaagagtatgctggacatggccaggccaccaagagaaaaaaacgcaaggcagcaaagaacttagagctcaccaggcttctgcccctgaggtttgtacggatctctgttcaagaccatgagaaacaacagctgcgcctgaagttcgccactggcagatcttgctatctgcaattgtgtcccgctcttgacacacgggatgacctctttgcctattgggaaaaactaatttacctcttgcggccacccatggagagtaacagcagtacctgtggcattccagctgaagacatgatgtggatgcctgtgtttcaggaagacaggaggagcctgggagccgtgaaccttcaaggaaagggggatcaggaccaggtcagcatccaaagcctccacatggtctctgaggtgtgtggggccacctctgctgcttatgctggaggggagggactccaaaatgactttaacaaacccactaatgtgctcaatgcatccatccccaaaacatctacagaacttgctgaggagccagcaacaggggggattaaagaggcagcagcagcaggggcagctgcaggggcagcaacaggcaccgtagcaggtgccttgagtgtggcagcagccaattctgcccctggacaggtgagcgcagccatagctggggcggccaccatcggtgcaggaggaaacaaaggcaacatggcccttgcaggcactgccagcatggctccaaacagcacgaaggtg

SEQ ID NO: 115675 - DNA, 637 bp, Homo sapiens
actattaaaatgacttatcaaatatatatttttctatttttaactctgaaatttgtttgatatttattgatatgatggagtgatgcttgggatgcctgcgacccagccagcaatggaaaatagtttaggattggccctagttcttagattagactctggtctcttttgaaaaggttgtgaaatcagtggaaatagggtatataaatatatttttatatcatctttattctgtgatgatatatcattagcattaatccctgtatgatagtttaatagaagcactttgtaaataatggttttataaaattaatgtagtaatgagaatattacattttaccattttacaaattacctacatgaagattaaagaagtaacttgcgaaagaaattcagctagctagtgtagaacagagatccgactccagttcagaatctacatctgactcctagtctagtgccttttttatatttttatttttaagtactttaaatataaatgtacgtgtctaagagaataaacaaaccatagtgatgtttcacatggatttttcttttgatatagcttataatgttacagtgttactgttaacagtattaaccattaattaactggtatgtgcctttgaaacttttgtat

SEQ ID NO: 115676 - DNA, 193 bp, Homo sapiens
agtacagaggaaaaagcagccagccccacctgcaggagcctagaaagtagtagcatttgatccaggcttcagaagaggcaaagcagggcagtccattggatgagagggggcccatgtgcaaagtccctcccaaaagcagtcgtttgagcatgtgtggcaagagcagagatgacaagaagaacgggaggcagta

SEQ ID NO: 115677 - DNA, 1259 bp, Homo sapiens
  misc_feature (490)..(490): n is a, c, g, or t
  misc_feature (555)..(555): n is a, c, g, or t
  misc_feature (558)..(558): n is a, c, g, or t
  misc_feature (1050)..(1050): n is a, c, g, or t
agactaagggatttgcccaaagcagcctgacagcaaggggcagacccagagatagaaccgcaccctgcactgcgtacacttcctccccacctccctggccaggatggggatgggaaagaaggtgtgcgttctttttgtttgaacatctacgtggcagtgggttagagttgattttaggagagaagttacgtataagggaggctttgtcctcagtatctcttcggggtacagttgttgaaaagaggttgaatattaagagcccaagtcccgtttccccaaaaatcccccccagcactggtgaatgacaggcagtccttctcttttagcaccttgtttcactcctgcctccaaagcctgcctcatgtctcggccttcctgatgacagaatgatcatccctgtatgcaacaagcttccccccacaccagtgttcatcagtctgtcgtctgcaccttggtttctcaaggtatcatcagggattggccgatgganatgaaatgagcccctgtgtcctcgctcctgcatcactgacgttgccgtgggctattgagttgganaanacattgggcttccctgtcctggcttccataaggggcagagctctactgcaggtcctggtcttgcctgcaggtcaagggccacctcaccctgagttcaagcaggctcttccccaggatgggggtgccgccttgttcctgaacatcctgggctggctctcatcccagcctcaaaaccagcctgtttcttttatcttgctggccttgatttatagtaactgccagacaccactaattgacagttcctggtccggcctcctgcctctgcccagcaggatagagtctattcagcaattgcagagtgtcatggaatcaggggtcagaggatggcagagctggaaccactcgttctagtgaaaagaaagccatccaaccaaaggaagtgatttgacaaagttccagttagtaaaagagcccaccctggaacctggatctcctggctcctactcagggctctttccattactcaaagtagccaggctcactgggtgagangactgcttagaatcacgtctagaaggctctcccctgcccatcagggtttccggtcttctgttgttagtggtgacatttctggtgcccttcaaatgctgtgcatgcaagaatcgctagaacccaggagacggaggttgcagtgagccgagatcacgccactgcactccagcctgggcaacagagagagaccttgtctcaaaaaaaaaaaa

SEQ ID NO: 115678 - DNA, 440 bp, Homo sapiens
tgatggagtctcgctgtgtcacgcaggctggagtgcagtagtgcgatctcagctaactgcaacctccgcctcccgggtccaacagattctcatgtctcagcctccccagtagctgggattataggtgcaaggcaccacacccagctaattttttgtatttttagtagagatggggtttcaccgtgttggccaggctcgtctcaaactcctgacctcaagtgatccacccacctcggcctcccaaagtgctgggattacaggcatgagccatggtgcccagccaccttagaatgtttctctggctatttcacatgtgatttttcacagttaaaatttctttcttcaaggtcaaggccttcagtatactaaaacaacttaatatgatgttttgcaaggcataattagtgtttgcccaataaaattaatacatagtctgtaat

SEQ ID NO: 115679 - DNA, 436 bp, Homo sapiens
ataactaaatgacggggtgctgcccctggaaattacacccagacatctcttttctcgtagacctgggcccctagcttttagacaggatgacaaatcactgacaggtgctgactttacatgcactgtggcctcatgcttcagccattcactgccaggcagtcttctagggcagcaaagagctcagccacacagcccgggccacagtcaggatgagacctggcgttagacctcccctcagcgccgctcaccccccattctgggcatttcaatctccaacaggagatttaaatgaagaaaacacgcacctcacacagctgtaaagggaggaactgggaatttctcccaaatcttgacccttgagttctagaaatggggttctccctggaatgcatgatggcattattctggaaggcaaaaataaagctatttaatatag

SEQ ID NO: 115680 - DNA, 327 bp, Homo sapiens
caagcagtcctcctgcctcagcctcctaaatttctgggattacaggcatgatccgtgatggctgtccagtttctagtatctttatatgtgaaaatggggctgatgatacatacccaacctatctcaaagggcatcttgagaagatggagagagaatcatgtgaaaaagcactttgaaaattgtaaaactccctacaaatgtaagatattgttaatgaccttacaaaaaccacctttttaaaatgatttggaatcatagactctaaaagttgattctagtggtctagtccaaattcttagctactgaaaaaaacccttttccataatt

SEQ ID NO: 115681 - DNA, 369 bp, Homo sapiens
aaacaagggtttgacccctttctgaaatatatttctctgaagacctgtaccctcagtgatatgggaggctcattttagaccattgggcacttttgtctccggaccacaatttgccctttgtgacctgctctactaagaaattcaagtgtaattcaaattagtttaccatctgctgatcaggggagattgctctgggtgcaagttcaagacaggcactcacatcttcattcgtaccccaaatctcagcatcacacaatacatccatgtaataaacctgcacaggtaccctccagaatctaaaatgaaagttgaaattcattaaaattttaatttcatcttattacaaaacaaagatacatttacttcttt

SEQ ID NO: 115682 - DNA, 315 bp, Homo sapiens
ttgaaccctggcacctctgacaacaaagtccatgttctttttactatgccctaatacctttcatcagttatccacattgatgctacatctgtattttataggtaccctatgttaggtgttctgggggatagaaaagaaataagcaggccaggctcagtggctcatgcctgtaatcctagcattttgggaggctgaggcagcagagctgcctgagccccagggttcaagactgcagtgagctatgatggcaccactgcattctagcctgggtgacagagcaagactctgtctaaaataaaaaaagagaaaagaaaa

SEQ ID NO: 115683 - DNA, 349 bp, Homo sapiens
gctgcagtgggctatgactgtgccattgtactccagcctgggcgacagaacaagatcctgtctcaaagaaaatgcagtgaagagggaggaaaagaggccctttctgctacaaaatgcaatctaggggaaccaagagataggatgaagaaagaaagggagggaagacttagcaggagataaggctgtggggtagggtgagcaaaagaaggcttccccaggtctctcccaagcactcaggtccagtattcacagcctgaaaatgggaaacgttattcaagatgcaaccgcaaagcttgggcaaggggcaaatgaatgatgtctctccagcccaaccagttatccccgccag

SEQ ID NO: 115684 - DNA, 288 bp, Homo sapiens
caggaggaagacgtcggccggccggggacccgggctttgtgtttgggaaatgggagcagcacttattagaaatggggaaggacagccgtgtggcgggaggagcaagcccgttttctgtctgttcacaggagatgcaggggcgcctgtaagagaggctgcagccccaagcggtggcacacacctgtggtcccagcatttggggacaaggctgaggtgcaaggatggctcgagcccaggagtttgagaccagcctaggcaacatagtgaggccccgtctcttaaaaaaaa

SEQ ID NO: 115685 - DNA, 462 bp, Homo sapiens
ggagagcaggagcagctgtgtggggagggaggagccagcctggatttatagctctactgggagaaggctcggagacaagaaaccttcctcaatctcagtgagaggaggtgtgcattttacaagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgatttactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttacc

SEQ ID NO: 115686 - DNA, 374 bp, Homo sapiens
gtgccatgatctatatccatgaagggtgaggtggttcagcctgcttgtccaggcaaacagttgctccaaatgcctggatttttgccagggagtagagcagagagggccctgctgcaccacaggggaacaggctgtggcaaccaatcatggcacatgcagaccagttccaggttgctaagctggatctggcttgaagtctggttgtccaggagaaacaatagctgtagcagctcttctctcatccttgacctgcagtggaggagagcacaatcccagcacctactgctgaggcactaactacagtgtggctgtgaagacctctgtcctgctccagagccagaagcctatgtggccatgctactgggttgccaaag

SEQ ID NO: 115687 - DNA, 398 bp, Homo sapiens
acatccttaccgtgagttatttttcatgctgcagccatgtatctttttaaaacctgcatcagatcaccttgttcccatgcctgaaaacttccaatggtagtgcccactctgcttcaaagaaactctagttccctccccatgcccacgatgccctgcaatcccaacactgaccgttctcatctcatctctttccatctgcttcctgctcactccagcccagtagctctgaacattcttcttcctcttccagatcatgactaagtatttctctcaacttactttgttctttttctgttttattctatgcttttctctcaggctaaaataaactttagtttaaaagtctcttgcattcttagttaagtgattttttctggtaatattgtaaccacatcgca

SEQ ID NO: 115688 - DNA, 115 bp, Homo sapiens
cctgtgagtcgctcttggacggcctggctcctatgctatgtactcctcgtccggggacctatgtccaccttgaacttctaagtttctttccttaaaccttatgagccaagcggtg

SEQ ID NO: 115689 - DNA, 176 bp, Homo sapiens
ctggctctccgtgcacagtttttgtgttccacccaaaaagcgtggcagcgactttccttacccccactttagagatgaggaaactgtccttagagaggtgacgtttattgcccaaagacacagagctagttaatgctagagcgtggtttatagcattgaagcagttccagctctgt

SEQ ID NO: 115690 - DNA, 269 bp, Homo sapiens
caaactcttctatctcaagttttcacacacatcacagtgcctagaagaaagagactggataccctgaggtgggcaccagaggttgacaggggaacagccaattcaggcatcttaatgcaatattaagatcagaaatagtacccaaatttctggcaaggtgccctatttagctgattaatctgggctgatagactggctgtgcctcacactctatctagaaacatctcaactaagctgtcttttttaaggagtccctggacaacccccgc

SEQ ID NO: 115691 - DNA, 832 bp, Homo sapiens
aacctccctttgttcaggacataacagtacaggtgagccaaatatagaagaatctaccccatagcagttagtactgtattcacattgcaccagactatgttggaagagttccatccttgaacatatttgttcaaaagttatgagggggtagcaaatgctttttcctcagccaacgccagcaacaatatgatttgatacccatcagtaaagctttaagtttatcctcaagccaacaagaaaactttgcttagttacaggtgacacttcatttaaaatggcatcttactctcgagtagaatatttagataaataagagatccaaataaccttaactagcacaaagaaccttgaagtcattaaatactttcttggctgatatatttatgaaaatgggcattctctacattggaattattaaagtcaaaattctgaaacactgaatatagcacaggacctgagataaactatttctatgagtacacccaatactgaaattttaattgttacagaaaagcataatattccctatacatttatattgttaatttaaatttattagtttcatagtttcaaaattcaatttataaatttttcttaatcatcttataagaacaataacttacagccttcttctctggtttatatatatttttaaagcataaaaataacatattttcatacttggaaactgagataattctttctgttaaaaataagtccaggcacaaagaggggaacgacactggggcctccttgagggcagagtttgggaggagggagaagatcagaaaaagtaactattgagtactaggcttagcacctgggttacaaa

SEQ ID NO: 115692 - DNA, 772 bp, Homo sapiens
  misc_feature (17)..(17): n is a, c, g, or t
aacagacagttcacagnaagagaaatacaaatgactagtaaacatgaatcagcgaaatgcaaattcaaacaagcaactttttttcaaccatagattgggtcaaccttaaacacaagttgaaacaagatacccatttttttgcccatcaaagtggccagaatgtaaaagattaataatgccaattattaatgagggtgaggaagacaggtactttccttcgttattggtgggaatgtaaatgaacccatcttttttagaaggcaacttggcagtatctacaaaatgtaaaacgcacatacctctcagttccatcacagtgccttctgtatgccctctcatcaggcttacaaggaggagagtgcaaaagcagccatatctcctaagggccaggcctaaattggcatggcagtccttctgccaccttctgtaagcccagagaagccacaggccagtccagatcacaaggagggaatctagctcccggcagaagaatggaataagtggaattattggccgctacattttcgaactaccacatagatagaaaaagcatattccttcgtgtaccattttagcagcatttcttcagtatttatatgtttatataaatttcaaaatattctattgttttagtccatatttccttcctgacctaaaccatgtgactgggcacctattcagttttttgtttttaaatttttttcttgtggtctgtggataagttatataaacaaacaactacacattgaaccccaccatagtaaatgcagtc

SEQ ID NO: 115693 - DNA, 373 bp, Homo sapiens
gaaaacagattattttgttttcaagaaggctgtatctaggacaaaaataagccagtatctctcagtaactaaacagcatgtaggatctaacaaccggggactattactgaaataggtaagacgtatatggggacaaagggaggggagagaatttaaaaaggtaggaagcttcttttatttgaaaatataaaataaatcaagaaagacgtggtgtggaacttgagattttaaaaggcattaaggactattccacacatatattcttatacagatatgtgcatatgtttgtatacaggatgtatatatacacaccgtgtttttatgttctattatattatacatatgtgtatgtatatttgtaattttatgtttt

SEQ ID NO: 115694 - DNA, 297 bp, Homo sapiens
gttttgcatagattatctctaaattatattaaaacccctgcaaggtaggtatttttatttccattttaatgatgaggaaacagaagcttaaggtgacatggctagtaaattacaaaatcaggcctagggtctgcttgcttctgaaagcatctacaattttcattctgccaggctgttaaactgccaaaatttgccttagtttattcttccagtcctgctttctcctatcaactcttatgtctttccagccaaaaacccaattggctatcatctacatttctgtctttaaaaatcatc

SEQ ID NO: 115695 - DNA, 235 bp, Homo sapiens
acatggtaataaagagtatttaatctatattgataacttgtcttatatatagtctactaacttcgaagtgcaaccgtttatcacagtttttctgtattacagtattagataatagttgttttatgcagtaagccaaagtaggctgtatgtaatgtttgattctgtttgattgtttttgtttgctttggcaaagaatgttaaattttgctattccatatagatgcaaatattttcc

SEQ ID NO: 115696 - DNA, 406 bp, Homo sapiens
aggccaagggaaagtcttccctacagccttcaaaaggagtgtggcccagatgacatcttgatctcagacttctagcctccaaaactgtgaataacctaagttcagagccaggcctggctctgaacttaggacactttcattaatactttgagtgtgaatcaatagtaatatcaacaataatgtgtagcagaggtaccattacataaataatagtatattaattactagcatttatttgacactacgtaccagacattaatgtccattttcccccatagcagccacagtgatttttcaaaagtataaatcagatcatgccatccctttaaaaatcctcatggacttactttgcacttaaaatgaaacctgaacttttcaccatgtgctaaaggccttgattctctca

SEQ ID NO: 115697 - DNA, 309 bp, Homo sapiens
agcaaatactaaaaacttgtgtttataaatttgacaagtgagaaggatgaaccagtccttcagaaaccataaataactaaaattcaactaaaataaaaatagactatctgggccaggtgtggcagctcacccctgtaatcccagcactttgggaggctgaggtgggcagatcacttgaggtcaggtgttgataccagcctggccaacatggtgaaactccacctctattaaaaatacaaaaatttacctagcatggtgacaagtgcctggattcccagctattctggaggttgagacaggagaatcgct

SEQ ID NO: 115698 - DNA, 194 bp, Homo sapiens
aacatagggagaccttatctctacaaaaaaaaattaaaattaaaattagccaggtgtagcggtgtgtgcctgtagtcccagctgctctggatgctgggtacttgagcccgggggtggggatggggacgagaggggatgtcttgaggctgggttgagctgtgattgcgccactgcactccagcctgggcgacaca

SEQ ID NO: 115699 - DNA, 506 bp, Homo sapiens
gctgggatcataggcatgagctgcagcacctggccctattttctttattttatagttgaggaaactgaggctcagcgagtccaagtacatgtgactaatgggtgtagctggagatccctatcggagaaggggcagataaaatatctgttcagaggaggaggagacagcttttgttttatggggacgggagataaaaaggtcagagaagtctttagggtggaatgtgacttgggactcaagggtagataggattttaagatacggaacatgggagagagctttgcgggggtggggaggagaatataggaatcaatcactgatccttccctcgcccttgtgttctctcttcacttagaatggagtcagtgggcaggaagatggtgattacctgtccgttgaccctccctatctagacacatgacttccacgtgacataaatgtgactgcagtcaggaaaaattcaactcggactgtgctgtgttgagtaatcagagggagaagcagtg

SEQ ID NO: 115700 - DNA, 374 bp, Homo sapiens
gagcaaaataaatcacaattatacaactcaagaaaaggtgaaataactcaaaagaatagaagtaaaaggaaaaattcattttagaaatgaatacaaattagaaggctcacaagagtgattaaatataacaaataatgccttagagtaaataaaaggttttaaaaagggtaaaattttttaaaaccataaagaatgaagaaagtgacatcagcaaaatgccagagtaggcagctccaagctccccatagaaacactgaaaaacaagcagaaactatcagaaccaactttgttaaaagtctcgaaaacagtcaaaggtttacagcacccaagtaaacgctgaatcaagaaaaaggcaattaaaatataggaaagct

SEQ ID NO: 115701 - DNA, 323 bp, Homo sapiens
ggaggggggacatttaatttaactatagtgccaggtctctttaaaagatattgattaattccaattagtttggccttaaacatgaaaaaaatttagtctagggacattaccaaaagtattattttcttacacatgttctcagtaagtcttagtaaaacatttcaaatgaagacctaactctgaagtctggaatatttgttgacattattgtcaacattattgttctgatcacagagtgtctcctggagaataaccagctaaaaatatgtgtttgtgtgtgtgtgtgggtgtgtgggtgtgtgggtgtgtatacatatagaacc

SEQ ID NO: 115702 - DNA, 266 bp, Homo sapiens
ttagtttgtataaaagcaaataaaaccattttggctctgtctcctgatgctcttttacacattattttaaaacaccactatgagttcaattaaactcatagaacagaagaacagctctaagaggtcaatgattcaaagcaaaacaattcttaaatatgatgctttaatcatcaggtaggaataaataaatgctataagaaaagccatcaacctaaagaatccattcaaacctaatttggattaaaactttgaaaagatgttacaag

SEQ ID NO: 115703 - DNA, 365 bp, Homo sapiens
ctctgttgttggatgaggactctcgttccttcatcaaaatccccagctctggcttctgggcagatgcctgtcccagccctttccagcctctccatggccttgggaagacttctctgggtggttctcattggtctccatcccccaggacctgaggcccatggggaatcttggcctcgtcagaagtggagaatgcagtgtcagcatgacacctccggggcatggaggctcgcgccagggctgcacctagctgcctcttctcctggcctatgtcccaaccctggagaatgctgccctcagaagcctgggaccttccagccctggagtagcctagtctgataagtctcaacaataaaccctgacttttg

SEQ ID NO: 115704 - DNA, 3463 bp, Homo sapiens
agcaatcatctggggggctaaatgtgacaaaccgagaagatggccaagatcaacacccaatactcccacccctccaggacccacctcaaggtaaagacctcagaccgagatctcaatcgcgctgaaaatggcctcagcagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaagcgcctggcccctggccaaatgcaacactaacaccagcaacaacacggaggaggagaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtcacctttctcctgtccaacttcaccaccacctgataatgggtatataacaggaagctgaaggtacaacatagtgactaaaattcagacttacacaagacagtttgaggcatatttcttaatctggtatcacctcgtgtgttctttggggccctagaaaccctggcttttgggagtgctatggcaagtagaagttctgccggatggaaagaggctgccccatttgaggtcatttaaaatctgtgaagcaaatccagactccttgccgttcagccactgtgaaaccagaatctgcttcacagaaaaaagcatctcagttaggagaagagacatcccctccttctcacttgccaaagagattcaaagacagcccctatcctccattcttgagtcagggccctaggtgacctattctaactcaaggaggagagctatgtacagggagagcattttagattgaaggttggaatggtgtactaaaccaaaaaagctgacaactgagagttttagaagattagaccattaggaacgtatctttgcaaactgcccattcacccatgaagaggaagcctcaagatcccttggaattgcatcccaaggcaaagcttttggctcaccgaaagctcacagattgcagaaattagcttttttaaaaaacaaaccccagtaaatataatttcattaacattttataacagatttatatttttgagttccgtgattgcaaattatgacctcaaattccatccttcacttatgtaacatgttgcaaattacccaaagatgagtctttcttctttctttcctttttcctttcttcttcctttccttttttctttcttcttccttctttcttcctttttctctctcctcttttcctcctcaaaatgtatatattttaaaagccttaactgttagttatgcctgcattcatatttgcacaggaaaaataaagacctggattt

SEQ ID NO: 115705 - DNA, 3777 bp, Homo sapiens
aaatcaattctgcttgctgcatatctgatttcctagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaaggaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtcacctttctcctgtccaacttcaccaccacctgataatgggtatataacaggaagctgaaggtacaacatagtgactaaaattcagacttacacaagacagtttgaggcatatttcttaatctggtatcacctcgtgtgttctttggggccctagaaaccctggcttttgggagtgctatggcaagtagaagttctgccggatggaaagaggctgccccatttgaggtcatttaaaatctgtgaagcaaatccagactccttgccgttcagccactgtgaaaccagaatctgcttcacagaaaaaagcatctcagttaggagaagagacatcccctccttctcacttgccaaagagattcaaagacagcccctatcctccattcttgagtcagggccctaggtgacctattctaactcaaggaggagagctatgtacagggagagcattttagattgaaggttggaatggtgtactaaaccaaaaaagctgacaactgagagttttagaagattagaccattaggaacgtatctttgcaaactgcccattcacccatgaagaggaagcctcaagatcccttggaattgcatcccaaggcaaagcttttggctcaccgaaagctcacagattgcagaaattagcttttttaaaaaacaaaccccagtaaatataatttcattaacattttataacagatttatatttttgagttccgtgattgcaaattatgacctcaaattccatccttcacttatgtaacatgttgcaaattacccaaagatgagtctttcttctttctttcctttttcctttcttcttcctttccttttttctttcttcttccttctttcttcctttttctctctcctcttttcctcctcaaaatgtatatattttaaaagccttaactgttagttatgcctgcattcatatttgcacaggaaaaataaagacctggatttaaaaataggaatgactcttgcttcagctcttgccataaaggaagtttcagtcccagagtatgtttctagggcaatggcttccctagaaaggataggtgctgatgtgggggacggcacacattccaagaaagtgacaaagccaagtgctgttaagggcacaaaccaacaagaactctcattcattgctggtgggcatgcaatattgcaatatgcaatatggaagacaatttggtagtttttataaagttaggcatatgctttagcatatgacccagcaatcacaccctaggtatttacctaaaagaatttgaaacttatatgcacataaaaacatgtatataaatgttggtagcagctttattcattattaacaaaaatctggaagcagtaataatatcattcaataagtgaatggatagataaacagtcaggcgaggtggcgtgtgcctataatcccagctactaaggaggc

SEQ ID NO: 115706 - DNA, 1887 bp, Homo sapiens
  misc_feature (348)..(348): n is a, c, g, or t
  misc_feature (476)..(476): n is a, c, g, or t
  misc_feature (482)..(482): n is a, c, g, or t
  misc_feature (659)..(659): n is a, c, g, or t
  misc_feature (982)..(982): n is a, c, g, or t
  misc_feature (1073)..(1073): n is a, c, g, or t
  misc_feature (1217)..(1217): n is a, c, g, or t
gataactaaattgaaagtgctggcagtccatttggggattgattagaatctaggggagatgtagttgtcagtgttcattctgtatgtaactcctgtctttggtttcagatctggttaggttctgttgatccttggggaactttctcatttgtttttatttttgccttggatctatgaatacctgaatgtattgtctaaaatggaaaaatcttaatgtagccattctattactatcactgaccctaggcctgaaaaaagtcacacctagggttaagaaatttttattttattttattttatttacttatttagagacagtttccctcttttgcccaggctggagtgcantggcatgatcccagttcactgtaacctctgcctcccaggctcaagtgattctttagcctcaagcctcctgagtagctgggattacaggcgcccaccaccatacccagctaatttttgtatttctagtngagacngggtttcgccatgttggccaggctggtctggaacccctggcctcaagtgatcaccttgcctgggcctcccagagtactgggattacaggcgtgagccaccacgcccagccaaggacatttttctagtagaatgcaacacatgtccaagttgtgcatgatccaaaaaaagtgactagnaaaaaaaagtaatgatgtcttcatgtccagatctagatatcttctacttcatgtaactaaagagtaagcacagtgtgaataaagcatcaaataagtacaattatcattttaaaataatgtcttattaatgtaattttaagagaaaaaaattaaacatataaccttaagtggacatagtacttccttaacacgttaatgctgcagggcacagtggctcatgcctgtaatcccatcactttgggaggaggccaaggcaggtggattgcttgagcccaggagtttgaaaccagcctgggcaacatggcaaaaccctgtctttacangaaaaattttaaaattagccaggcgtggtggtgtgtgcacctgtagtccctgctactcgggaggctgaggcaggaggattgctttatcccnggaggcagaggttgcaatgaactgagatcacgccattgcacaccagcctgggcactgtctcaaaacaaaaaacaaaagttaatgctcacatagaaaggattctttttaacaactttgttgagatataattcacataaccccccnaaaaaagaaataaaaaataattcaaatactataaaattcactgatttaagatatataattcagtaagttcacagggttatgcagctatcctcacagtctaatttcagaacaatttttaacccagaaaggaatcctgtacccattaatagtcattccccatgaccccacccacctccccccttactctaggcaactgacccactttctgtttttataggttgtctgttctgggcattttctataaatggaatgaatcatataacgtgaagttttgtgatgagcttctttcacttaatgttttcaaggtttatccacgttaagtacttcatatatagcatgtattatggccaaataacattccattttatggatataccaccttcatcaactgatggacataggggttatttccactttttggctactatgaataatgctgctacatacattcatacatgagctttagagtggatatgtgttttcagctctctgggatataaaagagtagaattgttgggttaaaactccatgtttaacattttaagaccaggcacaatggctcacacctgtaatccccacactttgggaggctgaagcaggaggatcacttgagcctaggagtttgagaccaacctgggcaatatagcaaaaccttgcctctacaaaaaat

SEQ ID NO: 115707 - DNA, 270 bp, Homo sapiens
taaagcccggcttccaaactattggcatggtcctcctacccggtggtagttatctatcactcttcccttcaaggaatacctatacctccagggagagccaaaattcagccacctcaaagatattagattagctaaagaccacctgtgcccaaagtgatattttaaacctaaactcacccagtataaaatgccattggatcacatcaaaaactgagatagaaatgtgagtttcctcacttaaacaccctaacctcccctactctccaagag

SEQ ID NO: 115708 - DNA, 198 bp, Homo sapiens
tagcaggagattcgttagaccattcttagcacattacgctcatggagactgtggggttcctgtggagaggcttgtgaaacaggtgtttgtggtaaaactggttacaatttttctcaaatatggcagcggtacttcttttttatcctagaggataaagccatattcttattccacctataactattattattatttttt

SEQ ID NO: 115709 - DNA, 440 bp, Homo sapiens
tggctaaaggtgtgtttttgcacccaagacaactctttagaaatatttttcttcagtattttaggttgtctttagatggacaatcagtttttatatttcttattttgtggttatcacactttaaaatctttgagttattttttgtgtacaatgtgtattttatgataagatcctagaatagtaatgtaacactagtgctttgtcctgtaacttttccatgaaaacaagacatttagtttgaagaaaatcagaaaaatttagaaaactcttattgtctagttactaagagacactttcaagatcattgagtttggtgattctgacgacttgttcatgttgagccaaaagttgttcattgtagtagaaaagtaaatctctacaaaaaataaatctgcttaagtaaagcatcctttaaaaagagaaaagagcctgtttatgaa

SEQ ID NO: 115710 - DNA, 614 bp, Homo sapiens
gaaccatgcaaatacaacagggtacgcactcttctatcttatactttaccagtcttagttgcaaaatccgtcttaacaagatgaaaatatatcttcttgacccagagcttgtgagtccagaagagcctctgttttcagactttcagggcttccagaaatgcgctttcattgccattttacgtccaaaattgtgtctcactcgagtttttgtatccgccagtgcccagcacaatccctagaaaagcaatgactggtaacgtggaaacttagatactgtttatttaattttcagttaactccctattgtgtacatttagatcttagtctcgagtgtctgaatttattacttcctataggatttgctttggacataatttcttgtgactaggtcttccacaggatatgtgagaaaataacagtgaatcagagttgtgtaagctgtagtaggttgggtaagaatgttccacttagtttggaactaccagctagatctactacctatgccgtcactctaaattacttgtttgtatcattattttttgaatttcagttgttttaggggtgcttttcagggtgaggataacttgtttcaaatagtacaacttgattaattt

SEQ ID NO: 115711 - DNA, 805 bp, Homo sapiens
agcggagctggaagcccggccgtgaccatgtaaggaagccgggacccgctgagatggggatgggggggcgatgaacgggggaacccgaggtgggggcgtggaaaggagggagcgccccggcccacccgagcccagcccgccggcctgccgcggaggcggcacaccccagccttggcctcagctgcagggagccccaggaggccagagccagagagaagtggcttctccagaccaagccccagagccgctccctagggagacttacagacacggactgaggcccccaaacagacaccgctcaaagctagcgcctgagtcctagacaagagcctccctcccacccatgccattcctgggagacttgtcccagacggaattttggattggtagcaggagtgatattctaaggctcaattagacctcaggttcggagaccctcccatcggagaccctgacagataaatagaggccccaagaggcatacataccagacacaaagaaatctgagggacggggacagacacagtgaacccacccacagactctacactaggaccttccctccaagacttggtcatggacacacgtaaactcgaacccgggcgcaagccccttgcaaattcggggaaaacactcccaggcaaccaaaccccagccagcctgcaagacaaagcccttcctcagcactgaggtggcccaggcctgctctgaaacagccctttcccaagttactgatgaactcagagcagaaagcaagacacagtctccagccacaaagtggcaaggccttccctggactgagacc

SEQ ID NO: 115712 - DNA, 241 bp, Homo sapiens
ccatataagagaagacaggaaacagggaaaaagggaaaaagaagcttgctttggaggcatgatgtataaatcagtatttctcactcttgaatgtgcataggattcatcaagggagcttattattaataaaacaaagattctttgcatgacccaactttcatgatctatatttatttcattagctatatatttatcaggctcccaaaccttctcctaggcccatctgtcgggctagtcgggg

SEQ ID NO: 115713 - DNA, 390 bp, Homo sapiens
tcaaataatagaagtttggagatagatcctctaagatttggctgtatggtaaaatcagagactcaggctccttctagttgttgctttgttatcttttaaatgttatctcatggtccgatatggctatttaaactccagccatcacatctacatttcagccagcagaatattttagcagacttcctgaaaaccacatacagcactcattcatatctcactgtccagaatctagtcacacgatcatatgtacctacaagggagattcagaaatgtcatcttttatttcatttatttatttattgagacagagtctcactctgtcgcccaggctggagtgcagtggcgaaatctcggctcactgcaaccttcgcctcctgggttcaagcgatt

SEQ ID NO: 115714 - DNA, 446 bp, Homo sapiens
ttttctgcaaatgttgagattctactgtttttaagaattgccggaggagccaagatggctgaataggaacagctccggtctacagctcccagggtgagcgacgcagaagacggtgatttctgcatttccatctgagggaccgggttcatctcactagggagtgccagacagtgggcgcaggtcagtgggtgtgcgcaccgtgcatgagccgaagcagggcgaggcactgcctcactcgggaagcacaaggggtcagggagttccctttctgagtcaaagaaaggggtgacagacggcacctggaaaaacggctccctcccacccgaatactgcgcttttccgacgggcttaaaaagcggcgcaccacgagattatatcctgcacctggctcggagggtcctacgcccatggagtctcgctgattgctagcacagcagtctgagatc

SEQ ID NO: 115715 - DNA, 228 bp, Homo sapiens
ttatatttgaataaaaaataatcttggttacatttcatattcagtaatcatcacagcttaataaaggtctactcatcaagggttgaaataaatggcaagatatataaaagtgccttgaaccaacttattagataatatatttgttatgaccactatttatctatctaacatacctgcttttgtacattttcaaaggtacagtctcattcacatatttcacaatttgat

SEQ ID NO: 115716 - DNA, 862 bp, Homo sapiens
agcggctccctggggtcacatggctatgattttctctttactgagggtaggcaaggtgtcctctttttttgttttccaagaactaaggcataataggtggttaatagatgttttgaggaatggagtaatgaatacatgaatccatcttctctcagctgttcagtttgtgaggaattttcaaatccttaattaagaatagatacatctatatagaagcaagctagaagtgtaaaacaagccttcaatatctattatttagagttgattgtatgtacttatgtgtttaggctaactcagtactaaagcatttttagtttttacgttggagttcagtcatttttggaaaatacttatgtcaaatttcttaagttttacattctagacattaccaaaattctgaatcacagagtgggttaaactaagtaagtggcatattgcaacttctattgttttacaagatccgattctgtctcaatatgtggcatttcatcatagcacctggcctcagtggaacttttcaaccctaaatgctaatctgatttaattcttcagggtaaaaaaattcagattagtctctatctaaacctgagtcagaaatactgaaactggtggggcttaggggaggagaatgggtccctcagtggtggacccatagagggtccttctggcttctcctctacccttagccaacgtaggcactggggcagcaagacctcaaacgtcccagcagcatgtatcccactggcctgctcctcccgcttctgctcctccttctattccttgtctcttcatcttccttccttttccttctttcctcttttctccattcacagtccttactccctccttcttccactgaagg

SEQ ID NO: 115717 - DNA, 231 bp, Homo sapiens
cggaaccggtggttagcacacttaagaggccgcagaacttagtggtgcattggaacggtgaaatccttcttgtggtccactgcgttggggaatttaaggaaccaatgatggagcggagaactctgccaaactaagaggctcgtcacctccagcaaacctacacctggaatgcgatgtgaaacaagcacgatccggaaaggcatgtcaagagcaggctggtgtagggtcagg

SEQ ID NO: 115718 - DNA, 380 bp, Homo sapiens
gcccaccaccacgcccagctaattttttgtagttttaatagaaatggggtttcattgtgttagccaggatggtctcgatctcctcacctcgtgatctgccctcctcggcctcccaaagtcatttactgttttaaacaaaacaaaaactagttacaaaggtagaattggcaggatttggtgacctcttagatatgggtcaaagctaaagcttgtctaacttgatagtaaagacttgaaggcgtggagtaggagaaacagtgtgtagaggataaggtaattaattcctttttggacacactgatatatctgcagtcctattggagatgtctagctggcattgagtatactggtgtgctgaaaacctaggtgatcactaaagt

SEQ ID NO: 115719 - DNA, 329 bp, Homo sapiens
tgtcaaacttcatcctatttttatggaaagtgggcaacgcagttaatctggctgcttcctgctgaaagggggcatagttgggaagtaccagaatggaatctattcacttggagttggaaatatatccacattcccagatctatagcaggaacttgctggagccttacagtgtgaggactgaggacctaggaacttttgagaaagtctgtcctcagtgtataacagtagtaaaatccatagcagctgatgaggacaatgagaagaataccaaccatgctgtatatgaaagtcttttataaggaagtcagctggaccacactgttaaaggg

SEQ ID NO: 115720 - DNA, 562 bp, Homo sapiens
ggaatttttgcttagtttgacttaatattatgctttctttcaaataaacagtttgatttgtttagaaaaggtatattctagcaaataacaatcatttagataaataatgctaagttccatctgtattaaacctgttcctatacatcatgtcaaaataataggaaaggaaaatctgatttatatatatgtattttttaaacaaacaataaaatgctaaagccttagtagctaaggaaatgatatgagcagatagtttataaaagaagaaatcaaggaggtcgataactgtaagttcaaactcaccagtgtatgaaatacagactaaattaattaatttttccacttaatggatagatattatgctctgggctgctgtgagatgggagctctgcatcacctgttgagagcatattttgattaatacaaacttaggggaaaacagttgggttatatatatgtaacagaagccttaaatgcttatacctcttgaactgaaatctcacatgtagcttggtaacctacaaaaacaattaaaaataaggacaagtttttaaacaaggat

SEQ ID NO: 115721 - DNA, 467 bp, Homo sapiens
agctcctgaccaaactgactgtgtttgccttttggaggttgccggctcacacagggtaaatgtttgaccttcttattttattgaccaagtatccaagtggctgccgtggccatagtgagtgacagagtgccatctgagtggctgccgtggccatagcaagtgatggagtgtgatctgagtggccgccgtgggcatagcgagtgacgggaatgcaatcagagtggctgccatggctgtagtgagtgacgggatgtgatccgagtgactgctgtggccgtagtgggtgacgggatgtgatccgagtgactgctgtggccgtagtgggtgatggagtgtgatccgagtggccaccgtggccacaccaagtgacagagtgtgatccaaggggccatcgtggccatagcaagtgatggggtgtgatcagagtggctgctgtggctgtagcaagtgacaggttgcgatcacag

SEQ ID NO: 115722 - DNA, 190 bp, Homo sapiens
gacctagtcgactatccattaatcgtccatgacacctcgttgcatatcaagccttgctagaatactggggtctacagcaacaacaacaacaacaacaacaacaacaaaaaccccacaaaaacaaagaacctctcatttaaaagtgggaactgatggctgggcacggtcactcacgcctgtaatcccagca

SEQ ID NO: 115723 - DNA, 641 bp, Homo sapiens
tgagactggagactcattctgttgtaaaaatgctttctccaaagatgttaaaaaagaaaaggggaaaatgtgaaagaaaaatatcttgggtcccttcaagatgggaactgctcagggcaaatctgccttctattctattcaagtcatccatttgctcacagagacagatgcatattctgattgcctcctttggaaagacttatcagaaactcaaaagaatgcaaccatctgtctctcacctacctgttacttcgaagcccccaatagggggtcttgctttgagctgtctccgcctttccggacggaactaatgtacttcttacatagtgattgatgtctcatgtctccctaaaatgtataaaaccaagctgtggccggaccaccttgggcacatgtcatcaggacttcttgaggctatgtcactgggcatgtcttcaaccttggcaaaataaactttctaaattaattgagacctgtctcaaattttgggggttcacaggtgagtgggctcaggcatgtgcactagtatgacttcctctagaaacactcgactggtaagggaagaatgcctcaactgagcatgtgcacaactcccataaacacacttgtgcttgcggagcctctcaagtgctggcaggcca

SEQ ID NO: 115724 - DNA, 311 bp, Homo sapiens
taaggatctcggtcaaggatcctcgggtcaaggatcctctcggctcctcagcctccttgtctcttttctcttattccttcattctcttccaggaagcttttctgaactgaccacgtccccctcaccactccccatacctgcagcctagagattggtcagcctgaatgatctgcagacctgcctctgtcctgtctcgtcctcaggctgcaggctttctgaggacaggggctccctcctccattaagtactttttaaaaaataaacaatgctggccaggcacagtggctcatgcctgtaatcccagcactttg

SEQ ID NO: 115725 - DNA, 293 bp, Homo sapiens
tgatgcttgtggggtgtcttcttgctataggctgatacatgtatgggtaaaaccaggaagtggtgcacagaaaggcaggagataaacaataggaagacctggggccaagttccaacccccatccaatatgactgaacaaagtcactgaatttttgcctcaatttatgtgtaaaacggcaattccattataagaagccaaggagaaaaatctacataaagcatctgcaaagtagaaggggctagaaaaacacttatcttaataaaacttttttttttttttttttttttttttt

SEQ ID NO: 115726 - DNA, 424 bp, Homo sapiens
ttttgaactcctgggctcaagcagtccatccacctcggcctcccaaagtgctgtgattacagacatgagccacctcttctggcccctggaacctactaatcagatgtttgaccttctgaacccatcctctaacttttttactttatctcacctgtttttttcttttcgttgtttttatcttttctaggttttctcgattttatcatgcagcatttctattgatttttaatttctactattccatttttaatttaaaaaactatttttgttttgaaggactatttttatgtccttcttgcaacctcctgtttctttatcacttttgtaatatcttttctctctaagatactgatgattttggggtgggaaatgttttcttctaccccttcaaagttactttcttccagtttgttttttggttttt

SEQ ID NO: 115727 - DNA, 101 bp, Homo sapiens
cattgtcattgtctggcctgccaccccgctccacactgtgccctgggaggtttgaatgagggtggtgagggatgcgccggtgaggaggcacgcggggacac

SEQ ID NO: 115728 - DNA, 182 bp, Homo sapiens
cttgtcttagcccaggcttcccgtggaaaacagagccagagagaagggctcacatgcttagcttttgttttggagactgacctggagaaggaggcaaggcttagatagagctgcatctttcatttagctgccatgggcagtggtcttgaccctgaggactttacaaggtgcatgaggaatgt

SEQ ID NO: 115729 - DNA, 782 bp, Homo sapiens
acaagggtttcagtctattccgtgctttgggtgccagggagagattatgtgtctcttgtttttatctatatccttttaaatccaggaatagagtcaggaaaatatatttttcagtcttttgaagatgaatttttaaaaatctcagtttggacagtagtcagaatgacctttcattttgtgctttgattcctagtgaggtggctagagaaatctatcctatgagaagtgagcagttaaaaacagagagagagagtgcgcaagagcgtgagtggtgaccaagagaaagagtgttcaatattttttgctgtatttgatgtttttttagtgcaactttaaagacattttcagtcaaagctttcaatgggtagggatgtttttaattaacttctacaatagcttcaaggcaggtctattcttgtgaaaagtaagatggccacttgagattttaatgtttttgataaatatgtttgttcttcataactactttctttctttttttttttttcctttcctttattaggaaactctgagatttccctcatgctagctaatggtgacacaggagtgtgaaaggcacagatgccttcaatcagggtttagtattacacatggtacaaaataagcacacaataagcatctgaaagaatgaacaaaccaccttcagcctgaaggaaaacgctttttacctagggtcctgcatattttaaaagccctgaaggaagaggtcttctacagactcttcacttgagagagttcaagagctactgccatatgggaactaa

SEQ ID NO: 115730 - DNA, 663 bp, Homo sapiens
ggagagagatgagggaacagctgattagtggagcagtcagagcacacatgacatttatgagttctccatcttataaaggcacctcgataaagtttgtggcacctcaaaacaattacagtaataacagcaaagatcactgattacagatcatcatgacaaataataatggaaaagtttgaaataatgcaagaattaccgtaatgtgacataaaaacccgaagcgagcatgtgctgttggaaaaatggtgccagtagacttgcttgatatggtattgccacatacctacaatttgtaaaaaacaccaatttgtaaagctaaataaagctaggtatgcctttaataggtttcaacttgattcagaacaaggaatcctaaattcatttagctgtctttgagtcaaagcaggaaaccttatttcagggagagagctcttggggctaatacatgtagaaatagaaataatatctctgaagtattgattgtcgtagagcttttggcttactttcttcacaaggccctacaacacaataattggataattgggtgaattgttaacatgtcatgttatgtatgttcctttaattctagttttctaaaatatctttaatatttttaattctagttttctttgttatacttatttaaaatttaattttattata

SEQ ID NO: 115731 - DNA, 591 bp, Homo sapiens
tagtgcctgggatggctcatgtcttcagaagggcctaatgatatgggaaagagaggatgcatgaataagactgtgtttgggatggacagtagactggtttgggaaagtgacagaggagaccactagttctgatcccaggggcactttaggaacagtaattcttttggagtccctctcatggtttctgagctgtgttcttttgattggatgcatctcactaggaatatgagggtgaatggggaaggggacaactccttggccagtggttctactaattcttcccccaaacgacactgcaggagagatgaaaagaaggcccagctatctctatagactttggtatagacactgtcccttcatttgccactgaccttccattacctcctgtggactctgcccgtttgattcagtcctccagcttgaatcaaagatggttgagacattattgaattaaccaaagttgttcttagtgataatgggagcatgaagtagatgtctagcctgactcactcatcacccccattctttgggaatgatggcacccagaggcccagctgaagggacaggcctgggttgccatgtttgagacct

SEQ ID NO: 115732 - DNA, 406 bp, Homo sapiens
tgtcggggctctgagctctgtaagggaatgccaaaagcaagctgctgcctccagaagcctcgctgtgcgcctcgtgggcataaactggaaccttggcaataaacttctgcacacaaggtcgccctgtgcgagcgtttctggaatccagatttaatactgcatacaacaccttgttttgaaaagagaagatcactgctttcaatgttatggaagtctattccatgctgaacatcgaaatactgatgctctctaggcagagaccatggagaaggaagctggggacgttttgtcctccctgctgcctgcctgcaggagtggactcagctgagactgtgccatgagcctccttctcatcacaaaggccggcttgtcaatggaagaagatgtgccagacagccacttcaca

SEQ ID NO: 115733 - DNA, 480 bp, Homo sapiens
cgacatctctaccagatcctgtccttgctgttcctctcaaccttcaggaacactgagcatccttacaacaccaaaaatttccaggaaagacactgaacttcccttctctgttcacaaggaggaatagccagtacagaatcaagctcagggtagaacagaaccaggctcaacattaggtaaaagtgtaccctcgctgactcaaaaaaaagttggtttataggtagaaagaaagaaagagaaagaaagaaagaaagagagagagagaaagaaggaaggaaggaaggaaggaaggaaggaaggaaggaaggaaggaaggaaggagatatgggagtgggaaagtggttttctttagtaagtctgggctgttttcatagcctaggatgaagtccagcaatactcaaccttgaggttttccaggcaccttctccttgacacgaatctcctgcaaacagatgtctaatagagaatgtctaataggga

SEQ ID NO: 115734 - DNA, 948 bp, Homo sapiens
atactaccagtattttgtctactgaatcctattccatagaaagttgagacatttccaaaaaaggaaaattatttctgcaactcatggaaataatcctagggacagacattttaggaattctgttttctggagcactatgaggaagagttaatacttgcagccctcaagttagaagttgggtaagaggcaagaaagggatctaaatttatggattatttcccgtataacagattatttcatttatttctcataacactcctgcgaggtagaaattatttccctttgctctgaagatgagaaaacttaggcctgaagaggtttctgtttcacagcatcgaactagagggttccctccatggccttcttgtattgtttaggacttgttttccttaagtatcatccctagacactcaataaatgttcaaatattcatttcatgcttatcagcgtgtaccacatttatttagttaaaattttcaggccagggtgctgggattacaggtgtgagccaccgcaacccagctatggtataattgtcatgtgcataaaaaccaggaggagaggtacacatgaaggtgatcaataccagaatcttgtagtctagatatccaactactattcagatggatcattctcatgcttccattctctagattatgtgaaataatttatcatggctgaaatgggcgactctggaaggactaagaactcatgacactttggtacctgtcgagatactacaggacgcgactgaccactggggtacctcgaccgtacgggaaaccataaaggagcatctacacgccctctgcggcatagaaaacggcccatcctacggtacttgttaaaagtacaagttctattacatctaaccctcaacattccgaattccatggcgcaaccggcacactttgcaagaccaaactggaaggactactaccactagcg

SEQ ID NO: 115735 - DNA, 408 bp, Homo sapiens
tgcagtcctggtaggaaacatcctaaggacaaagacagctacaaagaaatcctaaaatgtgttcagtaaacatactgttagtaataatactgttactgttatcttgacacaacacaaataagtggatcactatataaaggtaagatgaagcaagtgaatatgtcaatttcattagtaaccaagattttcaataagaagtatacaaatataaactattgatatatgtgtctgctaaaaatttatatttctgaatttcatagcactagctactgaaaaagcctagaagtaatgactaaccccatgaaggatcacctccatcacccagattgtgtctctcaataccactaaaaggaatcagaactccttagagaagtggctgcttagaaattgggacaagtaatatatgaa

SEQ ID NO: 115736 - DNA, 390 bp, Homo sapiens
cagaaagaacctcagaagtcttggtctatggtctgttcaggttgatcccagcatacattgggggctcctaagggacccgagcctaatggatttgtgggagttccagaccgtggggtgcagaggttgcggccacgggcgagaatccccatctgagaggagcgttgctgttttcggtgcgtcagggtaaattaccttttctctctatgcaaaagaatgcaaatgagcagaacttttaaagaagaatttaaagtaaaattacgtcaaaatgtagctgctttgacctcttcgtctcagatccgagcataggcttcccctttgtgctatttgaagggacttaggataaatttgaaaagcctgaactaaagaaatggttggagagactccgtctca

SEQ ID NO: 115737 - DNA, 141 bp, Homo sapiens
agtgctgggaagacaccgaagtgtaaaacgccctcagagcgcttccagtctggtcgggaaagcaagacaggaactccttctttccttctcctaccaaggttcagttcctggccgggtgcggtgactcatgcctgcaatccc

SEQ ID NO: 115738 - DNA, 361 bp, Homo sapiens
cttgtggtcgttcttggagcaaaagtttatgatgtaagcctccacatactgttctgttcgtccaagtgggagctgcaagttagtcctgctttgtagccacgattttccccaatattttgcatttctgatagttgccgtgagactttgatgttgctggtctaggaaccgtagtttgagaacaactgttctagcataattgaaagaaggttatctggccatagtcaaaccatcaagggaaccaacaaatataaaagcaaaaattcccaaccaaaaggcagtaagttcgaagattcaagaaacatcaagccacacagatgaaaaagaaccagaagaaaaacaatggaaattcaaaaagccaaag

SEQ ID NO: 115739 - DNA, 291 bp, Homo sapiens
ctggctcctttgtctcagggagctgctgtcctgcgactgccgcgaagaggttaaggcctgtgctactgccctgcaaagtgcctgaagctgaaaggaggaagttactttcctgtggctaggagaggccttgggtttagtcctgtggctgcgttgagacagtttacagcctaaggaaagaactgggcacctggtttctaagaggacgggcacttgattcctgggggccattaggacaaggaggtggaagctgtaggttttgcaaggactaaagaagcaaattggttttctgga

SEQ ID NO: 115740 - DNA, 380 bp, Homo sapiens
aaacttcttgcttctcacggtgagtctgacactggcgtcaccagggagaaatacaggttctcaggccaggcgccgtggctcacgcctgtactcccagcactttgggaggctgaggagggcagatcacctgaggtcaggagtttgaggccagcctggccaacatggtgaaaccccgtctctactaaaaatacaaaaattagccaggtggcgtgggcctgtaatcccagttgctcgggtggctgaagcagaattgcttgagcccagaaggtggaggttgtagtgagccgagatcgcggcagtgcactccagcctgggcaacagagcgagactctgtcaagaaagaaaagaaagaaagagagagagagagaaagagagaaaga

SEQ ID NO: 115741 - DNA, 510 bp, Homo sapiens
ctcggtctacctgttcgtacatgtgggtatatatgtgtatacaagatggtacctatccacactcacctgcatactttgtatcttagtccctgccttctcagtcatgtaagtcaactgatactgagtttctagtaactagtatagaccaaacatatacccctattgagagctttgcttagttccctagaaatgaatctctagaaatagaagattgtaatttgtggaatatttgagagaggagagggcttcagagaagctgctgtgtctgactgtgatcactgtgtcgtttgtttattgaacataggctgtaaaacgactttcttctcttccccatgcttttccatgttcctcgctctctctcttttttctctcctatttctcactttcccacgcttgtgtcactcacattacataaaatataatatatagtgaagccaacttaaataccacatcctcctcgaaaccactccttccctttccacttgaaagaaatctccgtcctctgtacct

SEQ ID NO: 115742 - DNA, 379 bp, Homo sapiens
tgtggtggaattcggctcttaacttcgcttgtcctctctgcaggccctgccgaagctccccctggtttcccgcagcgatcccgcgcagagtcccgctctgtcgcccagtctggagtgcagcagcgccatcatagctcactgccacctagaagctggggtgaagcaatcctcctccatcagccttcagagtagctggactacctgcgcggcccaccacacccggctaatctttgtggtttttgttttgtttttctgttctgggtttccgccgggcgcagtggctcaggcctgcaatcccagcactttggaaggcagaggtgggcggatcacccgaggtcggagaccagcctgacaaacatgaagaaatcccgtctctact

SEQ ID NO: 115743 - DNA, 379 bp, Homo sapiens
tttcaatggcagagccacagtccaataatacaatggatattctatgaggatatgacctcattttcgaaatatcccttagacatagcaggccagcaattatctttaatataggcagattctcatatttggtctcttagtgggtacagggaaggaatcttgatgagctgctgggataaaaagcattcatttagaaatatccttgactttctgacactgaggcatagccattgtttttctgagacttactcaattcaatacttatctcttccaaagggccttccctgatcaaagtaacatggacagtttactcactgctatgttctcatgaacgctgggtgcaaacttggaaaaaaattaggaagtatatgtttagtctgag

SEQ ID NO: 115744 - DNA, 359 bp, Homo sapiens
caggcccagaaggccaagctggatggtgcgtggctggagggggacctgtccctggccgacaaggacgtgactgccaaagacagcaagttcaaaatgcccaagttcaagatgccgtcgttcggggtatcggccccagggaagtccatcaaggccttggtggatgtgtctgcacccaaggtggaggccgacctgagtctcccctccatgcagggggacctgaagaccactgacctcagcattcagcctgcttctactgacctgaaggtccaggctgaccaggtggatgtgaagctcccggagggccacctgcccgagggagctggccttaaagggcacttgcccaaggtggagatgcccag

SEQ ID NO: 115745 - DNA, 627 bp, Homo sapiens
atccttccctctctctgttgcttcccagccccaacttcaactctccagctggtgttcagcatcaagttcagaacgtaagcaccctgcaccccaaaaacccagcaagttttcccttgccacaccaagctcccagattcactccagattccatctgcctcccactacggtttctccctttctttatactctgcctcctctcttcctggatggttggtgctgagaatgggcaattgctcagagctgggcaaaccttaatatcactgtacccaccaggcctatacagctgaagaagctgaggtccagagatcttgcccaaggatacacaggcagggacaggacagccggaagcctgattccccaccctgcccccagcactggctttctcctcatatagagactgagactgactctatttggaccctgaggaagaaaagtattcatctccactccaccctctgctgacatccaattagaaggctctctcaggctatctataccaaccactgcagcaggcagcctcttcctcactaccccttcctcccactacaatacatatagacttttaggagcaaaggattctcctatcttagctagaattgcgaccttaattatccatccaaacccccc

SEQ ID NO: 115746 - DNA, 225 bp, Homo sapiens
ttttataaactcttccggtgggaagctgaggactactgagctctccaccctgaagatgtctttctccactcgcttgttttcatcttagattctggtggccccaagtggctgcagcatggggtcagggtggtggccaggaaacaaagggtggttctagtccttgcttgctgctacttgtccatgtgactttgggatctttaagctccctgggtcttgatgtacttt

SEQ ID NO: 115747 - DNA, 175 bp, Homo sapiens
ggacaagtgaggaattccttaagactcagtgttagtttcctagggctgacataagaaagcaccaaaaaccgggtggcttaaaacaacagaaatgtattacattacagttctggaggctggaagtccaaaattggtgtcagtagggtcatgctctcctgaaggctctgtaggagga

SEQ ID NO: 115748 - DNA, 264 bp, Homo sapiens
gggagactgtcaagccaacgggtgccagagaaagaggggagagcttcaaacaggtgtgtgtggtcacagggccacatgtcttcgggaagtcaaatgtaacaagaattgacaggagataaccagcacccgatgtggttccaagggctgtggcagggcaggggctgtaggaaggaagcagcagtggagacgggggacaagaagaggtgctccatgtgactagtgggaaagggctcaagtggctcagaccagcagaaacaattttgc

SEQ ID NO: 115749 - DNA, 276 bp, Homo sapiens
cctgcaaacaaagtatcaaatcttgtttttttcaattaacaaaatgagaactatagactatagaaagccagctgtcaaaaaaatagggaagaattcctttagtatgagaagtgaataaacataaaaagggaaatgtattttgttagtgaccaaaagaacaggtgcattagttggtgatcaaaataaccagtcccccctgtaaagggggactggttttaaagggcattagtgtttcaagcaagtaggatggtgctcagagaaagattagtccctgtg

SEQ ID NO: 115750 - DNA, 409 bp, Homo sapiens
gaggtgctcagaggatcccgatatgctgtctcagctgatagagcaagaaaattgtgtatatgaacccatgtatatgcacatatctataaactgagctaaacctgagttcatgtaatgactcccaactctaatccatcaccacatggatcattctagcctccttcccttgtttatctgtacaattccactccagaagtggcaatcctggccacctgtcaactatttaattatttaatttcattatatatggacatcagtatcagaattgttaattgtgaattgtgaaaaactcttatcaactagaatacagtgctatgtacagttcctcttgcctttggtcttacagatgccactcatttccaattacataggtcagcgccttttcttcctgcccctcagtgaggttgtt

SEQ ID NO: 115751 - DNA, 612 bp, Homo sapiens
tgtctctacacaaatgctgatgggaaaaaataatggcaataatttttctcctaagaatccataaccacgggtcaagtctttatgttggttgggaattcaaattcctattacctgctttcagataaatccaaaatagagaaatcaaagtgtctgggttggcagtgcccactagtaacgaaacaatgcaaatcttttttggatgaaaacttgctcaacagaatgctactcaggttatccacaaatttggctgaatgtaaattccctttcagaaacaaccatacacactggaaaagaagccccaaagagtgaaagtcagcagaaataacaatagcctgagacccacaaagactttagatattagaggccgggtgcagtggctcatatctgtaatcctaccactttgagaggctgaggcaagaggctcaacatagcgagaccctgtctctgcaaaagattaaaaaattagctgggtgtggtggtacatgcctgtagtcctagctattcaggaggctgcagcaggaagatcgtttaagcccaggaggtcgagactgcagtgagctatgactgtgcactgtactttagcctgggtgacaagtgagatagtctcaaaaa

SEQ ID NO: 115752 - DNA, 762 bp, Homo sapiens
tgaaacttaagttctagcttaagatcatttagtcgtaacaaaacatcttgggtcagtcacttaaaccctctggacatcagtttctttttctgtcagtgaacaagtaaactaattattggccactgtggttcggcctgtctttgaccagagtcccaggtcctgttttttcaatcagaattgtttgagtcaaatggactctaaatgggaccctcatctcatgggactttctgggaccctacctatcccttgatttttgcctccctataaaccacctgcttgcatgtgccctgaggaactcctgaggcttcagccccaaccctaccccagagtggttttatgaggggtgtgcctccttagtcagcctgccttgtagtgtcttcttaaaaaccatcattgtttcaggtttgtgggtgcccacattccttggaaagttcatgcctctcaatgtctgacttgaaagcaataatattcttagtctttttacatagctctttccaatttacattatgcttttatatgtagttgtccgtcagtatcctcaggggattggttcaaggactacccccacttccctcaggataccaaaatctgcagatgctcaagtccctgataaataatggtgtggtatttacgtataacctatgtacacacatccttctgtatactttaaatcatctctagattacttataatacctaatacagtgtaaatgctatgtaaatagttgttatactgcttttaaaatttgtattattttaaatt

SEQ ID NO: 115753 - DNA, 344 bp, Homo sapiens
tgaaacttaagttctagcttaagatcatttagtcgtaacaaaacatcttgggtcagtcacttaaaccctctggacatcagtttctttttctgtcagtgaacaagtaaactaattattggccactgtggttcggcctgtctttgaccagagtcccaggtcctgttttttcaatcagaattgtttgagtcaaatggactctaaatgggaccctcatctcatgggactttctgggaccctacctatcccttgatttttgcctccctataaaccactctgtggtagggctggggctgaagcctcaggagttcctcagggcacatgcaagcaggtggtttatagggagg

SEQ ID NO: 115754 - DNA, 612 bp, Homo sapiens
gctagttgtgggcggctctgaaggactcctccctgcctggacatctgtccatgcctgacaccgtcactgctgaccctgacgtaaagaagaacaactggatgcctatggtaaaccatcaataaatggttttccttgtgcgctttgtccaaaacccagacagtaccatatacatcggtataaacaaaacgtggcctctgtctttcatgggccgatctaaacttgttcatgagcctccatgcgctgagtagcaataggggcgttcctgaccagacagaggctccatttcaccttaatgtcaacagtactctgggtcctcagtgtcctctgtggcagggtggttggtgcagctcagcacctgggccctgacactgcaccactgagggacggtgggctacttgaagtttggtgtctcttgctcagggacccaaggccctctctggctgacctggcctcgtctcagttctcaccagcatatctcactcagtctcaggtgtcattaatgacagacccctgcaagtctcatccaggaggccagtggaggtcacagctgagacctggagggactgtcagtgctatgaagagctgaggccatgacccccaacctcctaatga

SEQ ID NO: 115755 - DNA, 839 bp, Homo sapiens
cgaccacgcgtcgcccacgcgtcgggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctatttaaagcctggttgggaggtttttggggggggccagaattccttaa

SEQ ID NO: 115756 - DNA, 3317 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaa

SEQ ID NO: 115757 - DNA, 3322 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggccagtaggaagaaggagtcttccgcgcggttaccctccccgaatataaggacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaa

SEQ ID NO: 115758 - DNA, 3239 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctatttaaagcctggttgggaggtttttggggggggccagaattccttaa

SEQ ID NO: 115759 - DNA, 2690 bp, Homo sapiens
gggtggagtgtaggccagggggttggcggtgccgtgtcatggaggctcagtctctgagcagccattgaaggggaaggaactgcgggaaagggaaaaggagagtagtagctgaagagcaagaggaggacatggagatgaagaagaagattaacctggagttaaggaacagatccccggaggaggatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaa

SEQ ID NO: 115760 - DNA, 3419 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgatgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgatta

SEQ ID NO: 115761 - DNA, 1494 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcactttta

SEQ ID NO: 115762 - DNA, 1315 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggtgaatacacacttcttacctgcactgaaaattaatttctaggcataggagtaagtactatataaagtgtgttttgtagcaatctgagagttgtttctaagttgtgggtgtgcatatgtctatccacctgtcttttttttcattgtcctccaccccaaactatatccagataatcataaacacctattgattttacctcccagataactttcaaatctgttacagccatttagcctaaatggctgtagcgacagcaggca

SEQ ID NO: 115763 - DNA, 723 bp, Homo sapiens
tacaatcagctcggtacctgccaagcgtagtacccaaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgatta

SEQ ID NO: 115764 - DNA, 606 bp, Homo sapiens
cttaatgaaagaagaaattcaggtgaatacacacttcttacctgcactgaaaattaatttctaggcataggagtaagtactatataaagtgtgttttgtagcaatctgagagttgtttctaagttgtgggtgtgcatatgtctatccacctgtcttttttttcattgtcctccaccccaaactatatccagataatcataaacacctattgattttacctcccagataactttcaaatctgttacagcctcaatggcatggtatggtggaaacattttacaaatgtctgtgaacctcaatttctgcatttataaaacagattaggccgggcatggtggctcacacctgtaatcccagtacttttggaggctgaggcaagtggatcatgaggtcaggagttcgagaccagcctgaccaacatgagtggggaaaccccgtatctactaaaaatacaaaaattagctgggcatgatggcacacacctgtagtcccagctaatcgtgagactgaggctgagaatcacttgaactcaggaggcggagattgcagtgagctgagatcgtgcctctgcactccagcctgggcaacggagcaagactctgtctc

SEQ ID NO: 115765 - DNA, 3457 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgatta

SEQ ID NO: 115766 - DNA, 3262 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcagaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaa

SEQ ID NO: 115767 - DNA, 3762 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgattaaaaaaaaaaaaaaaaaaaaaaccgaggaagaaaacagacacaacgacaagtcaagaaacacagcacaaaacaagaacaccgacagaaactaaaagcaagagggggacgggcactgcaataatatgccacgagcgcagacctacagccgagcatctagtgaacgcggcccacactaggaaacatacacacgcggccgcccatacacgacgcggagaacacacgtgagtggcgagacaacgtagggggaaaggaacaacagaaacaggcaaaaaagaagtattaaacaacctggcgaaatccgctaa

SEQ ID NO: 115768 - DNA, 3167 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggagttggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaa

SEQ ID NO: 115769 - DNA, 3011 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggagatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacataccaccccatccctttcctctcatcattcaccttgca

SEQ ID NO: 115770 - DNA, 1367 bp, Homo sapiens
gggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttacaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgatta

SEQ ID NO: 115771 - DNA, 110 bp, Homo sapiens
ttgctgctccacacctgacttgcgtctcttttgaagctatgggatttaggctggcaccgtgagctgtgcaccacccgccaggctgagtgggcagaatgagcccagcaggc

SEQ ID NO: 115772 - DNA, 508 bp, Homo sapiens
tacatgtgtctaggtagagaaagggggaagtagccattcactgccatccacattcaagggatttgtacttccaatgtgcacaaatatagtctctgtgggtgcagcattcctgattcccagaagaaatcacttccaccaagaggaacaatgtggattgcactaaacttaaagttattactgctcagtttatgttctttgtgctagtgaagtaactagctcagaaagaagttgctctattagcaggagcaattaactgtaatcatgaagaaacagggctgctgctacataattgagacagagcagaagatatcttgcactctggtgatctaccaggatgtcttttgttactagcattgtggatttaactctacagccaatcatagccattaataagggcaaaataaacagggagtcagatcctgcagcaatgagagtttgagaaaaccctcccttcacatacacacacacacaaccctcccttcacacacacacagacacacacacatac

SEQ ID NO: 115773 - DNA, 127 bp, Homo sapiens
ctattaccctgcaacattcacccaaccaatctattgctggcaaatactaagtttccatgtgcccagcttcataccaagctacaggagataaggatgacacagttccctttccctgtccttcacaagg

SEQ ID NO: 115774 - DNA, 619 bp, Homo sapiens
gttaatgctgaaatgagttaagattttcgggaactgttgggaaggcatgattggttttgaaatgtgaggacatgagatttgggaggggccagtggtggaatgatatggtttggctgtgttcccacccaaatttcatcttgaattgtaactcccacaattcccacatgtcatgggaggaaccaggtgaaaggtgattgaattactggggtgggtctttcctgtgctattcttgtgatagcaaatgagtctcacaagatctgatggttttaaaaatgggagtttccctgcacaaactctcttttctcttgtctgctgccatgcgagatgtgcctttcaccttctgccatgattgtgaggccttcccagccacgtggaactgtaagtccaataaacttcttttgtaaataagaaaaacaaaaaaaaaaagaaaaatctgcggaagggcttttatgtcggggggcggagaagaaaagagggcattggacaggggcacaggggtcaatagcaggtctccgatggaccacagtttccttggtacaaaggggcgaaattctcgccgagtctccctattgggaggtcgaataaatacccagaaagccgtgttacccggcatcatggg

SEQ ID NO: 115775 - DNA, 671 bp, Homo sapiens
cggatcagccaaagtcattgatttgtaaaaatgaaaagaaaacagaaaaaagaaaaatgaagtctcactgtctcagtttagcgaatcccgttgtgtccactcctgtcctccagaggcgagcctcaggaaatcacataacttttcactgaggggatccagggggtctccatatagggggagatggaggtttctaggaagagcagcaggtgctggtatttacaatgttgagcacaaacatttgcagcatgtttaaaattgtctagtagagttcaagttgtggatttgcttttccttttattcttataaccttcagtaactcctcctctgggagtcagcactcccatgcccagagttcacccatctggtcatcaaacactcaaagaaggggcttttctggccttttgtcttgatccttatatttccaaataggccccctcccttgcttgcatccacgttggtcaacttgaccaaaacctcactcttcactcaaacaggctctgagaatggacttagtggccaattctaggtacatgagcacttcctgtatcccagttttgggaataaactggctgtatttatagaatgtgctttttttttttcaatttctcactctctctcctatctctagcaagtctcaggcaagatctttgattttcctggatgccacctgg

SEQ ID NO: 115776 - DNA, 336 bp, Homo sapiens
acttcctgctcttctcctcaccccacaccttcatccatttttagaaagtaactcagttccagccgggcgcagtggctcacacctgtaatcccagcactttgagaggctgaggcaggcggatcatgaggtcaggagttcgagaccaacctggccaatatgatgaaaccccgtctctactaaaaatacaaaaattagccgggtgtgctggtgcctgcctgtagtcccagctactcggaaggctgaggcagcagaatcgcatgaacccaggaggtggaggttgcagtgagctgagatcgcaccgctgcactccagcctgggcaacagagtgagactccg

SEQ ID NO: 115777 - DNA, 673 bp, Homo sapiens
ggcagcgagtccaaaagaagctggtgataagctttctctctgctaacccctaatgttctgcatgaaatatgtggaggcagaagagagacagtttattatagagtctacgtggtatagagcgaaggaataagaacatttctgataagtattttcaaaatttgaagaatcattcctatataaatcattcatttaagagactaaaatacaagtaagatgtttcttgccacataaccctcagcttagccaggctctaaaaaggacaacactggacaccttgacagtggtaaaaagcagggtttactcactcttgaatactaagatctggtgctaaccttaggcagcaacttgtctatttggttgaggttcagctcaaatctcttgggttattttcagttgtgccagtcatttaatttattttctgaatcaaataataagaatggatatggttttgagtgtaaacagcattcccagatatatcttacaacttggtgtgccatctgcctaattttgaacctataggacgggaataactgcattgtgaaaaataccaggtgatttccttaaagccaaatactcttgtccctcctacttttcttttggctttcctgctgcatgggacgtggcaataaatggcagttttctgcacacagagataaaattcacttgttgagga

SEQ ID NO: 115778 - DNA, 503 bp, Homo sapiens
tggtctaatgtctacgggaggatgtgcatagctgatatgtaaatactaggccatgttatgtcagagacttgaggatccatggattttggcatccccggggaccctagaactaatccatggataccaagggatgactgtataaactcactcaggaaggcttctcattggaggaaggtcccagttcaggacacacagggacatctccctggactactgtccattcatccatccattcatccattgtctccccccacccccgcatctcggactgtcccagtgacagccctagcaagaagagacaagaaacaagttcacgttgtccagttttgaggtaatggaagaagttgcaccagtatgagaatagtgggtcagttttctacaggatgcagaaagcatatcgggcagcctcggggtgcggaaaggagcctggcctctctagcagccacacaggcctgcagtaggatggggctgtggctggccatgtggatcacttgggcctcatg

SEQ ID NO: 115779 - DNA, 199 bp, Homo sapiens
gccctgctaaactaccctagtttcgcttagggctccatctccctctgcatatcttcatttcctccttccctgtttggagcagtgccagaggtctagaagaaaaccaggaagccacaggtccgagagtataagcaggttttgcttcagacatcggctcagtcggggtagatgatgtcatatcaggggctctagggagact

SEQ ID NO: 115780 - DNA, 292 bp, Homo sapiens
taattttggttttttaaacttattgagacttgttttgttgcctaaaatatggcctttcctagaattgaaaagatatatattctgtatttgttggataaaatgttctgtaaatgtctgttaggcctgattgacctaaagtctagtttaaattcaatgttcctgtgttggttttctgtctagatgatctttctaatgctgaaaatatgatgttgaggtcacccacttattgtattgccctctatctctctatatagatctagtaatatttgccttatgaatatgggtgctccag

SEQ ID NO: 115781 - DNA, 356 bp, Homo sapiens
cacccaatcccccactcctccgaaaagctggtctccctgcatctctcccagtgtatcccctcaaaagcagacaatgtgaccttttaaaaaatacaaacttcggtcgggggcggtggctcacgcctgtaatcccagcactttgggaggccgaggcaggcggatcatctggggtcaggagttcaagagcagcctggccaacatggcgaaatcctgtgtctactaaaaaatataaaacttagctgggcatggtggcgtgcgcctgtagtcccagctactcaggaggctgaggcaggagaattgcttgaacccgggaggcagaggttgtagtgagctgagattatgccactgcactccag

SEQ ID NO: 115782 - DNA, 453 bp, Homo sapiens
taactgcagcagctgctaaaccaaaaatacatgcatcttatattttgtaatggagaatggaatattcagtgattacagtcatttcaattctacaagtttttttgtttgtttgttttttgtttttaaatcaatggctgagcaaaaactgaagaaacaagtaaccaatctctctagctttgttatatacatccagctaatgccatcaaagatggcactaggttatgttcacactgattacatggccttaccctacccttgtttagtttggctgtttagtaaataacttgttttaaattgtgatttagccgggagcagtggctcacgcctgtaatcccagcactttgggaggcctaagcggacagatcacaaggacaggagatcgagaccatcctggctaacacagtgaaaccccgtctctactaaaaatacaaaaaaacttaaccaggtatggtg

SEQ ID NO: 115783 - DNA, 787 bp, Homo sapiens
agtgaagtgctttttcaggagtaaagttcaagaagttaaaacctgtgaatagagatcagtgaacattttagaaaatagaaaacgaccactcctattcaacagagtactggaaggcctagccagagcaatcaggtaagagagaaataaaagacatccaaattggaaaagaggaagtaaaattatctctgttcactgatggcatgatcttatacctagaaaacccaaaagacttttggaaaggctcctagacttgataaacaacttcagtaaagttgtaggatacaaaaccagtgtacaaaattcagttgcatttctgtacaccagtaatgttcaagctgagaaccaaatcaggaactcaaccccatttacaacacacacacacacacacacacacacacacacacacacacacacacaaaacctaggtatacatttaaccacggaggcgaaagatgtcttcttaagaagaagttctacaaaacactaatgaaagaaattttaattgatacaaacaaatggattggaagcatcaatattgttagtatgaccaaactgtccaaagtaatctacagattcgacacaatttctatgaaaataccaaagttattcttcacagaattaaaaaaaaatccttaagtttatatgaaaacaaaaaagaccacgagcaaccaaaacaatcctaaccaaaaagagcaaagctagaggcatcatgttacttgaattcaaattatactacaaagctatagtaactaaaacatcatggtactggtacaaaaatagatgcata

SEQ ID NO: 115784 - DNA, 386 bp, Homo sapiens
  misc_feature (57)..(57): n is a, c, g, or t
aaaaatatgattaaacccaacatctctgtacaacgaagaatcttcctgctctgacanaagccagcttacttcaaatagacattagctaaatcagattaaatcttttgggcagcatcctgttataggaattgacctgtataaatacttgtaagttgtactctacataaaatttctataactgttatactcttcactaggatcaccaagttattgaaattttgatgtagatgaaaatacagtgagtattatacaggtctatcccgaggcttggaaaagaatcagaagtgcctacagaaatttggctttttctcctcactgtaacttaacatagccatgcagacagggtcatgtgcagccaccatggtaagtaactaaagatatgttcc

SEQ ID NO: 115785 - DNA, 278 bp, Homo sapiens
gcaaagtacacattctttgtttcaaagtattttgcagacagtctggtctattaagaacaaattctaggactaggtagtagggcttagaagttaccatgacccaaattgattttttcatttctcttaaagttgatggttcattttttgatgaaagtagcaatcatatctataaaaaccaattttgataggcctatcaaatctgcccataaaacagaaagctattttactttctacaaacatattattaaataagctcactgtgagtatacaagtactgt

SEQ ID NO: 115786 - DNA, 650 bp, Homo sapiens
cagggcaacatagcaagaccctgtctctacaaaaaataaaaaacaattagctgggcgcagtaggacttgcctgtagtcccagctactgggggctgaggtgcgaggatcacttgagtccaggagtttgaggctgcagtgagctatgattgctctgctttgctccagcctgggtggcagagcaagaccctgtctcttgaaaactcaagagctggtcctgctgtagaccacactaggattcttttcactgagactcctcttgtgggcttgaagaccaggactgtgtcagcaccagtgttgtttcccttggcccagtatatggagggatttatatttattaagtatgaaaactatgcgccaagtacttgctagaaactctatatatgttattttagttaaggctttttacaacttcaagattaaggaattagtctacatatttcagccaccgagtagtaacttgcccagggacaaagtaagggtaagtctgaaacttggcttcccatccaggtctgatgatggagctcatgccttttacactccactgtgatgtcctgtgctccttagagaagggaacatagtagcttggagaacatttcttgtcctatcttgcttaaggtgtcaggatctccttctgtatgcatggtccagat

SEQ ID NO: 115787 - DNA, 348 bp, Homo sapiens
ggaccagaatggggtgtccacaagtgcacaagtgctgagcacaaggagctgagtcctggaagcctgcagacttttaaccacctttccgcgtgtgtcctggagtgtgagcctcaggcagccacgtggacaaagcgttgtgtagaggatttacttatctttggccaggattttaaaggtatatgcaaaacctgtctaggatgaaactgtggagaacagaagggctgcttttccctgctaaataattttttttagaagaggaatgaagcattctgttgagtttcttactatgatctggataccaaagcctgggactctcatcctctccactctgcttggctacacggggtt

SEQ ID NO: 115788 - DNA, 652 bp, Homo sapiens
agctcagctcttgcctctaaccattgtttcctgtttaatctgtgaaaccccttgagtcgtctgcacacttaatgaccctgtttgttttctcttaactcccacaataggagttatcactccccaaagcacgctctctctgatgtcatcagtgagcccctgatttcaaatccattgacctcctttgagtctcttccccattgatgccattgttgagttccacaccacctgtcccttccttcctcctcctgggaacactctcctttcgtttccgtgccctcctttacttctccgctttgcccctgagattcttgggccccgttggattgggtgatttcctctgtcgcatatcttcagattccacctgcgtggcgttgacttccaagtcgacacttctcactttcacttgtcttctgggtctagtttcatatttcccgcttcctaggggtaactgtacctggattctctgcagacatcttatattagcatgtccaaaagtgaacgtccctttcctaaacacctttctacattccccatctcaccggaaggcttcgccatgcactcagccactgaagccagatgcatggccgttgtcctggaatcctctactctccacagacttactcccaggttatcatcttgttacactctcttg

SEQ ID NO: 115789 - DNA, 190 bp, Homo sapiens
tgcaacttgattctgtgatcgtatctagaggtatcccccctggttcgaagttaggttaggggtaaagctggggctggaattcagtcaggtgacatttccttggagaagtgatttaacctttctgagctttcctttctgcctatgtaaacagaggtattaataataatagtgccacctcctaaggctattg

SEQ ID NO: 115790 - DNA, 284 bp, Homo sapiens
aacacctctacgtcatcagggcgcgtcctcgtctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagaggtgcggtccgcgggacggtacggaagccagcgggagttacggcgtgggggttttggtggggggatgaaagtacgcctttg

SEQ ID NO: 115791 - DNA, 564 bp, Homo sapiens
tcctcgtctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcagggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggagacagcaatcaaatatatgactgatggatgtttactgaaacatattctgggagacccaaatcttaccaa

SEQ ID NO: 115792 - DNA, 238 bp, Homo sapiens
tcggctctaccttgtctccaggcagagctcctgtggactgccttggagacaagggcccttggcatcctggcagcaagtactcacaggaaacttagtatgtgctttatgtggatggcgggtgggagagttgctgatggcaaatggccttttacttttcagtgttttgttgccaacccccacccaaccattaaaaagtggctgttgtgaccagggagcacacacacagacaaagacggaa

SEQ ID NO: 115793 - DNA, 342 bp, Homo sapiens
gatgttgtggtaggaaaatagattttgccacaagctgctacttatagttatgtctatggattgagttgataagtggagatatgcatagccgactcttggcatttatgagggggtatcatcagagatcttaaaaattctagatctgtaaaagtgaaaatgttgatttaagtgcctggcttttttctggaatcatttctgttgagttatgtatttcctatgctttgtctcacaacacaagttaatccctttcaatttcgttaagtttcctcgataactatttttcagaaagaattatttttctcgcttgataagagtgctgcctatataacaacaagtacagag

SEQ ID NO: 115794 - DNA, 239 bp, Homo sapiens
gtcgacaaaaaaaaaaaaaaaaaaaaaaaaaatactaggaaaaatggttagctgggcatggtggtgaatgcccttagtcctaactgcttgggaggctgaagtgggaggattccttgagcccagcagttcaaggttgcagtgaactatgattgtgccactgccttctagcctgggtgacagagtgagaccatgtctctaagaaaagttggtgaggacgccaggggacagctaggaaaaaa

SEQ ID NO: 115795 - DNA, 239 bp, Homo sapiens
tttttgtttttgtattcttcctttctttaccacaaaggtatagaaactcaacaccaactattagaaatgttgtttgatgttccttttgtaactttgttttatggtattcagaacacattttgatgatatcttaaagcctttattgatattagtgggtttttaaaagtcagctttcacagaagtgagaccatgtctctaagaaaagttggtgaggacgccaggggacagctaggaaaaaa

SEQ ID NO: 115796 - DNA, 313 bp, Homo sapiens
taaatataggcgttaagcatcaatgactgccaagatcacaaaaagacagctacattttgtgtgtttcctgtagtcttgccaaagagatccaccgtcagcttgatccattctttggatgtagctgcgtatttgcaggaaatacagaatatagagggaaatgttgaaccgcaccatgagaatgcaatcagcaaaatccagactgggaaactccacaggtcacatggcctgggtctttcaacagaaaagaaaatgaaaaggatggagaggggactgtggattaaaggaaacctaaaagacatttcagcagtgagat

SEQ ID NO: 115797 - DNA, 419 bp, Homo sapiens
ggatttaaaaatttcaggaaaagaattgaatgattacgttttcactgaacatgtgcagacttttttttgcttgtcattattccctaagtcatatagtgtaacaactacttacatagcatttacactgcattaagtattttaagtaatctagagataattaaagtacattggaggatgtgcttaggctacatgcaaatacttcaccatcttatgtaaggacatctgaggattattagcatccaagattttggtatctgtggggagtcctggaatcaatttccagtcgatacttaaggaaaggcttcataccaagttaacatgaccaaaatatacatatttctgataataaggatattttactgcacatgtgtcttaaaaatttcaaagaccttaataaatttggaattttattaaagtgt

SEQ ID NO: 115798 - DNA, 669 bp, Homo sapiens
gcaaacctaacaagagaggccctggcagagcctcatgtgtgcctggtgggaggacctgtatgttgtgagctagagagtgcctgcctggccaaggaccccatctggcctaggcccaagtgcagccacaagttgggtacactgctacaaaagtggccaagcctgaggacagtagcagtgccacctgattccccaagatgtcacctgagaattaaaggcagagctggtagctgggtgagggggctcatgcgtgtaatcccagaacattgggaggccaaggtgggaggatcacttaagcccaggagttcaatcacctgaggtcagggttctccatgttgaccaagctgagttcgagaccagcctggccaacatggagaaaccctctgttaaaaaaaaaaaaaaaattaggccgggtgcagtggttcacgcctgtaatcccagcactttgggaggctgagaccacaggcgtgtgccaccatgccaggctaattttttgtatttttggtagagacaggacttcgtcatattacccatgctggtctcgaactccggagctcaagcgatctgcctacctcagtctcccaaagtgctgggattacaggcatgggccaatgcgcccagccctgaaccatatcttgatgatgcacctcaaaaaactagccccctctctaa

SEQ ID NO: 115799 - DNA, 355 bp, Homo sapiens
gtggagcccctgcctttggcccttgggggaggcactgtctgcttacccacggttgttgcctcataggaatcatacaacagcttcctaactggtctccttgccttcagttggattggggcacaaatccctccttgacatataaaccatggtttaaggctccctgtggcctaaataaagataaagcttaagtatcttaacaagcacctaacccttctccccagcctcggtgatttggctcatcgctgccttcatgtttcattctggcttcactcattcggaatttcttgtagttccttggctgttctcttttccttaccgcctttacaaatgctctcaccatgcatgcttttctctg

SEQ ID NO: 115800 - DNA, 393 bp, Homo sapiens
tggggctgtggagatgagggaatgggttcacaactcttcagagataggattgaagggacttgggggttgattagagcagagactgaggatgaacaattttaaagtgaaagtatgagccaggtgtggtggctcacgcctgtaatcccagcagtttgggaggctgaggcgggtggatcacctgaggtcaggagttcaagaccagcctggccaacatggtgaaaccccatctctactaaaaatacaaaaattagccaggcgtggtggcacgtgcttgtaatcccagctactctggaggctgaggcaggagaattgcttgaacccaggaggcagaggttacagtgagccgagatggcaccattgcactctagcctgggcaacaagagagaaacttca

SEQ ID NO: 115801 - DNA, 455 bp, Homo sapiens
aagagtgcacaagggtaatcatgttgcctgaaggaaaggccctgattgtcattcttatgagtgtccataaaggtcttatttaccattggcatcgttcacagcatacactttcatcataacgaaaatgaagccaaacgtattcgggagagaaaagtcaggtaccagattgctcatcaatttatccaatttcaagtttcatgggaaaacacatattattgtaactcacatttataccccaattgcaagggtacttcagtcataaagattcatcagtgatcaaaacatatcctagcactgttagaatactatactaatattatagaaaatttagtctgtatttagacctcaatgactataatgcattgagcaaaattccaatgtgtcatatttctcaacccttaaaaaaatcaatcctaggtaaaaagtaaggattttctcatgaggattccatcaca

SEQ ID NO: 115802 - DNA, 103 bp, Homo sapiens
gacatctccattttgtgctttttttgttgttgctttaaaagcaaatatattttccagaccacatcaaatatggaacataaaaattaagaacatatgcattcat

SEQ ID NO: 115803 - DNA, 329 bp, Homo sapiens
aatgatgtttttttgaagatgtatctatggttttggttgggtaggacactttagctttgattctgagtatacgcagtagtttggtcgttgtatgatttctttggctctagacagcatcagtagtgtctgtgacttcctcagtggcacaggctatggttgtcagtgtagtccgtagtgcagttttgttggcataaggactccaggtgaacttgtccttgagtccaagtggtggtggcagcatgctaagcatgcctgtccttgggcctctcggtggcgtacacaagcaccaatgttactgggtccaagtaagccaattcgtgggcctccag

SEQ ID NO: 115804 - DNA, 872 bp, Homo sapiens
cgaaaggaaagaaggccaagggaaagaaggtggctccggccctgctgtcgtgaagaagcaggaggttaagaaagtggtgaatcccctgtttgagaaacggcctaagaattttgacattggacaggacattcagcccaaaagagacctaaccagctttgtgaaatggcccccactatatcaggttgcagcggcagagagccatcctctgtaagtggctgaaagtgcctcctgagattaaccagttcacccaggccctggaccaccaaacagctgctctgctacttcagctggcccacaagtacagatcagagactaagcaagagaagaaacagaggctgttggccctggccaaaaagaaagctgctggcaaagggggcatccccactaagagaccacctgtccttcgagcaggagttaacaccatcaccaccttgctagagaataagaaagctcagccggtggtgattgcacacgacgtggatcccatcgagctggttgtcttcttgcctgccctgtgtcataaaatgcgggtcccttactgcattatcaagggggaggcaagactgggacgtctagtccacaggaagacctgcaccactgtcgccttcatacaggttaactcagaagacaaaggcgctttggctaagctagtgggagctatcaggactgactacaatgacagatacaatgagatccgccgtcactggggaggcaatgtcctgggtcccaagtctgtggcttgcattggcaagctcgaaaaggcaaaggctcaagaacttgcaactaagctgggttaaatgtacactgttgagttttctgtacataaaaataattaaaatagaacaaattttccttgaaaaattaaatcaggg

SEQ ID NO: 115805 - DNA, 605 bp, Homo sapiens
gccgggactacagccacgtgccactacgcctggctagttttatttatattttcagtagagatggggtttcaccatgttggccaggctggtctcgaactgctgacttcaggtgatctacccacctcagcctcccaaagtgctgggattacaggtgtgagccactgggcccaccaccctgtcacatatttttatcatatccatctcagacaattgaagtttttcttttcctcaaaaatccaagatgagaggttacaataaatacagtggagcatatttatttgtattctaaactggtcaaatagtcatgtagatggaatcttagaggaaaaattatgaaagattttaaaattaaaaatgcttactcatctagcatactctactgagttttcttagctttttattgtctttgagcttaatataatttattatgtaaattatattgagctgaaaatcatgcaagtgcttttgcccaaagaaatgcaaattaattgtctcaaatagacacgtatttgattatgctaattgtggatattgacttgtttccatctctttgtaaattcattgcaggtttttctgatcgcctatatttatgtatgtttttaaat

SEQ ID NO: 115806 - DNA, 306 bp, Homo sapiens
tgaacagcaacagctgggaggacacagttgcaggcgtaacattcggtcccggagaaggcagcaacagattcaagcccaagagaagtgaggcatgggatgctttaattcaaagacctcctcagctgtaaggtgaacaaatgagggtacagaagagagagttgttagaatctacattggtactttcaaaaatgtttcctttcttccttcctagatgctttctgcattagcactgtgctccatttcttcagtcctatgcccttcccaaaattggcactgcaaggtaagtttaaaagagctgtaatttag

SEQ ID NO: 115807 - DNA, 246 bp, Homo sapiens
tgaacagcaacagctgggaggacacagttgcaggcgtaacattcggtcccggagaaggcagcaacaggtggggtgaaaggaagagaaatggatgtggtaagcttgagggtggggttgtctgagacggatcttggcaggaatcaaattctctacttcagagggaatctctctgggcatgacagcccatgtgcctgaatgtctgtcctttttctgaacaaatacatcttgaaaaaagagtgaggatta

SEQ ID NO: 115808 - DNA, 490 bp, Homo sapiens
acacgcttacacggccatttgtctcttttcccaatgcggcggtgcactttcgctcttgggggctgcaccccagacatagctggcaccagagcagggtgctcaggtggtgggtgctcagggccctgccccaggccactgggccgttttgatgacctcgaaggtcacaggcagaaaataggagcaggatttcccctggggaaaagttctcctgggacatcttctgctcttctgtacatttctagatgcaaataactccttcaccaggcagtgagtggcgtaggctctggagccaggctgcctgggctccaatgccagctctgccacttgctagctgtgagactgtggacaaaccactcagcctctgtgtgcctcagttttcctatttgtaaaatagaggccatagtggtacctattttgaagactaagtaaaagaattcaaataaagagacttggcacagagtaagtgctcagtaaatggttaaaaaaaaaa

SEQ ID NO: 115809 - DNA, 1253 bp, Homo sapiens
tcctggcctggaatcctcagcctctctggccgccagtagcctgaggctacggctcctgctagagagggtggcaggcctgctgctggaccccagaggccactgtgaccgccaaggggccttttccacttccacggcctctccaggcactgaggggaaggcattgctctacctctccctgacattttgctccggggcagatccaaccttacctggggcagcaaactttgtcctggtacctgggcccagctcgccagggatgtgggcagagcaccagcctgggcatcaggaagccaagtttcaaggactgtctttgagtctgtctgtatgaccttgggcctgccacttctcacagaccctaggtatccacagctgtgacatgggggcaagcggctttgtttcagcctaacccaggagcttagtaaaaattgcataagaccagggggaagagtgtcagcgtggggtgggaattcccgcggcctccacctgcttgctaggggcaggatctcattcaggctgccctggaagcacctgcttggccctgccaccttcctccaggggagggccagatggcatcctggcttggggcgggtgggacctacccaggctctgagactttactggcctatgcctgaggcctcttttcctttaactccctaaattatgatgactccaagtccaagcccacccttcccaaagattgggaggttccgccgttcccagaggctcctcctgcggtgctcccaagacttccatagaccatctggaccagtagcccatcccgcagttttcttgggggcagaggaaaacgcttctttctcctccagctgaatcagctggatcccagtgtcctggctgtttggtgattgggcaagattgaatttgcccaggtaggcgtgagagtgtgggttttgatgacctcgaaggtcacaggcagaaaataggagcaggatttcccctggggaaaagttctcctgggacatcttctgctcttctgtacatttctagatgcaaataactccttcaccaggcagtgagtggcgtaggctctggagccaggctgcctgggctccaatgccagctctgccacttgctagctgtgagactgtggacaaaccactcagcctctgtgtgcctcagttttcctatttgtaaaatagaggccatagtggtacctattttgaagactaagtaaaagaattcaaataaagagacttggcacagagtaagtgctcagtaaatggttaaaaaaaaaa

SEQ ID NO: 115810 - DNA, 1127 bp, Homo sapiens
tcctggcctggaatcctcagcctctctggccgccagtagcctgaggctacggctcctgctagagagggtggcaggcctgctgctggaccccagaggccactgtgaccgccaaggggccttttccacttccacggcctctccaggcactgaggggaaggcattgctctacctctccctgacattttgctccggggcagatccaaccttacctggggcagcaaactttgtcctggtacctgggcccagctcgccagggatgtgggcagagcaccagcctgggcatcaggaagccaagtttcaaggactgtctttgagtctgtctgtatgaccttgggcctgccacttctcacagaccctaggtatccacagctgtgacatgggggcaagcggctttgtttcagcctaacccaggagcttagtaaaaattgcataagaccagggggaagagtgtcagcgtggggtgggaattcccgcggcctccacctgcttgctaggggcaggatctcattcaggctgccctggaagcacctgcttggccctgccaccttcctccaggggagggccagatggcatcctggcttggggcgggtgggacctacccaggctctgagactttactggcctatgcctgaggcctcttttcctttaactccctaaattatgatgactccaagtccaagcccacccttcccaaagattgggaggttccgccgttcccagaggctcctcctgcggtgctcccaagacttccatagaccatctggaccagtagcccatcccgcagttttcttgggggcagaggaaaacgcttctttctcctccagctgaatcagctggatcccagtgtcctggctgtttggtgattgggcaagattgaatttgcccaggtaggcgtgagagtgtgggttttaaattcgaagctcaggccatagtttcagagaatcacccttaccccagaccttcatgagacagtgctcatgaagccagtgcgtttcccagaacgaacactaggcggcaccgttggtccacactcagaggcccttggcgccaagactgcatctagaatcgctcaaacacctgtttgcagaccccatgcaccagctggaggggccgtaactgcaggactg

SEQ ID NO: 115811 - DNA, 897 bp, Homo sapiens
cctgacttcaaattatactacaagggtatagttactaaaacagcatggtactggtataaaagtagtcaatgggacagtccaatggaacagaatagagaaatcagaaatgaagccaaatacatacaaccaactaatcttcagcaaaaaaaaaaaaaaaaaaaaaaaaaaaatttttgggggggcttgggccttggaaaagtttttaaaaccattcgcgtgttggggcggcggcgggcgacaaattaggtataagggagaacttgtgggcaaaaagggtggtccataagaagaaactccggggcaatgagaaatagggggtgggagtttgtttcacaatattagagaaaaagggccgggggagggacaaaccgagaggtgtgttgagacaacaaattgcacagaaaggaggatatcccgcggagaggggcacaaaaaagggggggaactacctaaataccaagaggaggggagctcccacagagagcgaagcctcgcgataacatcgcacatattgaacggcaccacgcacgtagccgggcgaacacaacagcacaaaagaacagagacaagcaggaagagacgaataagaggagaaagatcaggagaaaacgactgaaagaaagaaccgcacgaaaggagcgcaggcacacaaaagacagaagaacgaagaagagggaaaaaacaaccaaaacggaacgcacgcagaagaccacgacagggaaagagaaacggaccgcgacacagaagcaggacaaaggggaagacacccgaagaacaggacagatcaacaaagcaatcgaagggcgacagacgaagaagacgacgagcacacaaagcgacacaagcgccgcacacacaaccacacacggcacagagaaaggatgcgcagcaacgaaa

SEQ ID NO: 115812 - DNA, 420 bp, Homo sapiens
cccagaagtaaaggctaaaaatataaatctaaaaggaaacaatattttcatgaccttggggtaggcaaagatttattaaagaggacacaaaaaacaacaaacagaagaaaaacctgaaaattgcatcaatataagtgtctgctcctcaaaagacacctttaagaaaatgaaatggtaagccacagactggaagaagatatttcgaatacatatatttaacaattttgtatcctgaataaataactcctgtaaatccataaaccaaaaaactccaaagtcaggcaaaagattggagcagatgcttcacaaaagatatatgaatgacccagtaagcacatgcaaatgtgcccaccattaattatatgggaaattaaaattaaaaccacaataatataccatttcacaccgaccaagatggaa

SEQ ID NO: 115813 - DNA, 230 bp, Homo sapiens
gtccaaatttgatctggactggattcccagggcttagcccagcaccttgccacagtctgagctcaggatacgttcaccgaaagcaggagttaatgagagaatgaatgacaacacctattcatgccttgtgtggactcattcctggggacttggatgaggcaggtatttgtctgcaagtggccctgaggctcccacaggtacttctgaacgcagaggatgcagctcatggg

SEQ ID NO: 115814 - DNA, 364 bp, Homo sapiens
ctggaaggaagggacaggagagaaaagggaaaatgacgaagagccggcacaacctaaaacaccacagtccctgcggccttctaactaaggggccacagccacacaccactccacagaccctgaggatatgactgtgaggacaaagtcatgaacatgcatcagatgttctagttccaatgctaatttttgctgttttagtgtttgtagtgtaactacaagccatttagcctccctcaacctcagcttcttcaatcataaaatgaagatagtcaagttgcctttccagatctccacgttgaatatgaaagcagtctaagaactaaagtgtgataacatgtacaggtgaagaatgttatttaattaa

SEQ ID NO: 115815 - DNA, 248 bp, Homo sapiens
gtgaattcagaagggttacatattttggggatgaagttagggaaatttgaatataggatggttattagatgatattaagaattattagttaattttgttaggtgtggtaatggtattgtagctgagtgccctcatatttaagagattcatattgtagtatttatgggtgaaatgtcaggatgtctgcaattcacttcaaaataattcagcaaaaatgatgaagcaaatatggcaataagctaataatt

SEQ ID NO: 115816 - DNA, 593 bp, Homo sapiens
caatttgatactccccacagcatccctctaacactggtattatcaccatcgtattgttgaaggaaataaccttagaagacagtgccaaagccaaaatgagatatctagaatttacaacgttcagattcaatactcagtccacacgcacagtggcatgagcataaatttcaaccctagtattaatgtttatcaaacatttaattcactaaaaaattttcaattttcacaaggaatctacaacccaataagacccacccaaacatgtctcaaatgacatgtcaaagtgaattcactgacttactccccaaatggctccttttcccaacatccctacatctgcttatggtaatgctcttttctggataacctaaactcaaaaccttgataatctctttgcatctaattagctgctaaactttaagggctctgatcatggcactgtccataacaaaaaaaaattaaaaaaaaaaaattcagtgacttcctactgcctagcaaataaaatccaaactcttacaccaacacaaaggattcagagctctccacaatagagccccaaagtgccttaatacacagcctaaataacaactaag

SEQ ID NO: 115817 - DNA, 798 bp, Homo sapiens
actctgtgtgatgtaaagtatgttccctaatgtctgtgtgctccgttgtctccctcccatctgtaaagtgttagtagcctgtctcattttgagggtgtagtacagatgacatgatgagtaatccctgtgcctgttctacgactgctaagtgaatactagtaatttgcattctgagtttttttagtctgttttacccagcaagcctctgtttgccttcccaatttttactgcccagctttaaaaattacctagtcttcatttgcaggtctttttagaaatagtttacatgtagataccctccagtagtattaaatttaaaaacaaatggttttgaatcctctaactccagagcagtttcctactgattgtcaactctctaactttactacaaaggaaatattgaaaacaaatatgagaagtgtttttctctatttttgtctcattttttgagagtagttaaggatattatgctatagttgtgttcagggtccaagttttacaagattggccctgttcacagatttagctgacacttcccccatgtagcctcctagaaccttctacttaaacgtgtaccacttactactgtgttttgggtccttaaactgtttggggctttttctaaaagtgtaattaaaaccacccaagagtgagactttctgccaagtaaaggttaaatgaggttggtcacagtttgaatattcataggaaggaaagatctccacacatcatagtttaatttctatatttagagaaataatttttgaacccctggatgttttccccaggacacaattt

SEQ ID NO: 115818 - DNA, 324 bp, Homo sapiens
ctcagcctaattcagactcgcctcttctccttagagaaaggaagaggagcctcttccttatgctctgctcaatgtgtagggtttttcttcctatttgttgcaattctgaacattattagtggatagtcctggttttgagacttacccctgccttagaccccctgttcctagctcttatttcctgggacccagtttcatttttctctttctggatctcaactctcatccctgacagggcatgatcattatgttatatgatctctcttggttatatacaaagaatgtaccagtttgtggagtattcatagactttttttggttttg

SEQ ID NO: 115819 - DNA, 759 bp, Homo sapiens
atttgctgaatctagattctcatttgtcaatctaccagtcagaatcttgtcagtagatgcaaacacatcaggaatttgaaatgagagaattcgaaacaaatgttcctagctaactagtaaaaaatgtaaaagatatctctaaagtgtcccaaagtggcaaattcaaaacagcagctgctacctcaagggtgaggggaagtgaaaaatgaaggaagctaaggtattaggagaattctgcctctctaccccagcattgtcaaagaacgcatgcgtaccaaaagtacaagcagcctgctgggtgtggagaaattcgtcacatggcattgagtggagctggtgagtagaagtgtcctacccttggtagcgagcacaatactgcaggagctggcctgtagaatagagtggggaagtagtaatggtgaagttggagctcccatggaagaatccgccaggtagggagagcaaggtctgaaaatgcatctgacattagtccaggggagcctctgaaatgagtgctgcaagggttctgcatactcatccgctgcctctcacatagatgggaatgaaggcgtccgcaaaccagaagagactgcctatagtcccatagccttgcacattccctccagcaaccactgttggcaaagcctaaatttgcacaaaggagaaatgttacctgtcccagctccaacatcaggaagcagtgcaaagggggtactgaaagacactgcatttgtaactaaagtagggttttgtaggatg

SEQ ID NO: 115820 - DNA, 467 bp, Homo sapiens
agttaagtcacgggagggcgtagcaccgaagtggtagagagctgcggctccggaacgcccggcaggcccagagacgcagcagatggtgcctgaagagagagggcgttgctgcaagcgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggagctcttcgttgctgcaattgcctcaggtggaataagccttcctaaggaggaccagataagaatctttggaaatggctttttttttttttttttttttttttttaaagaag

SEQ ID NO: 115821 - DNA, 562 bp, Homo sapiens
aaagataatgcttttattttaaagaaaaagtgccaagaagaaactgggagaatttccccacagcagcttattttgaaaatattcacccgggcatggtggctcacgcctgtaatcccagcactttgggaggctgaggcgggcggatcacgaggtcaagagatcgagaccgtcctggccaacatggtgaaaccccatctctactaaaaatacaaaaattagctgggcctggtggtgcgtgcctgtagtcccagctactcgggaggctgaggcaggagaatcgcttgaacccaggaggcggaggttacagtgagttgagatcgcgccgctgcactccagcctggtgacagcgagactgtgtctccaaaaaaaaaaaaaaaaaattcaaaacgataggaaagttgaaagaatactaaagtcatttaatatccacatacccttcatctagattgtatctgttgttaacattttgccacatttgatttatttatgaggctatattttatttttgtgctgaataatttgaaagtttgctttattcctcatttataaactctcttgcatg

SEQ ID NO: 115822 - DNA, 288 bp, Homo sapiens
ggtcacagaccctgtacatcttatcatcccacgaaacaagatggggggaaatgttggacttaggtacacttcatagtttttatatatgctttatgtaagtttttcatagtccccataccatccttatcaggtacacattattgtccccattactcaaatgagaacttaaggttaagtgactcttccaagttcacaagccaagaaaagagcaaaaatttgtacctaaattctcctaatctgggaaccattccaccacactgtactacctcttagattcatgtgtatcat

SEQ ID NO: 115823 - DNA, 498 bp, Homo sapiens
ccctctgacaccctgtacatggccccattagctaattgcagatgagccccaggcacacacagggtagggaccaccacctccagttctttcctatgaaagaatatgagcagaccccgtctgagtttagaaacgggatatgagtgggtcatctgtaattcctgtctgtcgtacaacggaaattggtgatacacctggcagctggtgttttccctctctgaatctggggcattgtttggtcatcgagctcacaatgacttctggtttagaggagaaccttttggaggagaatatacaaggacctctcagtgatttccagtggtctctccttgaccctcagaatggctagtcgtcttgtccagctgggagcctgggctaatcttgctggaaggcagagaggggttattaaaagtcagaaagtggccgggcacagtggcttgtgcctgtaatcccagcactttgggaggatggggcaggtgaattgcttgaggtttagagttc

SEQ ID NO: 115824 - DNA, 554 bp, Homo sapiens
ctggcagaacagagtcatatttctcttctttcagaaagcgaataggagaaatatcgctgaattcttttctcagcaaggaataaccccgggaaaacgaatgcattctcaggggtaggtctctaaaatggccactctgggagtgtctgtcttatgcagttgtagacacgggatgaaatatgccctggcctcctgcagcacccccaggcttgctaggattaggaaattccagcctggcgaattctagtcagactggttgtctgatcacgaaccctgtttcctgttaagatgtttatcaatgacaatgtgtgcccagcacgacatggaccttcatcagtaattctagtttcaccctggccttgtgatctcactctgcctctttgctgttgtgatattttactgcctttgaagcatgtgacccactccctattcgtacacccctccccttttgaaacccctaataaaaacttgctggttttgtggctcaaggggcatcaaggaacctgccaacatgtgatgtcacccccagagacccagctgtaaaatttcaaaaaaaa

SEQ ID NO: 115825 - DNA, 417 bp, Homo sapiens
tgtgagcactgtgtaggggtttgctgtccttaccagtactctccttattctcagtcatctccagccatgcaacttccctcacctcctgactgatgatggtcagtcggcccatgcctgccttcacaatgtacaaccctgaagacccagaagttggttttgtccattcccatggctaggatgccaagtgttattaggggaaaatgaacccttcttggtgtgttggacagactcactatgatacctgttctttggaacagtcaccagtacacagagatgggctgccagtgagcccttgtgctctggctgtagctgattgtctaggagtgaacatgtagcctaggctgggcccatcattccatctcccaggaaactgaatctggaatggaggccttgactcgatcctgatcaatggcagaa

SEQ ID NO: 115826 - DNA, 654 bp, Homo sapiens
attgcatataaaaagttacttttttggaaacataaaagtacgttttaaaacttgaacatgacatcattagcactaattctggtttaaatgaaagtcctgcagaaatgccaaagaaggcagggcagagcggcacggattctaggtaattaaaagtgaaagaggcagaagaatagtggacagaactgcaggatagtccttaaaataatggtggtgggaaaggaaaacacagaatgctcctggcaattctaaattcctaggtttgcctttctagaattccttaagaagctgacagagaaatcagagggttacaagaatttcagaaaatttactccaagtgagaggacatactcacaactcctatgaagggtttctaaggtctttgtcctgtgcaatttgacaatgtgccatttctgtgctgtctctgccctctccctatccgtttgttatgggatggggggttaccctgggaatgatttcagctgcttcttacacagatgcctctcaaggtgttcttttgtgtcctctattttcttcttgtgaactgttaaagctacatgcattattttttttccatttactgaaataaagttttcaagttctaaataaaaatattctgactcgatgaaataaataaaggctacaaaagaaggaaga

SEQ ID NO: 115827 - DNA, 833 bp, Homo sapiens
agcggaagactgcatccggctccaggaaaagcgagtgggatatcccaatctttggactgcatcctggttgcctctactgtggtcacctttgggaagaaatgtcttctgtaaaaagaagtctgaagcaagaaatagttactcagtttcactgttcagctgctgaaggagatattgccaagttaacaggaatactcagtcattctccatctcttctcaatgaaacttctgaaaatggctggactgctttaatgtatgcggcaaggaatgggcacccagagatagtccaatttctgcttgagaaagggtaaacattttaggctgtaccacctgaaagggtttgtggtttaatttctttgttacatatttactttaaaattttgcttgtttccatatttatattgttgaactactaaataactcattggctaatttatgtaaaaatgtagcacaatttttctaacttaaaactttgtaacctttttcattgagaaattatttctttatagcaaagcaaatttatgaggagtctaattataaattttcctcccaaatagaaaatgcagatctcactatgactaccaaggacttcttgtagaattttggtatctctttatagtgcataaagcttaatactgttttattttgtgagtaattatccagaaagtgtaagtatccactgtctcttaactttttgtcatttatgattgttcttttaaccttcccaatagtaaactatgtaacaaaagaaaaaaaatctatgtaatcattaaaaagaaggactttaatatgtatctggaaatattttagtgaaataaatacggagaaagtgttta

SEQ ID NO: 115828 - DNA, 803 bp, Homo sapiens
tctctctctctctctctctctctctcctgcatcctggttgcctctactgtggtcacctttgggaagaaatgtcttctgtaaaaagaagtctgaagcaagaaatagttactcagtttcactgttcagctgctgaaggagatattgccaagttaacaggaatactcagtcattctccatctcttctcaatgaaacttctgaaaatggctggactgctttaatgtatgcggcaaggaatgggcacccagagatagtccaatttctgcttgagaaagggtaaacattttaggctgtaccacctgaaagggtttgtggtttaatttctttgttacatatttactttaaaattttgcttgtttccatatttatattgttgaactactaaataactcattggctaatttatgtaaaaatgtagcacaatttttctaacttaaaactttgtaacctttttcattgagaaattatttctttatagcaaagcaaatttatgaggagtctaattataaattttcctcccaaatagaaaatgcagatctcactatgactaccaaggacttcttgtagaattttggtatctctttatagtgcataaagcttaatactgttttattttgtgagtaattatccagaaagtgtaagtatccactgtctcttaactttttgtcatttatgattgttcttttaaccttcccaatagtaaactatgtaacaaaagaaaaaaaatctatgtaatcattaaaaagaaggactttaatatgtatctggaaatattttagtgaaataaatacggagaaagtgttta

SEQ ID NO: 115829 - DNA, 826 bp, Homo sapiens
ggggctcccgcgacagggcggaggtgcggcggtactgaggtcgtagagtttcctgcccaagctgagatggggaaaaggaagcgctacttagggtgtgatttcacctcgaaagaaggaatctcacagtagtggcaagaaagaagaaatgtcttctgtaaaaagaagtctgaagcaagaaatagttactcagtttcactgttcagctgctgaaggagatattgccaagttaacaggaatactcagtcattctccatctcttctcaatgaaacttctgtccaatttctgcttgagaaagggtaaacattttaggctgtaccacctgaaagggtttgtggtttaatttctttgttacatatttactttaaaattttgcttgtttccatatttatattgttgaactactaaataactcattggctaatttatgtaaaaatgtagcacaatttttctaacttaaaactttgtaacctttttcattgagaaattatttctttatagcaaagcaaatttatgaggagtctaattataaattttcctcccaaatagaaaatgcagatctcactatgactaccaaggacttcttgtagaattttggtatctctttatagtgcataaagcttaatactgttttattttgtgagtaattatccagaaagtgtaagtatccactgtctcttaactttttgtcatttatgattgttcttttaaccttcccaatagtaaactatgtaacaaaagaaaaaaaatctatgtaatcattaaaaagaaggactttaatatgtatctggaaatattttagtgaaataaatacggagaaagtgttta

SEQ ID NO: 115830 - DNA, 4180 bp, Homo sapiens
agcggaagactgcatccggctccaggaaaagcgagtgggatatcccaatctttggactgcatcctggttgcctctactgtggtcacctttgggaagaaatgtcttctgtaaaaagaagtctgaagcaagaaatagttactcagtttcactgttcagctgctgaaggagatattgccaagttaacaggaatactcagtcattctccatctcttctcaatgaaacttctgaaaatggctggactgctttaatgtatgcggcaaggaatgggcacccagagatagtccaatttctgcttgagaaagggtgtgacagatcaattgtcaataaatcaaggcagactgcactggacattgctgtattttggggttataagcatatagctaatttactagctactgctaaaggtgggaagaagccttggttcctaacgaatgaagtggaagaatgtgaaaattattttagcaaaacactactggaccggaaaagtgaaaagagaaataattctgactggctgctagctaaagaaagccatccagccacagtttttattcttttctcagatttaaatcccttggttactctaggtggcaataaagaaagtttccaacagccagaagttaggctttgtcagctgaactacacagatataaaggattatttggcccagcctgagaagatcaccttgatttttcttggagtagaacttgaaataaaagacaaactacttaattatgctggtgaagtcccgagagaggaggaagatggattggttgcctggtttgctctaggtatagatcctattgctgctgaagaattcaagcaaagacatgaaaattgttactttcttcatcctcctatgccagcccttctgcaattgaaagaaaaagaagctggggttgtagctcaagcaagatctgttcttgcctggcacagtcgatacaagttttgcccaacctgtggaaatgcaactaaaattgaagaaggtggctataagagactatgtttaaaagaagactgtcctagtctcaatggcgtccataatacctcatacccaagagttgatccagtagtaatcatgcaagttattcatccagatgggaccaaatgccttttaggcaggcagaaaagatttcccccaggcatgtttacttgccttgctggatttattgagcctggagagacaatagaagatgctgttaggagagaagtagaagaggaaagtggagtcaaagttggccatgttcagtatgttgcttgtcaaccatggccaatgccttcctccttaatgattggttgcttagctctagcagtgtctacagaaattaaagttgacaagaatgaaatagaggatgcccgctggttcactagagaacaggtcctggatgttctgaccaaagggaagcagcaggcattctttgtgccaccaagccgagctattgcacatcaattaatcaaacactggattagaataaatcctaatctctaaatctaagaactaagctttgagtattatttaataatttctaataacactcattcctcaagtgatattagagattattcagtactcttgagagtgtcacaacacaaaatacgatgttgggttttcgaaatattttcaaagtgttctgtcttaatcacaaattcatatttttacacatttttacaatattgcctcagattatgttaaatttgggtcagtcttctctgaactttttctctcttggtttcttttcttccttcacagttttatctcacaaaaccatttttctaataagagacatcatgttggaaagatgttgtagaaatgtgcataaatttcagtgcctcttgtaagcattaaactgatgatgaagaaagttcctgatttgagaaatgaatcaaagtaattttaatgaatttttagcttgtattagcttgagttagctggcattgattttttagtccttttgttacctttaagttgtcaatatatggtttttgttcatctccccattgtagtcccacttgctctttcctgggggttccattgttctagcagtggaggtgttacagtgtcgccactcgtctaatttgaccagtgttaagaattttctaatttaataatttaatagtgatctcaataccacaccctcatggaaggagaaaagcatactattatatctgggacctctcttttagacctaaaattaattaacatatctacttatatgttacttatacctaaagctgttattaagacaaaccaagattctctgcttttgcactgaaattaaacttgaaaggaattctcctcaaaggtcggatattaaataagtcccaggcagatttacatatttaatttaaaacattggctttatttcattttgtgatgagtgatgtatctgtgttaacaaaaaattgtataatcattaccaatactatttattatgctcaaatatatcttggctttgaccttatttcaacacattctaagaagccttgacaaagtaagtatattttagagctgaatcagtaagattctagagaaagcaaaacatagtagttcacaattttgcaacatagaaagtcacattttgaaaggctattttgaaattgatttaatagctattatagtttatgaatatcaaaatttgtataatttgcatctttactaatgtatgctagagctacaagagaccttaaggataatatatgaaattagctttccttattttatagataaggaaaaagaaattgtgaaaggtgaatttacctaattagtgaaagttacataactaattacaacagtctgtactatataatgcagaggacgattctccctgtaaaaggaactagaagctattactaaaaatatatatagacaaaattaaaagaaggaatgataagaataaatttaatttaccaaatattgttaattaaaattttagatacttaacatttatttaacttaaataaaagataactgtcagataaaactttattttactaatgagcagtgattttcttaggaattgatgaaggcttattggtatcaagaatttaaaccaaattaaaactgacagaggacatttagatacataataaaattcgagctacataagtatatggaaaataatgtaccttgattattatgaaatagagcatcttgaaattcagttttactctaaatgtacttttaatacttgcagattctaagattacattgtaaaattccaggttttcataatgttaaaataggaaagtagaatataaagtatcaacaagtgtagttatacattttgttttggatatttaatccttacttgggaaaaaatcagcatctaggtaaattattattttaataagaactcttaaattgccaacctctgagaggtgaaaagctatgtaaatagaaggaatggccagttcaaaagaatagtagatgtgatagtgccgtgaatgtattctactggaaatgaatgtaataatacattaaatttttaaaatctaaaaaaaaaaaaaaaaaaaaaaaaaaaaaaaaaaaaaaaaaaaaaaaaaaaaaaaaaaaaaaaaaaaagagaacagaacaagaaaaaaaagaaaaaaaagaaaaaaaagagaagaaagaagacgacgaacgcacaagacccgccaacgcccacggaaacgagacgaaagaaagaagaaaaaacgaaacaagaagagaaagaagaagaacaacaagagaaggagaacaaaaagagaacaaaaaaaagcacaaacaaaacgagaaaacgaaaaacacagacaaacgaagcccgccacacaaaagcaagaaaagaaaagagcaaagaacaaagaacaagacaagaaaacgagaagcagccaaaaaacaaagaaaacaaacacaaaaaagaaaagaaaaatagaaaaaaaaaaaagaaaaaaagagaaagaggaagagagaaaaaaggagcacaaagaagaaaaggagggaagagacagcaacagaaagaaaaagcagagaagaagaagaggaaaggaaaagaaagaaaaaacgaagaacgaagcacgcaacaacgcaccaaagggacaaagcgacaaaaaggaaagagagaacgaaaaagaggaagacgcaaaaagagaaaagggaaaaaacaccgaacgagagccgacaagaagacaaccacagaggcaggcagagacagggagcagaga

SEQ ID NO: 115831 - DNA, 1349 bp, Homo sapiens
agcggaagactgcatccggctccaggaaaagcgagtgggatatcccaatctttggactgcatcctggttgcctctactgtggtcacctttgggaagaaatgtcttctgtaaaaagaagtctgaagcaagaaatagttactcagtttcactgttcagctgctgaaggagatattgccaagttaacaggaatactcagtcattctccatctcttctcaatgaaacttctgaaaatggctggactgctttaatgtatgcggcaaggaatgggcacccagagatagtccaatttctgcttgagaaagggtgtgacagatcaattgtcaataaatcaaggcagactgcactggacattgctgtattttggggttataagcatatagctaatttactagctactgctaaaggtgggaagaagccttggttcctaacgaatgaagtggaagaatgtgaaaattattttagcaaaacactactggaccggaaaagtgaaaagagaaataattctgactggctgctagctaaagaaagccatccagccacagtttttattcttttctcagatttaaatcccttggttactctaggtggcaataaagaaagtttccaacagccagaagttaggctttgtcagctgaactacacagatataaaggattatttggcccagcctgagaagatcaccttgatttttcttggagtagaacttgaaataaaagacaaactacttaattatgctggtgaagtcccgagagaggaggaagatggattggttgcctggtttgctctaggtatagatcctattgctgctgaagaattcaagcaaagacatgaaaattgttactttcttcatcctcctatgccagcccttctgcaattgaaagaaaaagaagctggtaagaaatgaatgctgcttttcattggtaaaatctggtttttagacttgagttggagttgtatgtatttgcactttccaggggcactctttttccagtaagcagtgaaattagactgtcttcatcagaaacttcttaaagttctcaccctaggggactactctcctgggcagttagtagttctaatcagcccagactgatttcctgagaattaaccctggtgcatgatgatctcatttgattcttcattgaataattcttagttcctgctacacgtagaacatgatggcaaagactttgactgttttgttttgtattctgttgatggggctttttatggcatggtaagaaattggggtttgattctaaagccatttaaatgtaacctaacctgtgtttaaaatatttttttaaaaaagacactgcacactggctgcatcatagagcataaattg

SEQ ID NO: 115832 - DNA, 3493 bp, Homo sapiens
agcggaagactgcatccggctccaggaaaagcgagtgggatatcccaatctttggactgcatcctggttgcctctactgtggtcacctttgggaagaaatgtcttctgtaaaaagaagtctgaagcaagaaatagttactcagtttcactgttcagctgctgaaggagatattgccaagttaacaggaatactcagtcattctccatctcttctcaatgaaacttctgaaaatggctggactgctttaatgtatgcggcaaggaatgggcacccagagatagtccaatttctgcttgagaaagggtgtgacagatcaattgtcaataaatcaaggcagactgcactggacattgctgtattttggggttataagcatatagctaatttactagctactgctaaaggtgggaagaagccttggttcctaacgaatgaagtggaagaatgtgaaaattattttagcaaaacactactggaccggaaaagtgaaaagagaaataattctgactggctgctagctaaagaaagccatccagccacagtttttattcttttctcagatttaaatcccttggttactctaggtggcaataaagaaagtttccaacagccagaagttaggctttgtcagctgaactacacagatataaaggattatttggcccagcctgagaagatcaccttgatttttcttggagtagaacttgaaataaaagacaaactacttaattatgctggtgaagtcccgagagaggaggaagatggattggttgcctggtttgctctaggtatagatcctattgctgctgaagaattcaagcaaagacatgaaaattgttactttcttcatcctcctatgccagcccttctgcaattgaaagaaaaagaagctggggttgtagctcaagcaagatctgttcttgcctggcacagtcgatacaagttttgcccaacctgtggaaatgcaactaaaattgaagaaggtggctataagagactatgtttaaaagaagactgtcctagtctcaatggcgtccataatacctcatacccaagagttgatccagtagtaatcatgcaagttattcatccagatgggaccaaatgccttttaggcaggcagaaaagatttcccccaggcatgtttacttgccttgctggatttattgagcctggagagacaatagaagatgctgttaggagagaagtagaagaggaaagtggagtcaaagttggccatgttcagtatgttgcttgtcaaccatggccaatgccttcctccttaatgattggttgcttagctctagcagtgtctacagaaattaaagttgacaagaatgaaatagaggatgcccgctggttcactagagaacaggtcctggatgttctgaccaaagggaagcagcaggcattctttgtgccaccaagccgagctattgcacatcaattaatcaaacactggattagaataaatcctaatctctaaatctaagaactaagctttgagtattatttaataatttctaataacactcattcctcaagtgatattagagattattcagtactcttgagagtgtcacaacacaaaatacgatgttgggttttcgaaatattttcaaagtgttctgtcttaatcacaaattcatatttttacacatttttacaatattgcctcagattatgttaaatttgggtcagtcttctctgaactttttctctcttggtttcttttcttccttcacagttttatctcacaaaaccatttttctaataagagacatcatgttggaaagatgttgtagaaatgtgcataaatttcagtgcctcttgtaagcattaaactgatgatgaagaaagttcctgatttgagaaatgaatcaaagtaattttaatgaatttttagcttgtattagcttgagttagctggcattgattttttagtccttttgttacctttaagttgtcaatatatggtttttgttcatctccccattgtagtcccacttgctctttcctgggggttccattgttctagcagtggaggtgttacagtgtcgccactcgtctaatttgaccagtgttaagaattttctaatttaataatttaatagtgatctcaataccacaccctcatggaaggagaaaagcatactattatatctgggacctctcttttagacctaaaattaattaacatatctacttatatgttacttatacctaaagctgttattaagacaaaccaagattctctgcttttgcactgaaattaaacttgaaaggaattctcctcaaaggtcggatattaaataagtcccaggcagatttacatatttaatttaaaacattggctttatttcattttgtgatgagtgatgtatctgtgttaacaaaaaattgtataatcattaccaatactatttattatgctcaaatatatcttggctttgaccttatttcaacacattctaagaagccttgacaaagtaagtatattttagagctgaatcagtaagattctagagaaagcaaaacatagtagttcacaattttgcaacatagaaagtcacattttgaaaggctattttgaaattgatttaatagctattatagtttatgaatatcaaaatttgtataatttgcatctttactaatgtatgctagagctacaagagaccttaaggataatatatgaaattagctttccttattttatagataaggaaaaagaaattgtgaaaggtgaatttacctaattagtgaaagttacataactaattacaacagtctgtactatataatgcagaggacgattctccctgtaaaaggaactagaagctattactaaaaatatatatagacaaaattaaaagaaggaatgataagaataaatttaatttaccaaatattgttaattaaaattttagatacttaacatttatttaacttaaataaaagataactgtcagataaaactttattttactaatgagcagtgattttcttaggaattgatgaaggcttattggtatcaagaatttaaaccaaattaaaactgacagaggacatttagatacataataaaattcgagctacataagtatatggaaaataatgtaccttgattattatgaaatagagcatcttgaaattcagttttactctaaatgtacttttaatacttgcagattctaagattacattgtaaaattccaggttttcataatgttaaaataggaaagtagaatataaagtatcaacaagtgtagttatacattttgttttggatatttaatccttacttgggaaaaaatcagcatctaggtaaattattattttaataagaactcttaaattgccaacctctgagaggtgaaaagctatgtaaatagaaggaatggccagttcaaaagaatagtagatgtgatagtgccgtgaatgtattctactggaaatgaatgtaataatacattaaatttttaaaatcta

SEQ ID NO: 115833 - DNA, 3439 bp, Homo sapiens
agcggaagactgcatccggctccaggaaaagcgagtgggatatcccaatctttggactgcatcctggttgcctctactgtggtcacctttgggaagaaatgtcttctgtaaaaagaagtctgaagcaagaaatagttactcagtttcactgttcagctgctgaaggagatattgccaagttaacaggaatactcagtcattctccatctcttctcaatgaaacttctgaaaatggctggactgctttaatgtgtgacagatcaattgtcaataaatcaaggcagactgcactggacattgctgtattttggggttataagcatatagctaatttactagctactgctaaaggtgggaagaagccttggttcctaacgaatgaagtggaagaatgtgaaaattattttagcaaaacactactggaccggaaaagtgaaaagagaaataattctgactggctgctagctaaagaaagccatccagccacagtttttattcttttctcagatttaaatcccttggttactctaggtggcaataaagaaagtttccaacagccagaagttaggctttgtcagctgaactacacagatataaaggattatttggcccagcctgagaagatcaccttgatttttcttggagtagaacttgaaataaaagacaaactacttaattatgctggtgaagtcccgagagaggaggaagatggattggttgcctggtttgctctaggtatagatcctattgctgctgaagaattcaagcaaagacatgaaaattgttactttcttcatcctcctatgccagcccttctgcaattgaaagaaaaagaagctggggttgtagctcaagcaagatctgttcttgcctggcacagtcgatacaagttttgcccaacctgtggaaatgcaactaaaattgaagaaggtggctataagagactatgtttaaaagaagactgtcctagtctcaatggcgtccataatacctcatacccaagagttgatccagtagtaatcatgcaagttattcatccagatgggaccaaatgccttttaggcaggcagaaaagatttcccccaggcatgtttacttgccttgctggatttattgagcctggagagacaatagaagatgctgttaggagagaagtagaagaggaaagtggagtcaaagttggccatgttcagtatgttgcttgtcaaccatggccaatgccttcctccttaatgattggttgcttagctctagcagtgtctacagaaattaaagttgacaagaatgaaatagaggatgcccgctggttcactagagaacaggtcctggatgttctgaccaaagggaagcagcaggcattctttgtgccaccaagccgagctattgcacatcaattaatcaaacactggattagaataaatcctaatctctaaatctaagaactaagctttgagtattatttaataatttctaataacactcattcctcaagtgatattagagattattcagtactcttgagagtgtcacaacacaaaatacgatgttgggttttcgaaatattttcaaagtgttctgtcttaatcacaaattcatatttttacacatttttacaatattgcctcagattatgttaaatttgggtcagtcttctctgaactttttctctcttggtttcttttcttccttcacagttttatctcacaaaaccatttttctaataagagacatcatgttggaaagatgttgtagaaatgtgcataaatttcagtgcctcttgtaagcattaaactgatgatgaagaaagttcctgatttgagaaatgaatcaaagtaattttaatgaatttttagcttgtattagcttgagttagctggcattgattttttagtccttttgttacctttaagttgtcaatatatggtttttgttcatctccccattgtagtcccacttgctctttcctgggggttccattgttctagcagtggaggtgttacagtgtcgccactcgtctaatttgaccagtgttaagaattttctaatttaataatttaatagtgatctcaataccacaccctcatggaaggagaaaagcatactattatatctgggacctctcttttagacctaaaattaattaacatatctacttatatgttacttatacctaaagctgttattaagacaaaccaagattctctgcttttgcactgaaattaaacttgaaaggaattctcctcaaaggtcggatattaaataagtcccaggcagatttacatatttaatttaaaacattggctttatttcattttgtgatgagtgatgtatctgtgttaacaaaaaattgtataatcattaccaatactatttattatgctcaaatatatcttggctttgaccttatttcaacacattctaagaagccttgacaaagtaagtatattttagagctgaatcagtaagattctagagaaagcaaaacatagtagttcacaattttgcaacatagaaagtcacattttgaaaggctattttgaaattgatttaatagctattatagtttatgaatatcaaaatttgtataatttgcatctttactaatgtatgctagagctacaagagaccttaaggataatatatgaaattagctttccttattttatagataaggaaaaagaaattgtgaaaggtgaatttacctaattagtgaaagttacataactaattacaacagtctgtactatataatgcagaggacgattctccctgtaaaaggaactagaagctattactaaaaatatatatagacaaaattaaaagaaggaatgataagaataaatttaatttaccaaatattgttaattaaaattttagatacttaacatttatttaacttaaataaaagataactgtcagataaaactttattttactaatgagcagtgattttcttaggaattgatgaaggcttattggtatcaagaatttaaaccaaattaaaactgacagaggacatttagatacataataaaattcgagctacataagtatatggaaaataatgtaccttgattattatgaaatagagcatcttgaaattcagttttactctaaatgtacttttaatacttgcagattctaagattacattgtaaaattccaggttttcataatgttaaaataggaaagtagaatataaagtatcaacaagtgtagttatacattttgttttggatatttaatccttacttgggaaaaaatcagcatctaggtaaattattattttaataagaactcttaaattgccaacctctgagaggtgaaaagctatgtaaatagaaggaatggccagttcaaaagaatagtagatgtgatagtgccgtgaatgtattctactggaaatgaatgtaataatacattaaatttttaaaatcta

SEQ ID NO: 115834 - DNA, 601 bp, Homo sapiens
agcggaagactgcatccggctccaggaaaagcgagtgggatatcccaatctttggactgcatcctggttgcctctactgtggtcacctttgggttagtagaagcagtggggagttagtcgtctcattgcctcctctgggggcggtgaccacttccctgggctctttggttcccgcgctgccctgcgtggccctgctgagttgtgtggcggagcctcgtagtggtttggtgggcgcaggcgcgggagccacggacgcatttgcaggggctcccgcgacagggcggaggtgcggcggtactgaggtcgtagagtttcctgcccaagctgagatggggaaaaggaagcgctacttagggtgtgatttcacctcgaaagaaggaatctcacagtagtggcaagaaagtaaaatatcttaaggcattttaccattttcagagaccgtgcacgggtggcacttaattggtcttgagtgcccagggagtggatgaaattcgttaattgatggtcagtgatttcagtgacagagcgatatttaaggtcctgtcctgtcccattcggtctgtgtgagcatgcggaagtcatgggccccgggttacatgtc

SEQ ID NO: 115835 - DNA, 401 bp, Homo sapiens
agatgatacttaaaactgagaaacagaggctgtggtctgcccttggcttcctgaagttaagcagagtctagctggaaaagctgtgttgaaaggaacagtgggaaatgagaccataggaagtgcaaggagtgggaaatgactatctttattatgttaaccagtgcagaaaggaaattccagttcagatgagggatggccaggtttagtctgaacaaacccccaacatagttcaagtatatcagataaaatgaggcctcaaaaattaaatgaagaagctgaattcattcccttttgatataatctgagactctaaattgatgctgccatatagacaagaaatataagtatttagacagcccaatttttgaaggcaggaaaaaaaaccgctgaggaaaaaaaaa

SEQ ID NO: 115836 - DNA, 540 bp, Homo sapiens
tcaatcccaactctgccaggcatcagcctgtagccttgagcagcttctttaaggtctctgagcctccatttcttcatctataaaaaggggttagtaataacacccttagcaattcaactcaaagggctaaaattttcctctaaggaatgacaaattgaaggaaaagcccaacagcccaaagaaaaacggtgtgaaaagatagtgtacccaaaataaaatacaaatggctcttaaatatgtaaacacatcctcagtctcactcataagagaaatgctcattaaaatcacactgaggcagggcatggtggctcgtgcctgtaatcccagcactctgagagtctgaggcagatggatcgcttgcggtcaagagttccagaccagcctggccaacatagtgaaactccatctctactaaaaatacaaaaattaggcagatgtggtgatgcatgcctgtaatcccagctacttgggaggctgaggcaggagaatcacttgaacctagaagtggaggttgcagtgagctgagatcatgccactgta

SEQ ID NO: 115837 - DNA, 607 bp, Homo sapiens
ccccatctgccgccaggaggaagagaggggccccactgcgacgccccagcttctatggccatctctgctggccacacagctccccctttcaaaaatgagatgaagccactgccccagagggcctagagtggtttgttctctgggcatcgctctggacttagggtgtggccagcatggccgctgggtctgggcagagccaacacgcactcttcagctccggcatagcatgtgtagaatgacacggctattagcatttcatcccgggtttacagaaaggacacactgccgtgactgcaggttgaggactgctgcagaaattcgctcatttgatcctcaaagcaatctcctgagggaggccctgcgatcacccccattccacagatgggtaaaccgagacctggagagatgaagccatgtgctccaagctgcacgtctcagtgggtgttggaggggagacgtggtccaggtggccggggggccgtgagcgggatggcaccacggtgctgcttcctctccactggcttcttggtccaaaggccctgagcctgccaagggtgtttcttccctgcaatgcccccgggttgtgcaagctctctgtgccctcctt

SEQ ID NO: 115838 - DNA, 400 bp, Homo sapiens
acctcttttccccagataacttatcctcacagcattgagtctgatactgagaaaagaaagcctctgcaagtttagcttcactgacgtgagcagttcagttactgcactgtagcaaggacttcattagttatcgaccttattgctggtataaaatctgggagctagaccccaaatgagttccacatgtccctcagatccccagcaattttgccattggagcaatacttgagaaaagctctctttagcctcaagtttctggctgatttttttggtcttccatctcttcccccagtcttagggcccaaatctctcttccatttatcatgtcacctgcaaatcaaatctctgttctctgcattcccacaaccatctacctatgacccagccagccttttccaga

SEQ ID NO: 115839 - DNA, 360 bp, Homo sapiens
gttcttttttctttcatataaaagttcagcattgttcaataaatttaagcagttcctttataagacaagttaattttcttatgctggttgcatgggggtggggggcatgctatggggacatcctatcaaaccccaaacctctctaacttttgcctggaaagaatttggagtcagagtttttacgtaacgtttgcaaccctacggcgccacctagtggaataggatttttctccatgggaagccctgtcagccctcttccccaaacttctagtttcctaattctttttccttttatgtccctctatcagtgatcaggcaacatgtcctatttgtaaacaaaaaaactccactttcaacagc

SEQ ID NO: 115840 - DNA, 305 bp, Homo sapiens
acaggagggaagtggccatccttcccaggcacatgactatctactcagagcctgcaaaagaaagtgttcgtgtcgaaaggggcaggttgtaaatccctgtacagaaggccctggaaccagtgaggggcccgggcatggcaggcacactggtgagtacccagtggggtgggtgaatggtcagccaggtgggccttggagcctttggagactggttctttcttaaggactttcccaaccctgtgaacctttgcatttcacaagttattgccacgtcaactttacacaaattaaaaccgcttgttctc

SEQ ID NO: 115841 - DNA, 735 bp, Homo sapiens
atgacaataatacacaagaggatagagaagggataaacagaccttaagttgtttaacgaccttatgtattatattaaactctaataagtcaaagatacatatttaatctgtagggcagtgattttcaaattttagagttgtttagaattatatgaagggcttcttcaaagtgtgctatataccaccctcaaagtttctcatttaactttttgagtggtggggtggggtcaaaagtttgcattcctgctaaaagttgcagatgcaattttttttaagaagacactttgaaaactacttctgtaaggtaaactattgaagtagtggtaaaataatatgtagtgtatagctagtagaacagaaaatacactaaaaagaataatagtaataataataataataggcctgactactccaaagtgagcaagaaaggagagaaagaacataatatgaatgagtcaaggacaaatcaaattgtgacaaggtaaatttaaatccctaggaactacattttatttagaaagactattctaattaaaatgcaaaaattataatattgaataaattatgaaatgaaatttacagagataaggtaaaaaatgttgaaaatagatataaaaaagttttacacaaatattaaccaaagaaaactgtgtgaatatgtttatatcagatgcagtagtcattaaggcatgatgcatttattaaagataaaaagattgttttcatattgataaa

SEQ ID NO: 115842 - DNA, 536 bp, Homo sapiens
ggtgtctcagatgtttttgccacgatcggtctacagcattgactctaggttagactgagtgttaccatggccacgcaggacgcacggttcctccacccgtgatcagacacggaatcggctgcgatgggtgatcgccaatgagccccttttctagagcctttcctggccatctacaggcagggtccggctgggaaaaagacgactggaatttctcgaatgtcgatggtttgcacacttgaggattctacgtggttctcttggttcctttggtgtgtgtgtggaggatgccaaggcccttagctgaccttcagctcgtcgtacaggaccagcacgaagcccgcccccacccccatgcctttgagggcgttggaccacacacccttgaaaaaggcctcgccccgctcatctctgaagatcttcctccaacagtcgacggtgcccgtgtacatgatgtcagctcctttgcgccgggactgcatcatcgtccgccgccgcactgtgtcgaagggttaggagagcacgccagccacggccgt

SEQ ID NO: 115843 - DNA, 639 bp, Homo sapiens
gagcttagaaagcttatttcattagtaaatggtttgaaccgtcaaggtccagctgtggtttccactgatggaggaacaggaagaagaggagccttgacatttatctcaagcgccagcagcttctcttggatcaggaagacataaaagtccaatgtcatcttcaatttgtgcaggctccccttggagttgcagagccagtgaagtgaagtagaacagttaaaaaaacacccggggaagtgataaatcacagagagagattgcatatgcgggaaaggtgtctcccacaattaaaacaagtggccagagcctccctggcgacctctggtctgcattgccagccctgaagatggctcctaaattacttaagtttaataggtagttaatatagccaaccctccttatgaccccagtgggctgaatggctctgcttgctttaggaactgggcgttgtatggtagagcatcttggccttgacataaaaggtagcatactggctccccagccctgaaccttccctgctagagcaaggcaggggtgagagggggaaggaaagaaaaaggagtggggagtggggtggggagcaaggattaacagggagcagtagcagcaccagatgtgggcatagcacactgggaagaa

SEQ ID NO: 115844 - DNA, 591 bp, Homo sapiens
ataaagatgtgtgttatgaaaaaacttgagacttttaggaatttggacactctggttttacatctagatatttgacttggaagagtgcagtctttaatggtctatttaaagtaattagctaacatttgtgggtaggaggtgacaaaattggatgtactaatcctagaattatttggtagcatttttatgcctggcataacagttttatgaaaactttatatgtgaaaagccagtgtgtctgcttcagggtgagatgaattatgttgcagtagttgtaattataccatgagacatgtgaaagaagcaaagcaaaatagagaaacagctggagaacacaattctgcttttccaaggaaaatgaactgagcaatctgttgagcagcctctgacccttggacccaccgtgggcctaagtgcagcctcatgcaaatcagaaggatcagggaaatgacatcttcagggtaccctccttagagaatccctccgtggaagtgcaggagccagccaagaccctcagcatgctggggtcttgtgtggaatccttcttagggctctgactagaatgttctggtgaggccctctgggaaatag

SEQ ID NO: 115845 - DNA, 1068 bp, Homo sapiens
taagggaatgcaaggacatgaaagagtgtcctaggcagagggaacaacatatacaaaggccctgaggtgggagtgaacaaggaactgagagaagaactgagagaaggccactgtggaaagccagatgctgtgtgacatgaataatgggacacaggaaattgagatattagcaaaagagagattgatgacccataggcttgaagatgtactggaactaaagtaaggggcgaggataaataaaaagagggagaaattggagaaacagagtgcttggaagccctgatgaatttgaggaaaaggatggtgatagagttgacctagccagctagaagagtagtactttttagtcagtgagccctccatcccatttctcattaattcttgtaacactttctcacttcctatattctgtcatattttatagttgtttatataattatcttattctttataccaattgtagtttccctgggtgcttattatggattaacaattatattattattaataatatgggtgaatgtttacaaagaaagaagtcttttttgctattcttattttatttctttaatctttgatcaggggtttttatttatgaattcatcttatatgtcacttgacaaacactgaatgctgaatgccacagagtacatgacactttagcagcataaagaaaggcaccaaaaccaagcagcaaactacatgctacaaaacaacaatttttggaattaatgaatgaggctaattttctggagtcctctctctcttttaaaatgtaagaagtgttagtatggccaggcatggtggctcatgcctgtaatcccggccctttgggaggccgaagtgggcagatcacctgagatcaagagtttgagaccagcctggccaacctggggaaaccctgtgtccactaaaaatacaaaaattagccaggcatggtggcacgtgcctgtaatcccagcaaattgggaggctgaggcaggaaaatcacttgagcctgggaggcagaggttgcagtgagctgagatagcaccactgcactccagcctgggcaacagagtgagactc

SEQ ID NO: 115846 - DNA, 237 bp, Homo sapiens
ctgtggcaaaaagacaagcgcagagtgggaatgactcagcttgggccctgatcatactacatccaggtgtgataatgaattaagttaatctgtgagtattttcttaaccatagactggaaaactcttattcccaagaagttattttgacttttaagcagggaatcctgtaaaaggtagactattataaactctcctcaagcaaaatatttgctttatgtaaatagccttctcaaggt

SEQ ID NO: 115847 - DNA, 581 bp, Homo sapiens
gccaccatgctcctgttagaactttcactggcttaacccaattagatgccagagggcccaggagccccacacaggccagccctctagggcagggagcagggtggacatactggttttctgttgctgcaaatcagcagcttacaacacacatttgttctctcacatctcctttgcaccaggagtccaggaatagctcatctgagtgctatgcttaggtcctcctaaggctgtggtcagagtgtcaggcgggctgcatcctcatctggggctccagtggggaaggatctgcttcccagctccctcaggtttagtgttggcagaattcctttccttggagctgtcagggatctgtcttgcacagtggggaatggacagggcaaacaagaagatactcagagaaggtgacacctgagccttcctgaagatgagcagagggcaaagaagagaacacctgcgcagagtttcggaggcaagggagtcatcagtgtgtccacagatctgccagtccattcatttggcctagagtataaggcagaggaggtataggacctgtttcacggtggcctagtgagacttactga

SEQ ID NO: 115848 - DNA, 759 bp, Homo sapiens
gcacctcattgctgcatcatctagtggagatgaacactgtgttctcatatggcagaaaggatggagggcaaaaaggactgaactctgtgtgaagccccttttataaaggccttaatcttattcatgtgggagcagcccttataacttaatacctcctaaaaggccccacttcttaataccatcacaatggggattaagtttcaacatgaattttggtggggacacacattcagatcatagcatttcacccctggctcccccagatttatatcctgcacacatacaaaatatatgagataaatgcacgtgatacacatttattccatcccaaaagcccccaaaagacttaccttgttccagcatcaactttaaaatctaaagtttcatcttaacactatctaagtcagatacggagatgagactcaaagtacaattcatccagagacaaattcctcttcagctgtgagcctatgaaattatacagttatatgcttccaaaagacaatagtgggacaaacaggatagatattcccactccaaaatggagcaacaggaaagaacaaagggctaacaggttctaaccaaatccaaacacctcagataaacaacaaaaaactcagtagggcaaacattaaaccctgaagcttgggtgtagtcttttactcccatttctcattttctggacacactggggtggaagttggacccccaaggctccaggcaaccctacttcatcacattgctggctgcatttcttgt

SEQ ID NO: 115849 - DNA, 240 bp, Homo sapiens
gctggacgtggtggcgggtgcctgtaatcccagctactggggaggctgaggcaggagaatcacttgaatccgggaggcaagggttgcagtgagctgagatcccaccattgcactccagcctgggtgacaagagtgaaactccacctcaaaataaataaataaataaataaataaataaagtaaaagagggaatgctgagagctgggcgtggcctgtggctctgtagctacgcaggaggct

SEQ ID NO: 115850 - DNA, 425 bp, Homo sapiens
gagtggattcacagcctcatcccgaccccgcgtgtcaccgcgagtgggttcacagcctcatcccgaccccgcgtgtcaccgcgagtgggttcacacgctcatcccgaccccgcgtgtcaccgcgagtggattcacacgctcatcccgaccccgcgtgtcaccgcgagtgggttcacagcctcatcccgaccccgcgtgtcaccgcgagtggattcacacgctcatcccgaccccgcgtgtcaccgcgagtggattcacacgctcatcccgaccccgcgtgtcaccgcgagtgggttcacagcctcatcccgaccccgcgtgtcaccgcgagtggattcacacgctcatcccgaccccacatgttcacgtgtttaatgaacactgtgctagaaggtcagcagtaaacatgccacagcaccccatct

SEQ ID NO: 115851 - DNA, 440 bp, Homo sapiens
gtgctggaagttgctggtgtggcaatgagaactgggccccggtcaaggcagcactactttggtagatccagaatcaaccatgataaccgtgacagtgtcttcaacagtgcagcagtagacacaggcccctggtgctggaatccaatacagggacaggagcagcacggagtcacggaacaccgtcttgccttcatgtcactttaccatttcttctttctccctcttactctaccagctacctgtggagatgttgaaccttttatctgtcgctgtctgcttaggaacagaagaaaaggcagctcattgcttgactcagctttcagcttgatttttttcctttggcagagtgaattggggtcccaggtgttcattttccttttgtagtacctttcctcagcatgcaattaatacaaaaagaacaataaaccttaacaaagttt

SEQ ID NO: 115852 - DNA, 615 bp, Homo sapiens
cacctttagtatagtggtgagtaaaaataaaataaaaacaaggccaaattgcgtttttctaaattgcaagttccctgttttccatatcccagtaacaaacctactgttgtgcaaataggaaataacatctagtagctactttagcaatggacgtggcaaaataaataaattagtagctatggctcattatttaggatttaaatgagccataactactataaatgaaattgaagatcatgttcttaatttgaaattaaggatcatgatctcattggtactgatgagtcagcagctatcaatatataaggataacccttatattttaggaattattttaggagaaagaactattttaggaattattttacacagaattctaatcatgctgccttggaggttaggcaactaccattcctcactttgtagctttattgattctcttctgaagcttgcagtagcctcctaacttgccttgctgccagtccttccttgtcccagtctatccttcacattgccaccagtgttatttttctgaaatacgaaagcgaatatgaggcttctctgctccttggtgataatagtataaagtccaaactcttaagtattacataaaaa

SEQ ID NO: 115853 - DNA, 325 bp, Homo sapiens
atggaaagacatagaaagattagaaatatgtcttagacagaatcagctggacttagtgacagattggttgtaggggaggaggagaggaagaagtcaaacacaacaccatggtgtctggttggacagggccattttctgagatggggagggcatagatatgtttaaaagctctgttttgattactccacatcaggatttaaataaagtccaaagaatggtcatggtaatgacaataactgagcaaagtaatttaattttttaaggtgttacagttctctagagaagcagaatcagtaggatactggggatagtggggaggggagag

SEQ ID NO: 115854 - DNA, 364 bp, Homo sapiens
ttgcatttattgagcaagtatttattgagggcctcttgtgtgctagggactgtcctggatgctggagatatcagtgaccaagacaggtcttctatagggaagaccagtaaacaaacaaatgaatagacaaagcaaaaataggtcataatgaattctgtggaagaaagaaacagggtgctgtgatagagaacaatgggggcaaggcagctgctttagatggggtggtcattcggagaatcagaagaggctggctgtgagaagagcctgggaagaagtgttccaggaaggaaaacagaaaactaaaggcacagtgttgagggaagaccttggtatatcctaagaattaatggaaggtctttgtggc

SEQ ID NO: 115855 - DNA, 612 bp, Homo sapiens
tgggggtgcttcctgcctgaagcaccaggtgtcatattggctaggatgcccaggcagaaaatgggggctaacaataccgtgtttcacctgaagtgtttcctctctgcaccctgcttggccttccttccctccctcccgcttcaggctgggcctgaaatctgcagaaggaatggccctggccctcagaggaagggacccagcactatagaatgctgtggttaagagcacagctcaagtgctcttaacaagccgtgtgttcctgtgaagttacttcacctctctgtgcttctgtttcctatcagtaaaatggggatgctaataatagctccttccctaaaggcttactgggaaggagattaaagaaatgaggtagtgagtgtgcagcattcagcataccacgcctggtgtggagcaggcgcctagcaactggcatccttctgtccctcctcagacccagggagttgaggtgacttgcccaaggagcgccaaggtatccatctgggtggattgggaccaagacttgggcttccccctccctgtttctcttgctgcatctccacctccattcaggaagaaagaagatacttggactccaggaaatgatcaccgtgg

SEQ ID NO: 115856 - DNA, 741 bp, Homo sapiens
tataaatggaaatataaacagatgctcctcgacttttgatggggttacatcctgataaacctgtcataagttaaaaatattgtgagttgaaaattcatgtaatacacctaacttactgaatatcctagcttggcctagccaaccttaaatgtgcccagaacacttacatcagcatatttgggctgatgtaacacaaaccctattttatcataaactgtttaatatctcatgtaatttattgaatactgtattgaaaatgaaagataaaatggttgtatgggtactcaaagtacagtttctattgtctgtgtatctcttttgcaccatcgtacagttgaaaaatcctgtgtcaaacaatcataagtcagggaccatctgtactgttgaaatagcatttcaagctggattcctttttagaaaaaaaatgatctaaaagggatatgccataaaaatctacaaatgaagtgtaagaggtgatgtacacatgagcaatttcactatattcaagaatactaaaaattggttgtgattcccttgacgtttaaggaagtggttttgaattttaaaatagcaatgctttatgcagtaataaatatatacaatttattaccactgggaagagatccagccagaaaaattttgaaagacacatttagaaagttttagatatattcatgtacaatcatgcaaatcaaataaaaatgatatagcacctactgtattttaggcactcatgatcca

SEQ ID NO: 115857 - DNA, 271 bp, Homo sapiens
ttattgggtaacacctgtgaaagataaagggtcagggaaccaggtttggaagggaaggtcttcacacagcagcgcaggcctgagtaacacctgtgaaagcagaggggcggaggaggagcagctgccagtgagcagcgaggaacaccaggagaatgtggagtcgtggaagccaaaggaagacagcaactcaagcagaagggtgacatcgagtgtggatcaagtaaagtgagtgctgaggattgaccactgggtataaccacgtggaggtcac

SEQ ID NO: 115858 - DNA, 220 bp, Homo sapiens
tggtggtgccccgcgccagcccaggcagctgcagtagcaggaattagctcagtaagctaaggcttctccagtggtggggctgtttatagaggcaccgtcaccatgagcagcaccttctccactctgtggaccgactttcttctcataaggcctggagcaggctccctggcagggaaatgcaattttagaaagtagggcaggggcctaattacagtcggct

SEQ ID NO: 115859 - DNA, 586 bp, Homo sapiens
tcagtcgctctagggggattatccagtacaggcttgcttcttggtagccactgtacatagagttttgtttataattagacggtgtagtgttaattatgctggtggccctgccagtatcctacagaggctacaggaggagatcaaaacaatcattccagaattatgagtcacttcactctctccccactacacaccacgggcagcccctcaaccctggaaaaaggaaattatgcacactatttgcctatacagtctttcacatttaggatgaaatattgagttccaagagctgctctacatttacttttctagaataacggatacatttcagtccgggtaactttgggctgttcaagaattagaagtagaggagagaaggtttaggaaactctcaaggcccggtttatgctgtagaagaaaagaatttctgcataagtaaagtgcaattataagttttgctccagatatgaataattcctccaagggagaggttcataacctcattcatctttgtattcctggtgcctagcagggaagaaacctggcataaggtgttgaatgaaagtagaataatctaatatattaa

SEQ ID NO: 115860 - DNA, 677 bp, Homo sapiens
ttgatctcttggcctttcagcaactgtcatttgggactgctgttgctggtaattaaagactcttaggtcagctggaaagccgtctccaggtacataactgtgggtctaggcttcttctaactgctttccatgaaaaatcatacgctgaactcacaaatgacccctctgctattaaaaggagaagaagctgcctcatagaattatgagccattccaagttctggattctgatgcagactactggctatttaagaatgaaatacttggttttttgcacttaatgatgaatggagcagaatgaaatcatacaatatgctgatttttaaaattaattataacaaagtgaattttagacttcagatacacagattaatagtataccttttgaaaacaatttatagtatgctgtaaaatttttcttatctatttataagggttttccagatatataatttccatttttaaatttctgaatttatacacacacacataatcatatgtatttctactgcggcaacaattctttaaccattttgtttcagaagcaaagtttagggacactttctaaatgttcttttgactttgtggcctctaatactttcttaaaattctgaatctaagtttaattcaaacttagattgtaaattcaggtaatagataagttgtcagctttaaatg

SEQ ID NO: 115861 - DNA, 536 bp, Homo sapiens
caaatcttgtagactggattacagaggacatcgggcaatcttaatcagcagtctggagattcatgacccctctccacagcctgactccagggtacacgggtaagataatagtgacaacagccatgaaacgaagggggctggttttccatgaccccacacattctgcctaaggccacgcacctcccaaaggccacgatggatgagcaggcgggcctgggcactcaggtttttctggtaagtgacgaatctaagtcaatattgcaaagtagacgtggctcccctggctctgcaaatattggaccaaagacttgagtgaggcgatgctattgacgattacgagatggtagcattgttgtctttgttgccatgaagtgcagctcggtggagcctggcctaacatcctgtgtacacagaggggacagtgtgctcggaggcccgtgtgtttgctctgccaatatgcgccagtggccagccctcgaacactcccccatcccatggttacagctgggggtgttggaaacataccgccctctcct

SEQ ID NO: 115862 - DNA, 2212 bp, Homo sapiens
tcctgcttcgccctcccagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggcggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccggctctgggccagtacccctatgacaggtatggaaccatggacagcggcacgcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcttggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttaacgtcaaaagtttaacatggagaaggcggttccgttctgaagcgtggtctgctgtcccctgggcgtgaggcctcctgggcctgtcgggcctccgatttcatcctcagacgtaatgctcaccaacagcacttgcactgagttgactcttgcacactcgactccataatatgatgctttttaagatgtatgttcacaccaataattgcctgcttcagaggctaatataacaaaaccaataaaaccgag

SEQ ID NO: 115863 - DNA, 477 bp, Homo sapiens
aggccagattcgccggcacagcagttaaagtcgcccttccagccggtacgcgacaactctctggccccgcaggagggaacgccgcggatcctagcagccctcccgtccgcctgattaagggtcttcttttacttttgcgggggggaggggggaggagttggggagggagggaatgtgggaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctgcgattatcgggttcggtaaatgcccccacgtgcttgtgtctctttccccccttttctgtatatagagtggtttcagattgtaaatagcgcgtcagcgaacttgtctaaatcatatatttttgtctaataaactaaatgaaatgaca

SEQ ID NO: 115864 - DNA, 845 bp, Homo sapiens
gccgccgcctcgtcgggccgaccgggggccgcggagctgggcggcggggcaggcgcggctgcagtcacctcggtgctgggcatgtacgcggcggcggggccgtacgcgggcgcgcccaactacagcgccttcctgccctacgccgcggatctcagcctcttctcgcagatgggctcgcagtatgaactgaaggacaaccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctgcgattatcgggttcggtaaatgcccccacgtgcttgtgtctctttccccccttttctgtatatagagtggtttcagattgtaaatagcgcgtcagcgaacttgtctaaatcatatatttttgtctaataaactaaatgaaatgaca

SEQ ID NO: 115865 - DNA, 383 bp, Homo sapiens
gccgccgcctcgtcgggccgaccgggggccgcggagctgggcggcggggcaggcgcggctgcagggtgcgccgcacggcaagcccaagatctggtcgctggcggagacagccacgagccccgacggtgcgcccaaggcttcgccaccaccacccgcgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagc

SEQ ID NO: 115866 - DNA, 1135 bp, Homo sapiens
gccgccgcctcgtcgggccgaccgggggccgcggagctgggcggcggggcaggcgcggctgcagtcacctcggtgctgggcatgtacgcggcggcggggccgtacgcgggcgcgcccaactacagcgccttcctgccctacgccgcggatctcagcctcttctcgcagatgggctcgcagtatgaactgaaggacaaccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggacgacgaggagatcgacctggaaagcatcgacattgacaagatcgacgagcacgatggcgaccagagcaacgaggatgacgaggacaaggccgaggctccgcacgcgcccgcagccccttctgctcttgcccgggaccaaggctcgccgctggcagcagccgacgttctcaagccccaggactcgcccttgggcctggcaaaggaggccccagagccgggcagcacgcgcctgctgagccccggcgctgcagcgggcggcctgcagggtgcgccgcacggcaagcccaagatctggtcgctggcggagacagccacgagccccgacggtgcgcccaaggcttcgccaccaccacccgcgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagc

SEQ ID NO: 115867 - DNA, 303 bp, Homo sapiens
agtgatctactcatggggaaaatcttgatgatgcaagaaagaaagggatttgttggaatcttgtcctataacgggtgagaggggatgggttctagaagaaaaggcatgggtctttgtttgagatcaggcaattcatctgtaggaaccagtaggaagatggttaagtgggtacctgtggtagtggatgtttgtgaacattcttttcttttccattgtttctattttctcaataaagtgggaagcaaaaatcagctgagtgaagatgaggaagaaggtgttaaaggtttgaagaaaaaaggaaaa

SEQ ID NO: 115868 - DNA, 238 bp, Homo sapiens
agtgctgggattacaggcttgagccaccgtgcccaaccaagacttagtttttaaaatgaacatttggattttataaagtatcagttcctaatgtcatttttcacatgaaaatcataagatacagagaaatgtagagtagaacattgaaaaagacccatactcttacccccatgtaactgtgatgttgaaaacaagtagtgatgacacatgcatgattagaacatctggtcagcttgag

SEQ ID NO: 115869 - DNA, 257 bp, Homo sapiens
caggctggaccgctgaaggcccagttccttgcctgttgcacagggaagcccctgacacacagggaaccccactgttgtcacgctgtgttgggcctgaggccaagggcaaccatcctcctaccgtgtccccagctccagctcctcgccctgtggcactgcatggaatgcgctctgctagacaagcagggtgccctcgaccagacccaatctgctatgggcagatgcctcctgtttgtaaggcaaggggcctagcaaag

SEQ ID NO: 115870 - DNA, 361 bp, Homo sapiens
atcaaaaccgcaatgtgacatcacttcacccgttaggatgtttattattaaaagatctaaatataatgagtgttggtgaggacgtgaagaaaagggaaaaactgcatgctgttggtgggacggcaaattgttatagtcattatggaaagtagtatggaggttccacaaaaaaataaaaatcaaaatagaactgccatatgatctagcaattccacttctgggtgtacgttaaaaaataaaatgaaatcattatctcaaagacataactgcactcccatgctcactgcactattattcacaataatcaagatacagatgcaacttaagaatccattgatagatgaagaaattgtagtaacta

SEQ ID NO: 115871 - DNA, 218 bp, Homo sapiens
gatccacccacctcggcctcccaaagtgctgggattacaggcgtgagccactgcacccggccatttcttggtttctttaattgattttccctctcccttagtgagagacatgcagaatacatcaaaatataggctggacttttttttttttttttttttttttttttttttttttttttttttttttttttttttttttttttttttttttttttttt

SEQ ID NO: 115872 - DNA, 344 bp, Homo sapiens
attgtgaagggtaatttcttaaattcattttcaaatgagctttttaaaaagaaaactagtgtcattccttgagtttcattttaatgtatctattcacatactgcttttaacttcttttcatactgctaattttttttcaatttgatcttttcaagattgagactacatattccaatttatagtaaatcagaaatgagattttcaatttcataatgaactttaataaaatagatttgttttctgtcagtgaaaatatttaggctaaatttccagaaaaatttcaccttcatttaataactgcattgttgaccaaaacttctgattaccttatttcgcaaatgtaa

SEQ ID NO: 115873 - DNA, 530 bp, Homo sapiens
actcttgttgcccaggctggagtgcaatggcacaatcttggctcactgcaaccaccacctcccgggttcatgcgattctcctgcctcagccttctgagtagctgggattacaggcatgtgccaccacatgcagctaattttgtacttttagtagagacggggtttctctatgttggtcaggctggtcttgaggtcgggagctcaggtgatctacctgcctcagcctcccaaagtgctgggattacaggcgtgagcactgcgcccggctttaacagatatttttataagcaaatcatttataagtatgggtgactattctttacaaatccatttgtgatgcagtggtaatttggtggcactgcaattatggccagcaatgaagattataaaataattgcctgaggaaccaagctcatgtgcactaaaaagaagcagggattcttagaagattcttagaagtatagagtagtgatttttttggggatggagtcttgctctgtcgcccaggttagagtgcagtggtgcgatat

SEQ ID NO: 115874 - DNA, 193 bp, Homo sapiens
agaagtgagctgccactgtcatgggtggaggtcagtcccagcaactgccccatctgtttcacccttgcttgatcgtagctagaaaatggtcagagatttagcccgcaagtgagtacacatgggacgtggccctgtttcgctgctcacttgctttgtgagccttggtgctgtgtgtgtgtagtgtgtgtgggtg

SEQ ID NO: 115875 - DNA, 620 bp, Homo sapiens
gaaacttcaaagaacatgattgttataaatattacacatttctatctactttcttaaaatcctaaaagagaaattgctgggtcacagagtataaagaatttaaggttattcgtgaatcggcaaattgtcctctgacgattgcattaccttaccttcccactggcaaaaagaccgctgccagtttcccccactctcatccccattaaactttgtttgtttaaatcatagggcacttattataattcttactcaagaaaacatacccacttttggccgagtgcagtggctcacgcctgtaatcccagcactttgggaggctgaggtgggcagatcatgaggtcaggagatcgagaccatcctggctaacacagtgaaaccccatctctactaaaaatacaaaaaattagccgggcgtggtggtgagcacctgtagtcccagctactcaggaagctgaggcaggagaatggcttgaacccgggaggcagagcttgcagtgaaccgagatcttgccactgcactccagcctgggcaacagagcaagactcagtctcaaaaaaaaaagaaaaaagaaaacatacccacttttgcctactgcaatagccagaacattgagcagcac

SEQ ID NO: 115876 - DNA, 3497 bp, Homo sapiens
acgtcagtccccgcgcttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgtacagtgcttggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtattacagtcttctttattttttagcatagaaagttggggatgtgttaattgtatttttaagaatatattctaaattctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaagcaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagcaaaaaaat

SEQ ID NO: 115877 - DNA, 3942 bp, Homo sapiens
acgtcagtccccgcgcttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgtacagtgcttggtactgagtaggcactccgtcagtattttagtagctattattccaaaggacactgtattctaggtactaagacaatgtgaatggaatggaaaacaattcctccctgcagaagccaactgtctaggaagacagataatgacattattaaaataatcagaacattggcaaaataaagaagattgaaatgcagttcatatgacagtgctaattaatcatactttttagatctaggaaaggccataaaggttaaattgacttggaaatggtaaacaagacaatggttgtgtcactgatcggtgatggccagtttttggttatccttatttgccatttaaatgattgaattgaaaggaagaagtaagacttggaagatgaatattgaaggaaaggtgaagatggaaaagagaagggggtttattctgagaacagtgactagaactctgaggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtattacagtcttctttattttttagcatagaaagttggggatgtgttaattgtatttttaagaatatattctaaattctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaagcaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagcaaaaaaat

SEQ ID NO: 115878 - DNA, 3744 bp, Homo sapiens
acgtcagtccccgcgcttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgtacagtgcttggatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtattacagtcttctttattttttagcatagaaagttggggatgtgttaattgtatttttaagaatatattctaaattctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaagcaagttttcagatttttataacagacccattttgttttatgaaacatgttcattacagaaacatgagaaaatagagataagtaaaaagaataaaagtcactattatcctaaaaaaaaaaaaaaaaaaaaaaaaaaaaaaaaaaaaaaaaaaaaaacaaaactaaacaggaaccaaaacaaaaacgacagccacagtcagcaaccaactgaccaaacaagattacaaccaccagaaaacaaagagagggggcgccgccctaaacacaatccactccggcgggcgcccacaatgccacaccacacccaacccattttataaaggaggcgccccccaaatgagagcctataacaaacaacggccgccacgggcgtcaaaaccacgttgatgggaaaacaacagcactgtcagtatcgtacgagaaacaccccactcggggcgggacacactggccgacacccacccccaagacaatgccgcgcccgagacaaacaccatcgggtcagcgtggacaccccgccttcctgccgcagacatggtctcgtgtattctcaaaatcacggcccgcaatcatagtcaaagcgacagacgagctcgcccagacacagaccagaccggcgtacaagctgactgaacacaccagacagccacggcggaccaccaactacgacgacagcgacgacccgaaccagcccccaacctctactcgttg

SEQ ID NO: 115879 - DNA, 4030 bp, Homo sapiens
acgtcagtccccgcgcttttcggaggctgccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgtacagtgcttggtactgagtaggcactccgtcagtattttagtagctattattccaaaggacactgtattctaggtactaagacaatgtgaatggaatggaaaacaattcctccctgcagaagccaactgtctaggaagacagataatgacattattaaaataatcagaacattggcaaaataaagaagattgaaatgcagttcatatgacagtgctaattaatcatactttttagatctaggaaaggccataaaggttaaattgacttggaaatggtaaacaagacaatggttgtgtcactgatcggtgatggccagtttttggttatccttatttgccatttaaatgattgaattgaaaggaagaagtaagacttggaagatgaatattgaaggaaaggtgaagatggaaaagagaagggggtttattctgagaacagtgactagaactctgaggatagcagcatcaaggagcattgtgtacatgcagaagtgcacagtacctggagtgaaactgcttgtgttcgatttctgataccattcataactggctgtgtgatctcaaataagaaaactgaagaaccagctgggcgcggtagctcacgcctgtaatcccagcactttgggaggctgaggcgggtggattacctgagaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtattacagtcttctttattttttagcatagaaagttggggatgtgttaattgtatttttaagaatatattctaaattctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaagcaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaagcaaaaaaat

SEQ ID NO: 115880 - DNA, 170 bp, Homo sapiens
ggcctcaataatttggtagttttctacagttgcacagatttggccaacagagggcggcagagtccagtaccttgagagcacaaatgctgtgtaacctgtgtgacttccgtgcttagctggtgtgggtggtggagaccttagtgaactggagaggagatctcagatcttga

SEQ ID NO: 115881 - DNA, 302 bp, Homo sapiens
ttcttcacaagtgtttgaatttgcattctttgattgccaatcatgcttctatatatttgactattgtttgaatttctccttgtgcaaattgtccttgtgggccatgaatgaaaatagtttcaaggagagtcataatgaaaagctgatctctcaagaatcacccaaggtgtacatacacaaacatacacacataagctcattttccccctacattacaaaatctaccagggcaaggtctagctaccatactaatgccattagagaagaggctgattatgagggttcacctttcaaatggatat

SEQ ID NO: 115882 - DNA, 816 bp, Homo sapiens
ggcctcccaaagtgctaggattacaggcgtgagccaccgcacccagcctggaatcagttttaacagtgtataatctcattggcactccttggactgaagccacttagcattaaaatgtaccttgatctcctggtgacctccagtgacccacattgatgactctgatgggttatcattagttctccccaggaaatttgaatcatcaggatgtttctttggttacataatatatttaacccaggtactggctattatgaaatcaagaagcatatcttcccagaagtgtccttgtgtgtgttcatttgtggaagttggaggaatcaaatctctccctctctttagaggtgtgttttggaatgccctaagcaggctgctgtgacatcagcccttgaatttactctggttctcatcaggaacattaggaataattcctcatcttccatggaagaaggtggaacatgaagcaagcctgaaaacaaaagctttacattggctatgtgtgaaccacctttgctgttttataagttttgctagggggcctgggatagtagtgacacctgaccccttactgaacattttcatcgatgctctttggctctgtggttttatactgcccctttcagttgatgaaaaagacctagcttagctttaggtttctcaaatagaggaccacatctatattaaggaaccaatgtaactacataaagaactgtaagttcatgttcctcagaatcttatgtgtgtaaatactttatgatttttaattccttcttatattatcctcattattgttaacaggatttaatgtggcatgct

SEQ ID NO: 115883 - DNA, 337 bp, Homo sapiens
ttataatacaaattacaggagggtaattatctatttgggctgactgttcctcagctttctcatgtgaggccgatggcctcctggtgaaaatgagtgaggttcctggcagtattctggaaccagtcaacacaaagggtctgaggagtgggttgaagcccatggtctcagccaagatggatctcagagcttgtggatgtggggagagaaagctgccctccagccgcagcttctccaatagtcttctgtcatcacccagcactgctgcgaggatccacaaatcccatcacttatgtgagataacaacatggcagaagacagaaaatgaatctaagacatc

SEQ ID NO: 115884 - DNA, 255 bp, Homo sapiens
tcactccatctccttttccagggatatttgcatctttagtagtagtcttcattggtggtccttcagtggagtgtcacaaagagaagggaaaacactcaggtactatgaggggaaaggttggggactgttgagagatcacaaggacacctctcactcctacccccaaagctaccttaacctattcctgtcaagacagaaggttggccgggtgcagtggctcacacctgtaatcccggcactttgggaggccaaggc

SEQ ID NO: 115885 - DNA, 433 bp, Homo sapiens
cccagctaatttttgtacttttagtagagatggggtttcaccatgttggtcaggctggtctcaaactcctgacctcaggtgatctgtccacctcagcctccgaaagtgctgggattacaggtgtgagccaccacgcccggctgaaaacgtttttgaagctgctgtaagtctttgggctaattgttcttagatttgttatagttattatacagcatttatgtacttgtactgtggtgatcactgctaaaagatgatccagagagagaattatacattgtgcatattttgagatttgcacttacatttttatgattaaacatttgcccttttagccaagcgtggtggcacaatagtcctagctgctctggaaggctgaagcaggaggattgtttgagcccaggagttcaagaccagtctgggcaacatagcaaga

SEQ ID NO: 115886 - DNA, 138 bp, Homo sapiens
tcctgagtcatcgtggggtagcagtgagtgtggacccctcacgcgctctggctcagggcctgctctccagcctccctattctctcaaccctgtctttcagactcagctcattcctggtcttctccttgcccttgtctt

SEQ ID NO: 115887 - DNA, 431 bp, Homo sapiens
actttgtatcctagcccagagctgcatctaccaagataaaaagttgcatctttctaattaccacaaaggcaccatgtgggctaaccacagccttgagatgaacttgattgtgaacttattgcatataaattgtgtgtggtataaccaaaatagaaatgtctattaaagtgttagatgaacaggtcttgagccctagcgaaagatctgggctagagatacagatgttgaagtcatctccttgttgaaaccatgagtagatgacatcttctgggaaaatcatgaaaagagaatagggttggtgttcaagtgataaaacacagtgcagttcacatcttcacttgttattttatggacatttgctggaaacaaagcaccttagtcaacacaactgtttgaattatctcattggactgataggatgattcatgatt

SEQ ID NO: 115888 - DNA, 320 bp, Homo sapiens
ctaaaatacattaaaaagcaaaggaactagaatatcctaagcaatttgaaaacaatgtagttggaggaatcacactaccagatattaagacacataagtacagtaatcgggactgtgatattggtactgattgtgtggttttggtagtgatagacacatagctcagtgatagacgcagaatagagtacagaaatagacctacacaagtatgaaaaactaacgtctgacaaaggtacataagcaattcaatagatgaattgtgttagaaaaattgaatttcgaacaaagggtgttggaacaattgaatagtcatagctaag

SEQ ID NO: 115889 - DNA, 405 bp, Homo sapiens
gaagaccagtgctgctcaccgtgaggccgccacgtcactaaaaaacccgtgccggcgtggccaggtctgcacgcaccggacacctgcaggaggcgctgcgcatggcggataatttccccagtgcaccctggagtggaacgtggcgtgagagcggcgttggggctgcccaaagcaggtgaagcctcacacaagcgtggggggctccgcggggacctggaaggaacccaccagatgacgtcagcgggacccaacagtccaaccacctacaacacagggctgggctctgccaaggaaagcaggcggcaagagctggtctgctgctgagagtgggcccgggcccagggagagccagcggtgccctccctccgtggcgtctgcacctgagtcccagttcccgcagggccc

SEQ ID NO: 115890 - DNA, 1287 bp, Homo sapiens
atgtctggagacactttcgattgtcacaacttgtggttgtgtggggatgttttggtgtgattactggcatctggtgaatagaagtcaaggatgctgctaaccatcatacagtgcacaggtcagtcccccacaagtaagaattgcctaatcctaaatgtcaattgcatcatggttacaaaatcctggattaaacacaaggacatacatgaagtttttaaaatagtatataacacatagtaagcacttagtgggtgctaaccatgatcatcattcattatgaagtttagttgcattggtaactaatcctcaaatagcattttcgaatggttactcttgataaagaaactatacttacttattaaatcggaatgtccccaccaagacttcaacactattcgctctgctataatcccctctctccatccatactcatttctaaaaacaaaaacaaaaacaaaaaaaaaacaagctctttagtctagacacatggttgttgctatctctagtgctatacttttaatatttaacttctggatcagcctcctactagcttatccacattgcttcccttctttgaggtcctactcaaggcttatctccaaataacccttcctaactcacctagctttagcattccgtcattacaccactcttccgactcccccattgtcaggcattcactgaaactagtacccaaatgatgtaatttctctttcatgtaggtttgctttatctcaaaaataagaaatgtctttcattaatgctgtgcccacatttagaaatcagtccaaattgctactcagccagtcattgaacttttgttattgccacttggtaccaaaataaaatttaaaaacgttttccaccaagtggtttcagacctgggttccgcagattataagaaatggaagcagtagcatacatttcaatatatgtaatagatgttgtaaattatttcatccataagactcttcataaatacatgtaatgaagcttttaaccaaaccatggcatgtcttacccttatttcctgcaactacatcaattagcgtgtggtgctaaagcataataaaccacgacaaaagtaatccttattaaaacacaattcttttactctgggtaccaggccaacaattcaagaggtcaattaagattcttcctaaagagattctttaacttgggagtttacgaagccagtaaaatcatttgtacagaatgctgagaccacatgctagaatgagaaatagatcttggttattttacacagctgtatccaaaaaaaaaaaa

SEQ ID NO: 115891 - DNA, 232 bp, Homo sapiens
ggctggaaggttggttaatttggtgcatgatgactctcaaaagtaacagggacctgtaatcccagcactttgggaggccgaggccggcagatcacgaggtcaggagatcgagaccatcctggctaacacggtgaaaccccgtctctactaaaactacaaaaaaaaaattagccgggcgtggtggagggcgctactcgggaggctgaggcaggagaatcgcttgaacccggga

SEQ ID NO: 115892 - DNA, 655 bp, Homo sapiens
tcccagctacttggaaggctgaggcaggagaatcgcttgaactcgggaggcggaggctgcagtgagccgagatcgcgccgctgcactccagcctgagcaacaagagcgaaactccgtctcaaaaaaaacacaaataattaaattaaaaaaataataataatctcccagccgggcgtggtggctggcgcctgtgatcccagcactttgggaggctgaggcaggcacattgcttgagctcaggaggttacagtgagccaagatcacgccactgcactccagcctaggcaacaaagtgaaaccctgtctcaaaacataattatcatctcccttgcatgggggcaggccttgctctggctgccctagtcaggtaccacggctggttctggggtgtaactgcctggctttgagtccacagcatagactttcctgtctccttgggagcactgattcttccatggcagcccaatgccatggggcctcggtctcaggccagtaaccagctcctgagcttctcgggagacagagctggctgtctcacacctcacctcacctcacgacgaggtggggtgagcggggcatccgaccatcatccacccatccatcctgatttattcagtgcttctgtggtcagcacaacatcccgaaaatgtgcccg

SEQ ID NO: 115893 - DNA, 325 bp, Homo sapiens
tgaattttttgtagagacaggttcttgctacattgcccaggctgatcttgaactcgttgcttcaagcaatcctcttgcctcaacttcccaaagtgctgggattacaaacgtgagtcaccacttggagccccactgagttcttgattttgaaatctgtggtaatgtaatctgcatcttgataccgaagttttcctcatataaaacctaatttcagctatttaggaggctgaggcaagaggatcacttgagcccaggagtttgagtccaacctgaacaacatagcaagaccccaactctaaaaaacccccaaacctgtaaataaaac

SEQ ID NO: 115894 - DNA, 592 bp, Homo sapiens
cgttccagcctgggtaacagaatgagaccctgtctcaaaaaaaagcaataaaggtaatattacaactgataccacagaaatacaaagtttatcagagaccactatgaacatctctatacaattctgattttttattatgtatatgtgacttgttttttcctttctgaaaataataggttattctttgattccagtgttctgaaatttcatagtgatgtatcttcaaatgggtctgttttctatccattttgccggatattcaacaagccccttcaacttactaacatgtattttttagtttagggagacattctcgtatttttaacttgattttctccgcttctttatttgtttctctttctggagctcttaatgtttggatgttagaccttttaaatgaatctttttcttttctttcctattttgcatctgtcttctttctctgctttttgggggagtttcccaatttccagcctgtcttttgactttttaaaatttctactagcatttgtaattcccttccataagctcctttttattctctgaattttttattaacatcatgtttttgttcatgagctccatatctact

SEQ ID NO: 115895 - DNA, 331 bp, Homo sapiens
tccgtgtatgttgctaaacttctttttggtggagttatgttttctgtctctaccatcttgtgtgataatgagctacaaaaccagggatactgaggagagcagagtgccttaggagggcctagagttgataagcggttggggcagatgtaatctgtacagccagagaccttcatagcccatggaaggagccagtactgaacacttactgtgcttccttgattccagaatgattctgttgtaaggtggatttaagaacatgttttaggacaaaaaggaaacatttctacattaaatgtagaaccattgaattatgaaaacaatgtatgttaga

SEQ ID NO: 115896 - DNA, 254 bp, Homo sapiens
tggaagacatctgttgagaggaaagtgctcttctgtgggtctggcagcttttctgtaagtcttctattctgatgcaggagcgtgtgagcagtgggtgggaggagatgctttggtacttggaatgctgaggtccggattaagtggtattgtaatagctagttagaggcagaataaaaagctgggaatcaaagcatttaaaaatgcatccttccattatttgctctcaagttaaaccatattcattctaggggaaa

SEQ ID NO: 115897 - DNA, 598 bp, Homo sapiens
cccttatcttatcatgttgaaaggttgtacaaatctgccgcttccggagaataaagaattaacttccagcatgctggagcttagccatctagtaatagtatcacagctgatgaagatcagggtagacaaggagatgcaatggcagatcctcttccaggaagaacctgctgtctggctacaggacagcgatcgacatacagcctccagctatcggcatgttcagggtcagcctctgctgcagacagctatctcaccgaggtcacagccttcctggagccacctgcatatggtgactgagtgaggcaggggtacaaaggcccagacttttggccaacacaggacaaggcaggtaaccctgctgcagagatcccctgggttgaccgaggcgttgccagccctgcactgtaggctgccatctcccccagcagtcctgcttcctcccactttctttcacagggggtgatccctaataaatatattgcagcccaattccaactcaacctctgcttcctgagaacctaatcctctgccttgtactacagctgagacatacagattccgggttctctgtgcccaggtttgaattccagtcccagca

SEQ ID NO: 115898 - DNA, 150 bp, Homo sapiens
tcaagaaaaagccacgtacaaatatggaaaaagattaggagataacaggaaaagaacagtagttagggtcacagaattatgaacagactgctaggaaatttcctcctataacatttttaaattggtttaatgaaaactttcaatgagtca

SEQ ID NO: 115899 - DNA, 672 bp, Homo sapiens
cagaaaaggaaagatgtccttgaagtcaagagaaaccacatgagcaaaggtctagagattggaaggcgcatggcacactggagggtaggggagtctgcaaagaccagtttagctagagcacaggagaagatgcagatacagttggatttgtaggatgggaccagatggtagagaccttgaaagccgagcttagatatttgaacttagccctacagacaatatatagactatggagattttcaaaacaagacctatgtgttaagacgtcacttttgatcactatgatgctcatatttagacttttacagtaaaatacttcttcattttctctcacttatctttaagccaaccaaacgcaccagtcaccttcctcctcatgaaacactcttccctgatcaatggtgtgctgtgataaatagaatcatgtattcatatgaaaggatagacaaccaagaatatttaaggattgccaaaggactccctaccaaaaaaagctctcataccagcctaccagaatatgtctgaatttcccacccactggcaattcctttgagtgaaagtccccagtggtttgttatgatacaggtgatctccggaaaggcacacagtgagcatcactggctgatagcagccgtgtgtttctcagattagtacccccagaccctaaaagaa

SEQ ID NO: 115900 - DNA, 840 bp, Homo sapiens
gtattgaaacaggaattaaaagaaattaaagaatgtgtaagcagaaactcagttgtatgtaagaaaacccaattctccctgaaaaagagaaagagctggagtcctttaaaatactaactgcctgtttttctgtggctaatgagccttacctctcctcccttctcaggcattttgaagaccctgattccctagcagtgtagctgcaaggtcactagaaagataaactcaagtcgcaaaacatgtttttccttgaaaaggaagaaatgatgtaatacatgtttcaattgaataactgtctttgtttctcacttctgtagtatgcttcaccctgcacagatgtcccctctcccaccccacaaaatgcttaaaaggtaactgaactctgttctgggctcagtcctttggatgttaattcgacttggccggtgcacctaaataataaatatcctcctgaacctaaataataaatatcctcctgaacagagtcggtctctctgattccttaaaaaatcccagaacagtatggcacttaaatgtgcaatggtatttattttaaatatcagtctgttgttaataaattgaataactaataagacaagcatcacttttaaaactgtattaccttatttgttgaatttagatggtaattttcaaactaggcaagataaaattttttacttgaaaagttttgaaaaaaacttctttggcatgaatattcaatacaaactgtagtctttatttgccaacatgcctttataatagagaacatccagcaatatgaagctaaacccagcccatgctttttagggctcactcacaatggcagcttcctagagggtg

SEQ ID NO: 115901 - DNA, 346 bp, Homo sapiens
gggtcacacctgaagctcatgttcttcctgatgagtacagtactggggcttacccaaggcccatggccactacttcctggctgctgctgatgtttattcaaggttcaaggtcaccttactcagcaggtggccaatcctgctgggactgggtccatcccatcagggcagcagattctcatctagcctagatgggtctagaaatgccattgggaagcaaaggcctggaatcaggggcttcagaaatctgcctggtactttattttacagtggctgaactggtatccagcttgccagaccaagtcctctgtaatattccttctcccttcctcaagcagaagtctttccc

SEQ ID NO: 115902 - DNA, 817 bp, Homo sapiens
gatgaagctttctctaaacttcggtattgtagttctccaaactgtttgtcttcttgctcatgctctcaagtttttaattctaactgtttctagtagattgtaaacgcctttggaatagtgtcagtatgtaatactttgttggttatccaaacaatacaggacagtcagagttgattagttgatgtgaaatagatatgtgtcccaattttgtgggtttctttttcttttcttttcttttctttttttttttttttaagacagagtcttactctgttgcccaggctgaaattcgcaccactgtgcactccagccgtgggggacagagcaaggactcgtgtctcaaaaaaaaacaaaaaaagtgtgatttcgtaaaccttgaaacaatatgtcaatgtgattggcacaggataatgtggccatttccctttgtgccgtggagtgcctttttccctccaattgtgccagttaacgcttctcaagggccacgcctttctcgtgaaattaaccattagttaccattggcaaccttgggggtccgcgggctcctctttctcccccgcgagtcttcccctctctcattcttctcgcgtcaccatctccctgtgtgcccttggtgttcacactctctttgtccattaacctggtgaaatactcctaagagcgctccatctaaagggggaccagcgcgggtcccccccactattcgtcatatccttccacaatttctccctatattttccacgaggttctcttatagacaaccctccgcggggcaatctgtttaacggcacctctttgtgtgcgcaccacatcgcgc

SEQ ID NO: 115903 - DNA, 270 bp, Homo sapiens
acactaagttaattttgcgaggaatatcttaccaagattcctagtttctttcactttttttttgagacggagtctcgctgtcgcccaagctggagtgcagtggcgcaatctcggctcactgcaacctccgcctcccgggttcaagcggttctcctgcctcagcctcctgaatagctgggactacaggcaagcgccaccatgcccagctaatttttgtatttttagtagagatggggtttcaccatgttggccaggatggtctcgatctca

SEQ ID NO: 115904 - DNA, 602 bp, Homo sapiens
agagccaaagggactctactgtgtagccccaatcaccttcttttacagttaagagcctggaacccagagaggttgagtgacttggccaagaccccctggaggcagaggagagcagaaccaatgtttcagactcccacatgacttgcgcatcagtgtcttttttttgacaatctgttgctataagaaattactcgtttggataattttcacactagaaaaccctgtgacccaaggctagcattgagaagctaaagctggccactgacatactgtgattttaaggacagtctccttcgaaattatctgcctttcaaaatctttgccattggagacactggttggggttatgttagtcttccttaaggagggctctactaaaatgccagactaggccgggcatggtggctcatgcctgtaatcccagcactttgggagtccaaggctggtctcgaactcctgacctcagatgatcccccagcctcggccttccaaagtgttgggattataggcgtgagccactgcgcctggcctgtttttgttttttttttgaaatggagtcttgctctgcactccagcctggtgagagagcgagactcagtctc

SEQ ID NO: 115905 - DNA, 327 bp, Homo sapiens
tggaagacccaaagctgctcgtgtgtgtgcgtctgtatgtgtgtgtggttaacaccataaaagtctagctttctaagttaacagctgattgggatagtgaaattatctttgctgaaatcatagttgaggtaataggtcaatgtatcaatccttacctataattaacggaggctttctagagagaacgtcttaacccaaaagagtgactctaggccaggtgcaatggctcacacccgcaatcccagcactttgggaggccaaggcaggagcgttgcttgaggccaggagttcaagactggcctgggctacagagtgagaccctgcctc

SEQ ID NO: 115906 - DNA, 588 bp, Homo sapiens
gaagcacaacctagaggtggtgaaacatcctgcaaaagtacaaggaggccaatgcctttccagaagcttggcagtggtgcacttcaggggaatgactagccacaggacacaggaggctgtataaaggtatctggaaagttgtttttcaaaaaggaatctatgggacgataaatgaaaagataactgatccaaatggaaagtgagctggcaatagtacaaacatgaataaaaggaaactcatgaaagatgaggaataggtgcaatgaaacctaaatgtaaagtcaccaaaattaaaatatgttatcagcaaagagcagagagtccatgctgcagaaaattgaatgtgtgagggcaaacttgagacatacttccagaatttgatgaattggggcaaggaggtaaaaaggattaaagaagaagagataacagatacagaggtgagaaaacagataacaaacacttcagaggaagataaatgaagacgtggggtggcatcactgatcctttataattgagacatgtttcaagagaatagaatgttcatattcaaaatcaattaaaggaactaaaccacacacacaagagaaa

SEQ ID NO: 115907 - DNA, 428 bp, Homo sapiens
cccccatcacacccagctatttttttttttttttttttttcagatatagtcttgccgtgttgcccagactggagtgcagtggtatgatctcggctcactgcaccctcctcctcctgggttccagcagttctcctgcctcagcctcctgagtagctgggattacagttgtgtgccaccacgcctgactaattttttttgtatttttagtagagacggggtttcaccacgttggccaggctggtcttgaactcctgacctcaattaatccacccaccttggcctcccaaaatgctgggattacaggtgtgagccactgtgcctggccttgttaacaatttttaagtggtacgtgaaatacctcaacattccctatgacagcatatggaaaaaagcgctgggctagtggcagattctgaccttaggttttc

SEQ ID NO: 115908 - DNA, 438 bp, Homo sapiens
gcaatgcattttttagaactctttcatggtaacttttacttatccatgcaggtcctaccttaataacattttctcaaggaggcatccatttgtaggtggttagatctgtgctggacatcttgtactttcatgtgaaattcttgccattgctgaatggattagatgagcataattatttactttaatatttctctctggctggagctttttcgtggagggattatgtttgtttattgttatatgcataatacgtggccttagtaggcatgtagttacctgtcaaatgaaaaggatatttgagggctttatttgctcagtattgaccaagctcaaagtctacattgatgaataacattttttgatcataaataagaatgagagattttgaaatatattttatttaaggaaattatactttaagagactggctctcactgt

SEQ ID NO: 115909 - DNA, 374 bp, Homo sapiens
ctcctggctctagggatcctcctgcctcagcctcctgaatagctgggactacaggcatgtgccagcacacccagttaatttttgtatttttggtagagacgaggtttcaccatgctgcccaggctggtctcgaactccggagctcaagcaatcgcacctgcctccatcttccaaagtgttgagatcacaggcactggccaccgtgcctggcctgtttttgtttgtttgtctaagacagggtcctgctctattgccaggctggggtgcagtggcatgatcacagctcactctagtgtcaatctgggctcaagcgatcctcccacctaagcctctcgagtagcttaaactacaggtgtgcaccactacatccagct

SEQ ID NO: 115910 - DNA, 337 bp, Homo sapiens
tgtaatgtatttgaaaatatgtgttcactgacaaatacactgaactttttcccctgaattattgtataatattcagtaatcgtttatgaaatgtgtaacatttttcaaggggatttacatatcaacttttcctagtggaatcaacaacagtagcatgaaatgtatctactccatttactcttatccagtgctcctactttctttttccctttaatttttatatatggtaaaaatttcattgaagagagattttagatgacaggactgtaattttaaacccaatagaagaggtgtaagcaatttgagcttagctgaagcataatcttaggttgtcaag

SEQ ID NO: 115911 - DNA, 368 bp, Homo sapiens
agtttgctagggttgttgtaacaaagtaccacaaacttgcttaaacagaaatccactctctcgcagttctggagagcagaaatctgaggtgaaggtgtggggcagggttggttccttctggaagccaaagccacgaggcaggatctgtcccacgcctctctgctaactgctggcagtggctgctcatctttggtgttccctgttttgtagaagcttcaccctgtccctacctgcgttgtcacgaggcgttcctcctgtatctgtcttcacatgaccgtcctcttataaagacatctgtcacattagattaggggcccactccactccagtatgaccctatcttaactgattacaactgcaatggccct

SEQ ID NO: 115912 - DNA, 388 bp, Homo sapiens
accctgggtgcatgcatgtgacaaaaaaatgacttgcaaacaaattggcaatagcccaccaccatttgctgaaaaggaggtgacacagggttggtgtgtcctcaggcccagcctcaggacaaggctgtgtctccagttcctacaccaccgagggttggagtgggtgaggtgcctgcaatgggtgtaccccagaattaccagctgggccttctggggtggtcatgggcttagagcatgacttaagcccttcttgacaggacgaaaaagaggcccagagaaggaagacatgtccccagggccacacaacagaattcatcactggcttcacacacgatgggcctctggtgtcacctccatatcgtatactcagagtgtgtacacacacacc

SEQ ID NO: 115913 - DNA, 1063 bp, Homo sapiens
caaaactgtctgtgtagaatcaaactagatgacagagatgattttgataaatgaaaacacaccaaatatgtcttcatctgcatgaaagtgaacccctgcaatgcagagcctgcacccgggaagcagtaattctttgagtttttgctaaggagggctctgtacagaataatgtggcaactagaacaggttaccaaagcaccaagcttgcagtggcacttcacagacgcttgctgaatgaacataaacaagtgaatgtgacacttgaaaggcagctctacatcagaaagttaagagttgtgggttctagttccaagcatgtcacaaaagaactgggcaaggaaatattaccgtccctttctggacttctaggtccttatctgtaaaacaaagtgcctgagctaagtggcttctggtatccctccaaactcacaatgttttgattctctgatgtgcattaagagttattttcccatgacattgtagaatcaaagatgacatcatttcaatttaatgagagagtcagtagatctcccttaattatcaaaagaatttagcaatcttgaaaaacaaaacaaaacaaaacaaaaacacacaaaaaaacacaaccttgctgtgtttcctgcttgcgctctgtctcaaaatgtgtagagctgaacagaactactttggcatcttcaggccaaaagccactcaaaatagcctttggctggctgatatttttcagtcataagtaagattttttgacccctgatatgaacataactcaagtgtgggctgatgactagcagtgcagcgggagggtggaggatattgcgcttcaagaaattctgggggcatttcatttcagatgctctcaaagcaccctcaattataattttttttcttagtttgctgttttgcaaagactgttacttacctcgggtttcaaccaggttagggcaattttaaatgagtatttgttgcttcaataacacatttacagcttcagaaagcaagcagtgttttgcttcataggacctgatagccatgcatcttgagagtgaggaaaagttacttgccaaca

SEQ ID NO: 115914 - DNA, 704 bp, Homo sapiens
tgtgtcttccacatttctacagtgagtgtgtcttactttgagaatctgcttcacaaaaacagaaccaaaaccaaacaaaataaccactacaatggtttgttaaaagattctaggtctagagtaggaaatgaaatggtagtattttcccttgtaatgtaattttgatattggcttattctctatgttaatagtcccagaacaccttgaatgaacgggtggctgggtccttagtacattgacaaaaatacatactgttaatttctctcagccttccctaaagagatctacagtctttcaccagtgtaagtgtgcatttggggaaaaggaaataatactatctttcagggacactggctctgagctggcactaattccaggagacgcaaaacattactataggccactagtcaaagtggaggcttgtaatggtcaggaaatcagtggagttttagctcaggttcatcttacattgagccctgtgtgttcctgaaatcatccagtggtcatttccccagttcctgaatgcatatttagagtaggcacactcagcatctggcagaatccatacattgctatcctgaactgtggagtggggtaatgttatggtgggaaagggcaagtggaagctaatagaacagattcctcacaggaagatagtatactaaaaacaatactgcatctctggagatattttgaaggaatca

SEQ ID NO: 115915 - DNA, 416 bp, Homo sapiens
aaagtccatatgttgacgtccttgccccaaggcgatggttttagagaggtggggcctttgggagatgaggtcatgagggctgcttccctcatgagcgggattaatgccctcagaaaagtggctggctgggcacagtggctcacatctgtgatctcagcactttgggaggctgaggagggaggattgcttgagtccaggagtttgagaccagcctaagcaacatggcaaaaccctgactctacaaaaactacaaaaacttagccggttgtggtagcatgtgtctgtagtcccagctacttgggaggctgaggtaggaggattgcttgagcccagaaagttgaggctgcagtgagctgagatcacaccactccactccagcctgggcgacagattgagaacctgtctcaaagaaaaaa

SEQ ID NO: 115916 - DNA, 378 bp, Homo sapiens
gaatgttctggagtacaagaggatgacatatgaaacaacccttctctctgcccattctcacctgaactttccttaacttttccccatccggtcacccaacaaaagggtggaattgccaactgctttgtgacactgggcaagcaaataggcaggatggcagaagtgaaggtgacttgagaggacagtttcaacaaggcgacgtctgccgttgtatcttggtacttgggatggatgacgattttggacacgtagtacttcacacgtttccttgagtcacctactgtaatcgatcctagccacacagtatatgaaaaagtagtccaggtcctatggggaaaagaaaggaggcctgcttatggcctgcagctgggtcagaac

SEQ ID NO: 115917 - DNA, 402 bp, Homo sapiens
ttgtccgagctgggaagaggcagagtccagattcgatcccaggcccctaattcttagccactcctatgtgctatcctcagagggctcctggttgctttcagagctgtaaacaagggaggcaggggggtccttaaacccagggaaggcgcctaacctgcttaggtgggatgggaagttgtcagggaaggcttcctggaggaggtggctgttaacctggattttgacaggttataagaaatagaaaatggctttgtgtagtttcttcattccacaaacattgagcaaggtctctaggctatggaaacccagagatgtgtcagacccactcccggcccttgctctcagcagtggtgaaatggaattaattacagagactcctgtagctgcagtgtaaggattgtt

SEQ ID NO: 115918 - DNA, 723 bp, Homo sapiens
atgccaaagagaagccatcagtccttcctttaagtgaaaatttgaaagctcttggcttaataaggagaggaaaaaagtcatatactgaggttgctaagatctacggtaagaacaaatcttctatccaggtaattgtgaaggaggaaaaagaaattcgtgctagtgttggtgttgcaactcaaactgtaaaagttacagctacagtgcaagatgggtgtttcgttaagacggaaaagacattaaatgggtgggtggaagacatgaatagaaaacatgttttgataaccaccagttgcaccagaaagcactgagcatctgcgaagacttcagcaagcaagaaatgagttgacaccacgccgcaaagggctggttacactgattcagaaatacagaaggtcagtagcagcctatggctacatcacaatgcttacatcattcacctcttgtcatctcatcacagaggcatcacagcatctcccatgacaagaaaggaatgtggatacggagagacttggcaaccaccggcaggcacagcagcaccagctaaattgcagctcaccaacaggcagcagttacatccctagttgtgctggtgtgggtctggagccaatgagtaagccaagagcagaccctcacaccctgcaccctgccccacaaggagctacccaagagtccacaatcatggccacaccttcctgctcacagcaccaattgtttataaga

SEQ ID NO: 115919 - DNA, 351 bp, Homo sapiens
ccacagaggagctccagagagcagcctgcttgaggctggtcgcggaagactgacggtggggctagtgaggctgctgtattttggctgccgccgccgctgctgccactgggcagataccgcagtgaggggtctgaccgcgctgagtgctctcgggaatctgggctctggctaggaatgagaagttaagagagggagggctgagaggtgggcaggactcaccaaggagctgcaaacccaaacgagaaatctagggagcaaaaggagaggaaagagtgagcttgagccaagacatcatgccaagtggaactggaggaaatgtcatcattggtaaaggaggactcggagaagaaa

SEQ ID NO: 115920 - DNA, 178 bp, Homo sapiens
atcgtgagactatttaaggaatcttaattgctgtcgagagcctgatgtcctctacccgagggggtcactcaggttgtcttttgaatggatttgtacggtggggaatttcagaagctgaggaagtagagagaaaaatagtaatgggagagacagcctcagcttctgttgggagtaggat

SEQ ID NO: 115921 - DNA, 793 bp, Homo sapiens
gactgttctcacccacatagttacagacactatgaaatagaagagcagtctggagtcattgcaaagcaaaatacctaccatcagttctctcttcctatttcttttttttttctttggagacagagtcttgctctgtcaccaggctcgagtgcagtggcgcgatttcggctcagtgcaacctctgcctcccgtgttcaaggattctcctgcctcagcctcctgagtagctggggctacaggagcgtgccacaacgcccagctgatttttgtatttttagtagagacggggtttcaccatgttgaccaggatggtcccgatctctttacctcgtgatctgctcgccttggcctcccaaagtgctgggattacaggtgtgagccaccgtgcccggccctctcttcccatttctactccagcttcccatcttagtaaaaaaaatctgtgagcaacaccctgtagcgggaaaaggtaacctgtcttgatgggagtccataggaggctgcaggctgcttccctacagagactgatatcaaggtagctgcagaatttagattctaatcctagtgtgattggaggtggggtagattccagggaggtcagaaagtgatcaaatacaaaattgtgctcctttggaggaggtcataggaactttgaattatgacaatggctagtaattgggtagaattggagcaggctggtgatggcagttttgtgtgggtggtaggacctaggaatcaaacttgagggcaaattgtggagcacatatgacaaacgatgtagagcctttcctat

SEQ ID NO: 115922 - DNA, 295 bp, Homo sapiens
ccactattctgttttcttttttaaatttttatgatttttttttccctttaagctctgttggactcaatcctttctatctctgtgggctttgctgtacatttgggttacttccactttttgactgttatgaataatgctgctatagaacattcacatgcaagcatttgtgtgaacatgttttcagttctcttggatgtgtacctgggagtagaattgctggatcatatggtaactctgtttaaccttttaaggaactgtcagactgttttccaaaatggctgccccattttacgtt

SEQ ID NO: 115923 - DNA, 427 bp, Homo sapiens
gctctaactggtgaccctcaccttaggagggagggatatagtttgaaatgctgtctccacctgccccaccttccgatgactccttaagggagtcatgtgatattctaccctcatttccatttgagaatctaaaccagtggttttcagccttaattatacattgtaataacctggaattcgaaaaaacagcattaggacctagaacatagggcccaatcccagaaggtcccgatttaattgatctaagtcatcaggactttttaaaagctccccagataagagaatttagaaacaggcccacacatatggtcatctgatatgtgacaaaggtgacactgcagtgtcctgtcttgtcttttctcttttcttttgagacagggtctcactttgtcacccaggttggaatgcagtggcacaatcttggctc

SEQ ID NO: 115924 - DNA, 125 bp, Homo sapiens
atctttctttcaaaaaaagttatgaaaagatgcttttgcattgcaccctatctgctggagcttccaattagaattgagccagtggcattttccggtggtaccggtgcccttttcccttctcagtt

SEQ ID NO: 115925 - DNA, 359 bp, Homo sapiens
tccttctaccctgggtcctccttctcccagcaataaagaattaggtcattcaaagcatctcctctccctaagagtgtggatctcacccaccacatgctgtccttgatctggggcctgacaaagattctctccatgaccacacgttaggctcttctgagatttttttcaactaggggtcaacttttgagcttctgtgtttgtctctgtccaattgtagcacgaatccagtttagacagaatcctccatcctcaatatctgatcacccttgatatctgattgggttcctcatctgtcttacgctgttcctgctgctatagcaaaataccttagaatgggtaatttatgtactgctcactat

SEQ ID NO: 115926 - DNA, 478 bp, Homo sapiens
cctcggctgccaggcagggaagggccccctgtccagtggacacgtgacccacgtgaccttacctatcactggagatgactcacactctttaccctgccccttttgctttgtatccaataaataacagcacagccagacattcggggccactactggtctccgtgcattggtggcagtggtcccccgggcccagctgtcttttatctctttgtcttgcgtctttatttctacactctctcatcgccgcacacagggagagacccaccgaccctgtggggctggtccctacaccctggaagaagggcagatgaactcagagacagcgcacagggtcacataaaatgagccatcccaaaacaagcccgtctctttcctaacagttataatgttgttaggacggggaaatgtgcagagaggagcagagccagcatcttcctgattttacaggcaaggaaactgaggctcagccagtaaatgg

SEQ ID NO: 115927 - DNA, 328 bp, Homo sapiens
ctggctctgaacttaggcctggctctgaacttaggcagagatgagagaaacaccctaggaacagccgagcagcatgacagcgggagactggacgctgaccccgaggagccaccacaccaaccacagctgctcgtgcccagacaactgcatgtgacagaaggaaacacatgttggtgatttgggtttctgtgaccacaaatgaacctaagtcctaactgatatatcagctgccaactagacatctccgtttgttcatctcaagcactctcagttcagtttgtcccccagctcatcttcccccattgcctcccctaaattccctgccccc

SEQ ID NO: 115928 - DNA, 1827 bp, Homo sapiens
cactcagccaactgctcgctcactcacctccctcctcggcaccatgagcacctgcagccgccagttcacctcctccagctccatgaagggctcctgcggcatcgggggcggcatcgggggcggctccagccacatctcctccgtcctggccggagggtcgtgccgcgcccccagcacctacaggggtggcctgtctgtctcctcctcctgcttctcctctgggggagcctacaggctggggggcggctatggcggtggcttcagcagcagcagcagcttcggtagtggctttggaggaggatatggtggtggccttggtgctggcttcggtggtggcttgggtggtggctttgctggtggtgatggccttctggtgggcagtgagaaggtgaccatgcagaacctcaacgacagcctggtctcctacctggacaaggtgcgtgccctggaggaggccaacgctgacctggaggtgaagatccatgactggtaccagtggcagcggcctgctgagatcaaagactacagtccctacttcaagaccatcgaggatctgaggaacaagatcctcacagccacagtggacaatgccaatgtccttctgcagattgacaacgcccgtctggccgcagatgacttccgcaccaagcgagtttgcagtggtatgagacagagttgaacctgcgcatgagtgtgggggccgacatcaatggcatgcgccaggtgctggggtgctggacgaactgaccctggccagagctgacctggagatgcagattgagagcctgaaggaggagctggcctaactgaagaagaaccatgaggaggagatgaatgccctgagaggccaggtgggtggagatgtcaatgtggagatggacgatgcacctggtgtggacctgagccacattctgaacgagatgcgtgaccagtacgagaagatggcagagaagaaccacaaggacgcagaggaacggttcttcactaagacagagaagctgaaccacgaggtggccaccaacagcgagctggtgcagagcggcaagagcgagatttcggagctctggcacaccatgcagaacctggagattgagctgcagtcccagctcagcatgttaggaatggtgccaggcccggtggtgcacccagaactggcagggagagaatggccacactcactaatccttgattccctttccctccctcacagaaagcatccctggagaacagcctggaggagaccaaaggccgctactgtgtgcagctggcccaaatccaggagatgattggcagtgtggaggagcagctggcccagctctgctgcgagatggagcagcagaaccaggagtacaagatcctgctggacgtgaagatgcggctggaacaggagatcgccacctaccgctgcctgctggagggcgaggatgcccaatgagtcttggccctccccttaatccgccccaccatggcactctcacggccccaccatgtatctaatgaccctgcccttttctgtcttcacagcctctcctcctcccagttctcctctggatcgcagtcatccagagaccgtgacctcctccagccgccaaatccacaccaagatcatggatgtgcacgatggcaaggtggtgtccacccacgagcaggtccttcgcaccaagaactgaggctgcccagccccgctcaggcccaggaggccccctgtgtggacacggatcccactagaagatcccctctcctgccgcctaagcacttcacacctggaccctgcttcaccctcaccccctcctggcaatcaatacagcttcattatctgagttgcat

SEQ ID NO: 115929 - DNA, 1855 bp, Homo sapiens
cactcagccaactgctcgctcactcacctccctcctcggcaccatgagcacctgcagccgccagttcacctcctccagctccatgaagggctcctgcggcatcgggggcggcatcgggggcggctccagccacatctcctccgtcctggccggagggtcgtgccgcgcccccagcacctacaggggtggcctgtctgtctcctcctcctgcttctcctctgggggagcctacaggctggggggcggctatggcggtggcttcagcagcagcagcagcttcggtagtggctttggaggaggatatggtggtggccttggtgctggcttcggtggtggcttgggtggtggctttgctggtggtgatggccttctggtgggcagtgagaaggtgaccatgcagaacctcaacgacagcctggtctcctacctggacaaggtgcgtgccctggaggaggccaacgctgacctggaggtgaagatccatgactggtaccagtggcagcggcctgctgagatcaaagactacagtccctacttcaagaccatcgaggatctgaggaacaagatcctcacagccacagtggacaatgccaatgtccttctgcagattgacaacgcccgtctggccgcagatgacttccgcaccaagcgagtttgcagtggtgggccagaacatccagtgtccccaaagtatgagacagagttgaacctgcgcatgagtgtgggggccgacatcaatggcatgcgccaggtgctggggtgctggacgaactgaccctggccagagctgacctggagatgcagattgagagcctgaaggaggagctggcctaactgaagaagaaccatgaggaggagatgaatgccctgagaggccaggtgggtggagatgtcaatgtggagatggacgatgcacctggtgtggacctgagccacattctgaacgagatgcgtgaccagtacgagaagatggcagagaagaaccacaaggacgcagaggaacggttcttcactaagacagagaagctgaaccacgaggtggccaccaacagcgagctggtgcagagcggcaagagcgagatttcggagctctggcacaccatgcagaacctggagattgagctgcagtcccagctcagcatgttaggaatggtgccaggcccggtggtgcacccagaactggcagggagagaatggccacactcactaatccttgattccctttccctccctcacagaaagcatccctggagaacagcctggaggagaccaaaggccgctactgtgtgcagctggcccaaatccaggagatgattggcagtgtggaggagcagctggcccagctctgctgcgagatggagcagcagaaccaggagtacaagatcctgctggacgtgaagatgcggctggaacaggagatcgccacctaccgctgcctgctggagggcgaggatgcccaatgagtcttggccctccccttaatccgccccaccatggcactctcacggccccaccatgtatctaatgaccctgcccttttctgtcttcacagcctctcctcctcccagttctcctctggatcgcagtcatccagagaccgtgacctcctccagccgccaaatccacaccaagatcatggatgtgcacgatggcaaggtggtgtccacccacgagcaggtccttcgcaccaagaactgaggctgcccagccccgctcaggcccaggaggccccctgtgtggacacggatcccactagaagatcccctctcctgccgcctaagcacttcacacctggaccctgcttcaccctcaccccctcctggcaatcaatacagcttcattatctgagttgcat

SEQ ID NO: 115930 - DNA, 532 bp, Homo sapiens
agcgtctggcttgagctcttgtgcgctgtggaccggccgacgctatgtgagtcgtcatcgcatgtgtggacgtgaagatgcggctggaacaggagatcgccacctaccgctgcctgctggagggcgaggatgcccaatgagtcttggccctccccttaatccgccccaccatggcactctcacggccccaccatgtatctaatgaccctgcccttttctgtcttcacagcctctcctcctcccagttctcctctggatcgcagtcatccagagaccgtgacctcctccagccgccaaatccacaccaagatcatggatgtgcacgatggcaaggtggtgtccacccacgagcaggtccttcgcaccaagaactgaggctgcccagccccgctcaggcccaggaggccccctgtgtggacacggatcccactagaagatcccctctcctgccgcctaagcacttcacacctggaccctgcttcaccctcaccccctcctggcaatcaatacagcttcattatctgagttgcat

SEQ ID NO: 115931 - DNA, 1731 bp, Homo sapiens
cactcagccaactgctcgctcactcacctccctcctcggcaccatgagcacctgcagccgccagttcacctcctccagctccatgaagggctcctgcggcatcgggggcggcatcgggggcggctccagccacatctcctccgtcctggccggagggtcgtgccgcgcccccagcacctacaggggtggcctgtctgtctcctcctcctgcttctcctctgggggagcctacaggctggggggcggctatggcggtggcttcagcagcagcagcagcttcggtagtggctttggaggaggatatggtggtggccttggtgctggcttcggtggtggcttgggtggtggctttgctggtggtgatggccttctggtgggcagtgagaaggtgaccatgcagaacctcaacgacagcctggtctcctacctggacaaggtgcgtgccctggaggaggccaacgctgacctggaggtgaagatccatgactggtaccagtggcagcggcctgctgagatcaaagactacagtccctacttcaagaccatcgaggatctgaggaacaagatcctcacagccacagtggacaatgccaatgtccttctgcagattgacaacgcccgtctggccgcagatgacttccgcaccaagcgagtttgcagtggtatgagacagagttgaacctgcgcatgagtgtgggggccgacatcaatggcatgcgccaggtgctggggtgctggacgaactgaccctggccagagctgacctggagatgcagattgagagcctgaaggaggagctggcctaactgaagaagaaccatgaggaggagatgaatgccctgagaggccaggtgggtggagatgtcaatgtggagatggacgatgcacctggtgtggacctgagccacattctgaacgagatgcgtgaccagtacgagaagatggcagagaagaaccacaaggacgcagaggaacggttcttcactaagacagagaagctgaaccacgaggtggccaccaacagcgagctggtgcagagcggcaagagcgagatttcggagctctggcacaccatgcagaacctggagattgagctgcagtcccagctcagcataaagcatccctggagaacagcctggaggagaccaaaggccgctactgtgtgcagctggcccaaatccaggagatgattggcagtgtggaggagcagctggcccagctctgctgcgagatggagcagcagaaccaggagtacaagatcctgctggacgtgaagatgcggctggaacaggagatcgccacctaccgctgcctgctggagggcgaggatgcccaatgagtcttggccctccccttaatccgccccaccatggcactctcacggccccaccatgtatctaatgaccctgcccttttctgtcttcacagcctctcctcctcccagttctcctctggatcgcagtcatccagagaccgtgacctcctccagccgccaaatccacaccaagatcatggatgtgcacgatggcaaggtggtgtccacccacgagcaggtccttcgcaccaagaactgaggctgcccagccccgctcaggcccaggaggccccctgtgtggacacggatcccactagaagatcccctctcctgccgcctaagcacttcacacctggaccctgcttcaccctcaccccctcctggcaatcaatacagcttcattatctgagttgcat

SEQ ID NO: 115932 - DNA, 224 bp, Homo sapiens
acctcaacgacagcctggtctcctacctggacaaggtgcgtgccctggaggaggccaacgctgacctggaggtgaagatccatgactggtaccagtggcagcggcctgctgagatcaaagactacagtccctacttcaagaccatcgaggatctgaggaacaaggtgggtgaatgggcagcagaaggtgccattccagctagctccttctgggaacaatagatg

SEQ ID NO: 115933 - DNA, 300 bp, Homo sapiens
gggacagtaggtatcttttgggttaataaacggacctgagaaattcttttccatttaaaaaaatgcagattgattttgtgccgagcagaccctgttttaaaaaatacatacgtgggaatttttttggtttattacatgtggaagaaatataaactactatcttttttgtcttcttgctgacagcatggctttggggaataaatatttgaaaataatcctaatacctttgttagttatagtctgtcattctaaataatgtatttcatccctttagcaaacttgaaacacaggcaagtgtaa

SEQ ID NO: 115934 - DNA, 317 bp, Homo sapiens
actcaaattcagacatcaaataccaattattatgtcacttcataagtgaagactcaagtcacatcagttacctcttcccttatctgtatttttacgagcactttgctcacacttccatgacagcaagaatcctatgacattataaataattttatatatttcttatttagatttaactttctggaatctatttttgtatcccagggatttgacacacagtgttcattaaaagcttgcgctcaatgtatatgagtgactaatctttgatttactaaatatggtcagctagaacagaattttccttttggttttcttga

SEQ ID NO: 115935 - DNA, 385 bp, Homo sapiens
cttcttgggttttgggactacaggcatgtaccacgacacccagctaatttttgtattttttgtagagatgggggtttgctttgttgcctaggctggtcacgaagctgttgtagttatcttagtgaaagatgatgagaacctaaaataagacaatgacaataggaataaagaggaaggtctggatagaagaaatagtaaagagaatcttgatgggagcaaagtagttgagacttagcaactgaatatggagggaggatagaaaagaggaaggacccttatgatgagtctttgtttcatattttgggtaatggggtagttgatggggaatataaaaaagaagaggaagattaagggaatgattataaattaaattaaggttgtatta

SEQ ID NO: 115936 - DNA, 686 bp, Homo sapiens
gggaaaaagagaaggaggaacagattggagctgcagaggataagcgaggacagagggacagagatgaggctggagttacagggacaggtggacaggcagaaagacagcaaagggagggacagacagacaggaacagaaggacatggaggctgagggagaggggagaaagagcaagatagacagggagacacagagaaagagaataagagagaccaaggggataatgcaggtttatcaacagagacagggacggagaggagcagatggagaatgaaagagtggtattcaggaaagtaggcagaaatgccacagcctaaggcccacaggaaaagaaactgaggtacagagaagccagacaaagaccaatggtgtgtagagagatggtgagtgctgggtttgttggctcacgcctgcaatcccagcactttgggaggccgaggtgggaggattgcttgaggccaggagtttgaggccagcctgggcaacatagagcgactccatctctacgaaaataaaaaaattagctgggcatcgtggtatgtgcctgtaaagtctcagctactggggaggctgaggagggaggatcccttgagcacaggaggtcaaggctgcagtgagctgtgatcatgccactgcactccagcctgggcgacagagtgagaccctgtctcaaccaaaaaaaaaaa

SEQ ID NO: 115937 - DNA, 371 bp, Homo sapiens
caattagctattatggaattttgagaaatacatgacaagagagaagccctcataatttcactgcctatgtgcaacctctgttagcaatttgctgttttgaaaaggagtagcacttctatataggggctgtaagagtcagacccatttcaagaaacggggttttattgagccaggaccagcccagcacagtggctcacacctataatcccagacctttgggagaccaaggcacgaggattgtttgagcccagaagttcaagaccagcctgggcaatatagagagatcccatctcttaaaaaaaaatgttttaaaaattagccagacatggtggcacacaagtagtctcagctacttgggaggctgaggcagg

SEQ ID NO: 115938 - DNA, 273 bp, Homo sapiens
ccatctgtacgatggagggtgtggacgaatcctctggctctaagtcctttggctgaagtgatagctgttagaaggggagattttatgatgctgtgatacgtaaggccaagatcttgggagggtctgattctatagacgccaagatgccctgaaccttcagaccacattctctgcagtggcccagtgacattcattcagcagttgccgatcgcatgtggtactcctctaggctctggggatacagcagggaacacagataaattccttttctca

SEQ ID NO: 115939 - DNA, 583 bp, Homo sapiens
agagaaaaatccaactaacaaaattattaggaccaacatcactaagaatgctggttgatatcttatgcatgctctttgattatagatatagttttggttaataaatatataaaatgggtagctatgctcaaaagcaacaccttcattttggtgctagttgtcttctaaacaaactaatattattcgagctaaagagaaaaaaaaaaacaaaaacaggaaacatgaaaagcagtggcattaaaccagctcactttgagttttctggacattccattttgcatacatctctctttccattttcatttatataggagttatgccaaaaacactagtttaccaaatgatgtgatctatttctttctcatcacaaaaccatctaaacattcatttcagtaaaatatctctcaggcatttaacttaagtgttaaactggtactttctcagagttcaatttgaggtggataagaccatagtaattcaatacagcaagtgtcactgtaagggaagccctcaggtggtctccctaattatttcatactaattagctcagatagtaaaaggttctgttttattaccttgatgc

SEQ ID NO: 115940 - DNA, 1547 bp, Homo sapiens
acttttctcagtgtcattcctagttctgatattttacttcagttcttttgatcacatcccatcatctccctgaaatatctctatgacaatttcttaagtgaagaatgcaaaatctactctttctcaccacgtgggacatgagtctccaaaatctacttcttccctggccagatccttatgagctatatggttcttcttcctctaaatattaatgtaaaaagatgcttactttggcaaatttgtatctctgtaatatactaagtacaaggaaggcatcaactacacattaattatgattgacacctcgtaaaatggtctgatcctctcaaaatgatcacaggggaaatgggatgtctgcaggcagtgagggacgtacctctcaactctgcctacagttgttgctgattagatcaaagctgggtcaattagagttcctgtccagggaatttggaattgggatgggaagcggcagaaccttctccttttattttactggaaagtgaggctaggaaaagaaaggaacttgcccaaggtcctacagtagggagtggcagaacttcctctctagctgcctcaatcacagcatttacctcattgtgctgtggtctgtcatggtttaaccattcactagtgtatgttaaccctaacctgatagcaaggctatcaggttatgtatgtgtatgtaggattgacatacactagttagactaagaaaagaaaggagcttgcccaagttcctttctgggagcagaaagttgagaaattgagagagaacttgagagagttctgagggctctgggcatagccagtcaacttgaaaagagtaggaagtcaccttctgccattctgtgaatcaacctgcagagtgtgtctaaaaaatgaagaagtagactgagagaaaagcagaaacaagagaaaatgagagcagattgtctgaattcttgttggttttccagttcacagttctcattcttctggaatccttgctggctctttgtcttgaagccctggtgaagactccttctttatgtgtattaggattatccaaccaatgtatttggcccattgttttgctgaagccaccttgagttgatttctgttccttgcaaccacaagaatcctaacttacgagtagcaaaactatgattagagttataaacaatccttacatgcgtttaacactgtgcacatttacaaactgcttagtattattaatgtctgctacaagcaagcactacagtaatgctgttgaagcagtcatccaacaactaataattgggtagcagctggaggttaaaaagcaagccaggaagagggagtggatttactgaaatgaaaactaatgtgaaaagtcatcaaatcacttcagataattccatttacaagagtccatcatggtcaaatggttgtagatcagtaagacagtaagaggaaattctttctattaggaaagaataaaaccgtgaaacagatggattgctgttttaaagattaaaattacaagagcacacacaactggctatgcttaggtggttcagaaaaaaaaa

SEQ ID NO: 115941 - DNA, 312 bp, Homo sapiens
ctcagagacacagtccctctgacagcacctggtccacccctctactctggcagcccggtggtgattattttgtttttcctccaccacataacctgctggaaggcagggactccacttcagaaatcttggaaaaccctgtggcccacaagggtttgagctcatattcccatctggtgaggtgcagaaggcacagagctgtgccaggacatctcgttccaacccagccccactcctaatagtaataaaagtagctacatgtttactgtgcagctacttggtgccagacacctaccttatccctatcaataatct

SEQ ID NO: 115942 - DNA, 490 bp, Homo sapiens
ctaaaccaccaagtctcagggctcttttcagtattttcccactcaaagtagactttattccttccaggtatgatacctatacggtgttgcctttgatgggccagtaccttgactctgctgtacactacttccagtgcaaaattccccagttctctctgctagtgtgggctctggatccagctctgttggcttaaggtattcatgcagtcataatgcctcctagacttggctaggaatgggtgtttgctgaattttttctctcattgtgattttgtagtactttttgaggatgtaaagggattaaaatatagatagccacttttatcccacagagatgtgggagccctacactcaattataacaaaactgttttgtggttaatttcagaattccattaaaatagtttttgtttctgacctcagtaaactataatatatgactcataccaaagatatttattaattgaggtttgaaaaaatattttaaatat

SEQ ID NO: 115943 - DNA, 149 bp, Homo sapiens
ttatttacctgtgggtggcctctccgtggcaaaagctctttgctctgaatttcgaagaccacaaagactcacttgggtgtgtgcatcagtctaggccacagagggctcactgggtgttgatggcctagtttcaccttccccagctcctg

SEQ ID NO: 115944 - DNA, 130 bp, Homo sapiens
agaaataataataatgaattggctcccccagcattctgccatggtagctgatgcatttagatgcaggtgtgtgtgtgtgtgtgtgtgtgtgtgtgtgtgtgtgtgtgtgtgatgtttaatgtgtttcaat

SEQ ID NO: 115945 - DNA, 304 bp, Homo sapiens
agggcagcttattaattgaggccacctgaagaagtttttcccattgaagttttggcaagcctgtttgttactctttgtgctggcctatcagacacttcctgtctatataaccttagggatgcctttagcaggtcattcatccctgggtgacagagtgagaccccatctcaaaacaaaagcaagcaaacaaatcccaaacccaaattctatttggcccttcacagtaccatgtggttgactcctgtcagtttcctcagcctcaaattaacccagtagctgccctggcctccttgctgtaccttga

SEQ ID NO: 115946 - DNA, 598 bp, Homo sapiens
gggagatcgtgcgaactccaaatgacagtggccctggccaggaattgatattttttctcatcaatgttgtaacaagacaatgttattcaaggacctgctgtatatatctattattttcaaagacgtattttatatatatgcatttttccctgtaatcctgaagagaattcagaggtatagttacatggctagtaaccaacagacccaactttgaacctatttctgactccaaagccatgttctttctattacatgggaactcataaaccaggagagacagagccaaaattaccttaaataagaagcccatagtgaaaaatgttaagctagagttgtagtctctaaactttttttgattgtatacctctcttggtaaaatactcttgtgcaactcccactataggaatatttgtttttttatatatttatgttatatacttgtattattgtgctaacattatattataaaacacatataacatttacattaaatttatatgtgaatgcaatttacatataaatttcttactatactcccccaaatcatcttgcacatatctttgaaaacccctgaactagagaatagaggaaggaagct

SEQ ID NO: 115947 - DNA, 189 bp, Homo sapiens
agcaccggcccgaattaagagaaagaggaaggctaaacaggatttgtgttgtattgccaagggtttgggctctaatttttgtctttcttttctttctttctttctttctttctttctttctttctttctttctttctttctttcttccttccttttccttccttctttccttctttctttcttttcttt

SEQ ID NO: 115948 - DNA, 371 bp, Homo sapiens
ggaagctctgcttgttcacaggtacagagcttttgcagaaccgactctgtacctggcagccttgaaggggcttggattcaaagcatattcttgagccacgccatctttaatcaaactgcaggtggaatttgtagctgttagaatagctcctattcctttcatttctttttctgtttttttactcttccatctcagcctaaaaagaaaaacacgttaatttgagccataggaatttagaatttgttttttcttttgcttagatatgtttgactaaagcttcctttttcacaggtttattttttccaacattttattatgaaaaaaatatatacagaaaagttgaaagaattttacagcgcgcacccacatat

SEQ ID NO: 115949 - DNA, 307 bp, Homo sapiens
gggcacacaggcatgcatgcttcgaaagccccaaattcttcctcctcctcctcttcttcatctccttctcccaacaaacacagatgtttttcaggcatgtggagagccaggaagctcagacttggtgcccatccacgtcatcagacaagtcacccctttcctggccctcaattacccataggtcaaatagggacaagaactgccatcccagcaaccacatcagaacttcccatgctcttctagaagcttctgagctttcacagatgccattccctgcacccccacccctttgccctccttccccagg

SEQ ID NO: 115950 - DNA, 650 bp, Homo sapiens
gtccctgcttcgtttttagacacagcctatcagtcagctaatttggctatgcatataaatactttagtataaaatgctgccccctgctacctgcaggctgacatgttgctcatcaaaggcaggatccttctaatgagggattagttggatgcctaaatgtgggaccacctactctgttcattgtcttaattagctagatgtttgttggagcgcatgcaaattattttctgtaagcagacagatttattatcatatttacggagtgacatccagggtttgtgagacatccattaaatttttttttttttttaatgtttgagatggggtctcactgtgttgctcaggtgttggtctcaaactcctgggttcaagtgatcctcccaccttagcctcccaaagtactgagattactggtgtgagccactgtgcccagatgctattagcaagtatgaacaaattagatattttcagtctactcttctgtggtaatgatgataaaacttcttaactttcagtcctaaaccagcagtggctaaaacttgatttttaaaatttttttcagagtttggtccagatgaagtttctttcaccttgcgaacctttagaacgctgggctgcatcatgtgtgttgtaactttaaagttagaata

SEQ ID NO: 115951 - DNA, 289 bp, Homo sapiens
cacttcgaatgttaaccagtagtagcagtcatatttttgtggattacctgggaaccaaaccatcatcattgatataatttctattaccagttttaaacagttaaatgacaaagaatcccattttaatcaagacattacagtagagcacagacccaacctggttgggtacttagtagggagaaatagaggctagaaattaataattatgcccaataccagtgaacagctgttttcgcactgtgaccagtttagtacaaataaaaatgtttatagactgcatcttttctcc

SEQ ID NO: 115952 - DNA, 834 bp, Homo sapiens
gaatttactgggaccactggtattttcatactcccatttaaagaggtagcaaagtagggaataaaggaacagaagtccagaaataaactggtttaggaaacgtacaaaaaggagatttcaattatgtgccaattttgtggttacttgcttacacatttctaactagttgagttccttcctagcttcaggcagattagtctggaaatgaaatttgcccctgtttatatgtacctgtcttttatttgcctctgtcttttttattgcaactcaatagacacacaccattgctttgtctctgattatttggcatttgaatcgtcaatgagggaagcttttacagaacttttgatactaataaaaggtgagtcaaatgttttaaaaaagatgcagaatcatcatttatgtcagagctactgactcacacttaaattgcagtgttagcactgaaaaagaaatgtatatggatgggaatatagattgcaggccaattaggacccctcttttgaagttggaattaagggatagctactgttctcttctatctttgagggttaggagaactttattcagtgttgaataactgtattcctcctgtttattaatgtttgttgtgggggtcttctattcagcacccatctctgcctgtcctgctcccccgcccccagaggaggatataataagaggcatgggacaggggcttataataataagacatgggaggggttgattacccagtgtcttcaagtaacttttacgagagatttgaaatagccagcgatcaatgcaaaatagcaatggccttggcagaatttgcacatacatactcaatgttta

SEQ ID NO: 115953 - DNA, 420 bp, Homo sapiens
acgcagggcaacacacaaagagaagctgtaatagcagagccattcactcaatcattcatttcactcattcatttaatgcctaacatatgaagggtactttgtggagctttgagagacacaaaaatgactaagacaggacccctgccctcaaagagcccagctgttccaaatattctcattttggtatgctccaatttttaatgtaattttaattattgttgtcacaccttagctaatattttcatactcaacatgtacttccagaaattgcagcaactataccatctataaaagagggtaatcttggcagggagcggcggctcacacctgcaatcccagcactttgggaggctgagatgggtggatcacgaggtcaggagatcgagaccatcctgcccaacatggtgaaactccgtctct

SEQ ID NO: 115954 - DNA, 215 bp, Homo sapiens
tgagattacatactcatttaagaagaagtgccttaggagagggcactggtgcatcgtaggcacttaatagcagtgttagcctttgttattattattgtcagtgggcctataactgacttcacgggtgcatttattgttggctgagccagaggtgagctgtgcaggatagttggtgagagcatgtcaaatggaaggcgggaaatgactgagtggaa

SEQ ID NO: 115955 - DNA, 555 bp, Homo sapiens
ccatagcctcatatgttctaatttttagtagcctctggaataaaccagagtacttacactgttaaaaaataagaccttttctgtaacaaatttattgttataaattttacagttctattatttatcatcagtcagtttcaaaccattgggacttaggaacacagaataaataaataacactaatcagaactattaatataatcaaaatgtacttagataattgtttgctttatgtctggctcacgtgatggagataaccttcttgagagcaggactgtgtctgtcctattcatcccatatccccagtgcctacacaagtgcctgccacataaatcattcatatttgttgaagaaataaaattgaccaaaacagctaatttgcaccaagacattccagataaattctttccacaacaacaaactcatactagggttgagtggaagcaaacatggctgtaacaagtctattcacttaacttttttgagcctcagtttccttttatataaaataaggatgataacacttacctagtagagttagcagatgcttaaatg

SEQ ID NO: 115956 - DNA, 177 bp, Homo sapiens
actacccctctacccaccagtcaacaacttccacatctgaaatctcagcacccatctccggactctcttgacctcaggcacatattccaatctgtctcagaacacctctatgtctcacaggcacctcatacaaaacatatcactctaacctccccagaccgcctcttcctttattcc

SEQ ID NO: 115957 - DNA, 365 bp, Homo sapiens
gctgaggcactctacaggatctcgatcacgtgctcttgtggaggggtactcagggcaacagggacgtccatgcaagtttgcctggccaaggcgtgactcagctacccgcccccttcttctgctgagaccatttgatttcgccagtgcttagggacaatgatgtcacaacacccccttggcctggctcacagcatcttctgcttatctggtggcctttgctttttctcgttagcccacgacagttcaaacagtggcccctggcagcaatgccatggtaagcacggtcacagatgcaggccccaaaaccgcatggcaggtctcagtgacgaggcagtggcccagatctgcaggaattggcaggtggt

SEQ ID NO: 115958 - DNA, 340 bp, Homo sapiens
tttttttttgagacagggtcttgatatgttgcccaggttggtctcaaactcgtgggctcaagcgattcacccaccttagactcacgaggtggtgggattacaggtatgagccactgctctctcttggcctgagagagcatttttcattcctgaaatgaacgtgacagcagcttccctgggacactgtttcctttgctagtggtctggttgatgtaatgtgaccacctgattttgatttggcacatgtccccactcttgcctctagggcctcccctggtcatggaggaaagaacatcttcctggatagaggagtgttgttctcttaaaattttgtattatg

SEQ ID NO: 115959 - DNA, 622 bp, Homo sapiens
caaatattggctgggtatctactatatgcacttcattgaactagatgtggggaaaggatacaaaaaataagatatagttctttttgtgctccggaatcttatgatttaaaacatatccccaaataggcataatgtaatttgagcaccttaagtagtatgaaagtactatagataattactagcaccttaagtagtatgaaaatgctatagataattactatgaaaatataggcgaggccaaaattacttctatgtgaaaaaagtctatcaaaaataaatcttcatggagatgctagaaatctgattaatcttgaagactaagtaagattcacacagcatataatgggaggttggcatttgcactgaccaggtaaaaatacttatagaaaaaccatagaactgagattacagatgttttatgcagtgattagccgttttatgcagtgggtaagagctaatcttctgggagtagactgcctgtgttcaaattccagctcccctgctccctagttgagtaacttgactagttacttacacatttcagttccctaacctgtaaaatggagaaaatactacttgtacctcatgaagattccgtgagaacaaaataagaaaagctcat

SEQ ID NO: 115960 - DNA, 256 bp, Homo sapiens
ccaagtcctggcccctggctctgtctggatcctgatggaaggcacgcttcagccagcctgccctgacacagagtttgcaagcacagctcattctctgtttggtctagttccctaaatgaggtgtaggtcaagtgcacacaacaggctttgaccaggtgtgttcccacgacattaaggcttctcttcctggggctggaagtggcttggagaatgaggcctgaagccttcttatacctgcccagccctgtccctcctt

SEQ ID NO: 115961 - DNA, 550 bp, Homo sapiens
tttcctcctcatcttcgtccttgtcctcctcatacttctcatcctcatctttgtcctcatcatcctcctgtcctctgcctcctcctcctctttgcgtttctggtctttgtagtctatttttttttcctcttattttcaatctggtatttgggctctgattttgagaaggtttcctccattttattttccagtcttccttgggagttttcatttctactctcatattttaatttccatgagctcttttttatgctcggaaggttccttttaaagcaaggtagtaccgtgttcttgtgtccggaccatatagcttctctgaagggtctcttcttcatgcatactccttgtttcctccaagccctcccttcaccacgtgttggttggagtctctatttgctcggtgagaggctttcctcggatatcgggaatcttggtgttctgctcatatttagggtggggagcccaaagatgtgactagagtgtggtttgtggactgtgagttgacagtacgtatgtgttcctatctttaaaatttatttattatgaagag

SEQ ID NO: 115962 - DNA, 427 bp, Homo sapiens
tagaattgctttcttccttccccacctctttttctctattccaaatctaatagagctttctcctcaaacttcctctaatcacaagggggagtaataactagatgctaggtgtacttaacattgtgaactaaagatttacagtggataggtttgtaaagctataaactctagattcccataaaaggcaagctatgagcttacctcctccccctttctttcttcgtctcttgccatccctactctaccctctcctctctttcccccttttccttttccttttttttttcccaaattttaattttttctgtgggccaaaaatattttgcaaaaataaaagcaacaatgaatatcctagttcaaaccttaaacatttgaaaatccaaggaaagaaaatccttaggcataactgaaaattgttgatcgctac

SEQ ID NO: 115963 - DNA, 321 bp, Homo sapiens
ataaaagaaagaaaatatcagatttcacccatgtaaccaagagtcacaatctatatttgcaggctgtgcttcagttaatagcagccacacaatacttgcaatttaaagactttttgccaaaaatgaatcccaacttgcattagcaattttccattacttacaaactgtgggcttttctcttgtgactccattttactgcacatgggttttccagggctccagaggtaacaagggggtatggcaccgtgaggtatagtgcaagctaaaatgacagttaagtcattttaaaaatatttgtatgtagttgatcatttataaggt

SEQ ID NO: 115964 - DNA, 610 bp, Homo sapiens
tggagccactaggatctcgttcaaggctggtccacctcacacgaatcctaccccatgggcgctgggaagacagggttttgaacatgttgcagactggtctcaaactcccaaactcctgagctcaagcaatcccagctcaagcttggtggctctaaacagttctgttcaagggagctcttctcagccaggccttcatctttcttccatgttggatgcttcctgaccttgaaaattggactccaagttctttagcttttggactgggacttacaccagtggtttgccaggagctctcgccgtcggccacaaactgaaggctgcactgttggcttccctacttttgaggttttgggactcggactggcttcctcgctcctcagcttgcaaacagccggttgtacgactttactttgtgattgtgtgagtcaatagtccttaataaactccctttcctatatacatctatcctattagtctgtccctctagagaaccctgactgatacagaaagggtgaggggtggtatggagcctgaactcaggcctccctggctccaaagctctccactgctctgccctccccacctctctctgggtttaagctcctggagg

SEQ ID NO: 115965 - DNA, 694 bp, Homo sapiens
gcagttcctgggaccaagtgttcgccgccttttggcagcggtacccgaatccctattagtctcttaggggcaagcttctgagggtcaccttcaccctgacacctgtggcaaacgtatcttgacggaagacatagtacaccgggaggtgacccctgaccagaaactgctgtcccggcgactcatgaccaagaccgacaggatgccccgctgggccgagcgactgtttcctgccaatgtggctcactcggtgtacatacatattggaggactctgttgtggacccacagaatcagaccatgaccaccttcacctggaacatcaaccacgcccggccgatggtggtggaggaacgatgtgtttactgtgtgaactctgacaacagtggctggaccgaaatccgccgggaagcgtgggtctcctctagcttatgcggtgtctccagagctgtctgggaatttggtcttgcccagttcaaaagcaacgtgaccaagactttgaagggttttgaatatatcttggcgaagctgcaaggcgaggctgcttccaaaacacttattaagacagccagggaagccaaggagaaggcaaaggagacggccctggcagctacagagaaggccaaggacctcgccagcaaggcggccaccaagaagcagcagcagtagcagcagtttgtgtagccagcccatcacca

SEQ ID NO: 115966 - DNA, 846 bp, Homo sapiens
tgcctagctttgcccaggcagcttcagaggacagttggatatttgtaatattggaggcacggtcaagaggaacatgggctattttaggctaaagtcattttacctttaaaattcaagtagaggcaataaataagatttgtgtggtagggagaagagtgtatttcttattggtggtacaccctgtttgctgaagtctagcaaaactagttgattattcaactcatccctgaactttctatagataaaatcaagatggacaagattaaagagagaaaaaggactcaatggagttgtgaaggaagaagctgttggactttgagatgggcatttgtggagcctctgtagaggctgataatctctcccatcacccaaaccagctctttttcccagttactccatatctgtcagtgcttgcacctgtcccctaggtgagaaatttgagatgattctttatcgatttccgctatcatcttaaatatgaaataaatcaaggcctataattctgttccatttgtaatgtctctcaaattttccttcatctccacttctactgctgtcatcctttcccagtcttcagcatacgtcagcaattctggagtagcttcagactgcacgttctccttctccaatttctcccctactgtttccagcttactgtttcccaaatgccacttaactgtttctctcagagaacctgaagctactgcaaataaccacagactatgagccttttcaaaactggggctttatcatactcacttttgtagctccagtgtttaggaaagtggctgacacctaacccaattttagccttgcaacaactccatgaagtttttgaatgggaaa

SEQ ID NO: 115967 - DNA, 179 bp, Homo sapiens
gccaccacattgtctccagggtacccactaccctgattgctaacagcacacattagttttaccagtctttcaaatctttataaatgaaatgttcagctgggtatggtggcccatgcctttaatcccagcactttgggaggcccaggtgggaagatcacttgatgctaggcatttgagac

SEQ ID NO: 115968 - DNA, 444 bp, Homo sapiens
tcagcaccattgtggtatggggtgccgagctcgtagtgcgccagtcgtggtcgtggcgtgttgtggtggggggtacaggaggaggagatccctgagatgggtctggacagattgcccaggtaaggatgctcctcatcccagctcctccctgctccatgggggcctcgacactggggtagggggagcttcctgcctcctggcctgtctcccactagactggggacagtcatgatgatgaggataacgacagtcaccatgcattggggattctattatggatcaaacgcttgttagtatatttaattgtcacgaccaccgtgttttatagaagaggaaaccgaggcccacagagtttcagaagctcggccgaagtcatacagctcatagacgacagacccagtcctcaaaccctgatagattctgactccagagcacctactctca

SEQ ID NO: 115969 - DNA, 363 bp, Homo sapiens
agacattgcaggcacttatgtattcatgtgtgctcatccagggagtacagacttcaacatcaagacctagttggaatcctagctcagggagatcttgagcagatgactgagtcttttagggcccatttgtaaagttgagggataagcttaaattttctgggatgttacacatattcaaatgggcaatctagtcatccttgaaggcatctggcacaaaactctctgcacaagattctttccctagtatagctggagctaaaaatatacttattaatacatatttgattacattttaaattcttaattaaatacttaatatttgattacatatttattaataaatggattttgttccttcttctt

SEQ ID NO: 115970 - DNA, 467 bp, Homo sapiens
tctccctcatttccccccaaaaaagtacctaagagcccgtctaagacccttttttttggtcttgacttgaggtgagattttcttcaagacttctctgtagaagaaaatgaagagacttgcagaacctgaataaaatgtctgaatttctgtcttgttgattatagagttccccgaggctgggtgtggtggcccactcctggaatcccagcactttggggaggctgaggcaggaggatccctttagtccaggagtttgagaccagcctgggcaacatagtgagacctggtctctacaaaaactaaattagttgactgtggtagtgcatgcctgtggtcccagctactcagaaagctgagatgggaggatgtcttgagccttgggggtcaaggccacagtgagctgtgattgtgccactgtactgcagcctgggcatcagagcaagaccccatctcaaaacaaataagca

SEQ ID NO: 115971 - DNA, 332 bp, Homo sapiens
gctagaaactcagccagggcagatgctgtagtcttgaggcagaatttcttctcctccgggagaaatcaaccgatggtagatgttaaccaagtctgtagaatatctactcagcagcatctagtgctggagttaaatagctgggtgctatggtccagccaaggtgccgcctgaaacaccctcacatggtgggaagagcggtggttgaagaaggaaccctggagaccttgatgttgaagagagggcaagggaagagggctaaggacaagaaaagagccattggagagagaaagagatgaagtggaagacagtgagtgaggggctggcagaaggat

SEQ ID NO: 115972 - DNA, 185 bp, Homo sapiens
acacaaactctgtacacctccctctaaaaggcaaagcccaattccctttctcttgagtataggctgggctttgtgactcacttggttattaaccaacagaatatggcagaagtgacaatgtgtgactaggtcataaaaggcatcaccacttcctccttgctctctctctctctctctctctctct

SEQ ID NO: 115973 - DNA, 158 bp, Homo sapiens
tcctacgagcgcatctcataaattttggatcttgcatttatttaattcatctgaaagtatttcaacttctctgtcagctactgaaaatgagaagctggtttttaggaatatattgagaaacaggattgcaaattttggagacactggcacttaggttg

SEQ ID NO: 115974 - DNA, 237 bp, Homo sapiens
agcacctgtgtacacagttgagcaggccaaaaatcagccatttgttgaaataaatgactaagagtaacccctccaaccctgcttagaaaataggttagggcaggccgggcacggtggctcatgcctgtaatcccagcactttgggaggccgaggcgggcagatcacaaggtcaagagatcgagaccatcctgactaacatggtgaaaccccatctctactaaaaatacaaaaaaaaa

SEQ ID NO: 115975 - DNA, 469 bp, Homo sapiens
atagaactcttctatacagactactgagtcataagaaaacaaatctggcacctgaacctgttcaggccacagggagagattaatatttacaaagccccagtaacagcccttgctgataaaaccactgttatatcatctcttaatctttctgtgacatgtgaacaaagactaagatggaaattcacagagaagtccttggttgatctctttaagccaaccaccattaggatgttcctgaccatcattctccttttcctcactgccctcttttagcctgggtcttgctctgtctgatccagataaaatattttgagaaaaaactacccataattgatattcagacatttttgttaatggaagccctatttctgtgccagatgcagattcctggtatgaaccataggattactgctcagggataagtagtttctgcttctagttttaactacttctcaatgaaaagtcaaag

SEQ ID NO: 115976 - DNA, 376 bp, Homo sapiens
acgttgaaaattactcagcatatcaagcaccagaaaaaaaatctcatcttgaatgagataacacatgccaacacagtgataacacataaattagatttattcacaaggattttaaagccaccaccataaacatgttttaatgagcaattgcgaatatgctggaacaaatgaaacaatggaaagctttacaaagaaatagaagatgccaagagacaaatagaaattttggcactgaaaaatataattgaaactttaaaaaatacttgatggctcaatagggtaatggaggaaatagagaaaagaataagtgaacttgaaaataggacattaaaaatttactaatccaaagaccagagggaatatagactgaaaatga

SEQ ID NO: 115977 - DNA, 469 bp, Homo sapiens
ctcctgacctcgtgatccacccgccttgtgactcccaaagtgctgggattacagacgtgagccacctgtgcccggccaagtccaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcatgcctgcggagcccggtgggaggagccggtctgagtcactgccaccacccggctccccctgttgagagtggactccgtgcgtgtgtcccccaggaacggtgacaagtacgacggcgactgggtccgggaccggcgtcagggacacggggtgctgcgctgcgccgacggctccacctacaagg

SEQ ID NO: 115978 - DNA, 229 bp, Homo sapiens
gaattcaaacagaataattatcttccctacggtgggaaaggttgaaattctcattcagtcacacacacgtatgtatgtattgtatatagatgaatgtttctatgtaactatatataatattttatccagattgtatcattgttatctgtgagagtgttagtttagcaagctactccagtattaccggaagccagaacttcagttttgttttcttactggattttatgta

SEQ ID NO: 115979 - DNA, 425 bp, Homo sapiens
atagatgtccttaaatccaattgtcttctcagttgaatcttagagaaatttttcttttgcaatttcgctttcctgttgaccacagtatccagtgcccttttctttataatcttttgagtgagtaaaaaaattttaagaaataaaggattctgtttagggaaacttttgaatagatttgatttgatgtgagtcagggctaataaaaagctatagaagaattttctttccaataagtaaaaatcctctgttttattaaggaaaaaatagctatgttttaggtaaataactctgaaataaactggtacaacaattgtaaaatagaacatatttaaatgtcaaggtgtcttttcttaagacttcaggaatttgtattgaacaaagtctcaagttaagtagcaataattatgatgcataaatgagactgg

SEQ ID NO: 115980 - DNA, 311 bp, Homo sapiens
caaaaaacaacaacaacaaaaaaaagtgagcaaagagtttttccagagaggaagcagcaagcataagggcctagaggtaaaacagcacctaatagatttaggaaagtaaaattggctcacatgactagagtacagaatgtgaagaaaaagtgaattatctggacagacaagactggagaagtaagcaaaaaccaggttatacaagactttataaaccacactgtgcattatcctaagaataatgaataaacatccaaaagttttagcctagggagggtgtgatcagatttgcactttaaaaaggacacatt

SEQ ID NO: 115981 - DNA, 738 bp, Homo sapiens
caaaaactcttatgcagagcaaaaatcattgaaaagtgtactgataccttacaatgcttcacagaaaatccatgaaatgtgcatcgcaaggcactgtctattactgtagcaacattgctttacaaatttccaggacaggtagcgaatatcttcacttgctgtagtgctattcctaataagatgcctggagcaggtagctggctgttgtaagggctaaggattctataaggctctgataggataaagcattcaaaggagcagatttaaggcctagtcaatatcggtctcctataattcaaactagggaaacatttggtgaactggagaactgatgtacctgttcatgaaggagaaaaacaactccaaagacatgctccaaaggacagctcacccttccatgagtgatggatcaccaatctctttgaacactaagaaggtgccctcttggggccgggcgcggtgactcacacctgtaatcccagcactttgggaggccgaggcaggtggatcacgagatcaggagatcgagaccatcctggctaacacggtgaaaccctgtctctactaaaaatacaaaaaattagctgggtgtggtggcggtcgcctgtagtcccagctactcaggaggctgaggcaggagaatggcgtgaacccgggagacggagcttgcagtgagctgagatcgtgccactgcactccagcctgggcaacagagcgagagtccatctcaaaaaaaaa

SEQ ID NO: 115982 - DNA, 377 bp, Homo sapiens
tcttgggatttcgtcccagcctgacaaccttggaacagaacaagaggacaggaggtgtcgttccaggtatgtgttagctgcaccagccactctttgtggcatctgctacccatcaaaggacgtggttgggctgggagccaagttaagttttctcattgtttggcagttgtgtccccagattttcttgcccatcttggagatcttagcacagccggggtgcttggggctcagctgccttgaaggggactcagtcccccacacaggtgattcccatgtcccatggtgggcactgagattggggtgaggggagcacacttgagggacccttcacttcctcacagcccttgcccctttcctcagggtgcgctgggaagaac

SEQ ID NO: 115983 - DNA, 614 bp, Homo sapiens
agtgagattctgtctctaaaaaaataaaataataacataataaaataaaaacaaaaaatggcagtgagcaattttcctttgaatgcagctgtttaaagtaacatataattaatttcaattattatagactaagattgttaaacaactgatcctgaaatgtcaaaaccgtacagtctatttttataatagcagtatagaacaaagattaattatgatttttactgttattctaatccatgggccaaatccagccctcagtgtatttttaatgcctcctttaagctaagactggtttttatgtttttaaaagacagtatgtagcccacaaaacctaaaatatttactacttggtccttcacagaaaaattttgccaaaacaataaaatgtaaaatttgctgttgttccaaacactactaccacaaaactgtcacttgccaacaactttgcgtgtaatttcagtaaatgcatacgctgcagatgaatccatgaggctcagagactgtcacacttacaggccccttctaaaagaggcaggaaaaagctgcaccttgtacatgggtcatgtaacctaaaaaccccagtccaaacgggctgtgccacttccaggctggac

SEQ ID NO: 115984 - DNA, 910 bp, Homo sapiens
gtgggttgaccgtggtcttgtgggttgaccgtggcttgtgggttgaccgtggcttgactgtggggaggggtgtttaagaccatgacaagctatttcaatgaattatataaagaaacatagttgctttcactgcctcaaataacaccgcagtaattctgtgatacacttcagaagagttagcactggagggaaaagagcctgtgcggcagcccttggtgactacatttccctccagcgcaatgcaggtagcaggacatcagcgctttgagaactagcataagctgctgcaggaatcatcgactggcaacaatgtgccttcccagagagcctggtcttggagaatccaggctatgaggcttgcaaatgctgcatgagttttatggctaccaggttgggagcaaggttttttaacggcttcctgaatgtcagatggcaactggttttttcttcaaacaatggcatattctttaagaaaatcaaattatcaatgaaatttgccatgtgaccacaggcaagttaactattcttgcatttttcagactaggtttccttatctctaaactagagaaaatgatacctacatgtcacaggggaactggaaggattaaaagacaaaatgtgtgtaaagcttccagcacaatgtctggcacaaaacggttgccccaaaaagttcaatactcttcctttccctgctccccctcccaacaaaacaggaaaaggcaacagccaagtaactaaacaacttcttaatattccaagtttctacccaatcatctcttcttcttttaaaaccacaggcttgaaatctttactgtttactgtcaacaacggcatatactgctgtacagtcagaattttagaatttagaaatcaaatataacccccttattcaacagatgctgccggggga

SEQ ID NO: 115985 - DNA, 371 bp, Homo sapiens
aaccccatatgcacctgaatacctgaaatcataagtctatcttgagcttaaaaccctgatttaatctattctattttaaataaatagtaaaagtacctcaattatcttaaactagatgtttctctgccacttaacatggtcaaacacaaaaccatattttaccatgaaggaaaaacaaaagcttctgtctaaatccttaattgttatagttaaggctactactggaaatgtgtaagaatctcagataatgtcaatttcttactgtgtgtgcttcccagatccagccatcgcagatgtattttactttttgtgttgtcagctagtcaccatctttttctaccaatacctatagtgaatacttaatcagaacc

SEQ ID NO: 115986 - DNA, 147 bp, Homo sapiens
  misc_feature (4)..(4): n is a, c, g, or t
ttgnagagatggggcctcgctatgctgccaggactggtcttgaactcctggtctcaagcagtccttctgctttggcctcccaaagtgttggggttacagccgtgagccactgcacccaacctactttatatttttcatgatactttt

SEQ ID NO: 115987 - DNA, 407 bp, Homo sapiens
agtaagtagcatttgaagtaggtcctgtgtccttttgacataacctcattattgtaatagtttactttctttcaggagcaagattttcctgggtttatcttgtagctgtcctttgcaagaatggaatcatccttccaaactgtttcttttttaaaaattattattatactttaagttctgcgatagatgtgcagaacatgcaggtttgttacataggtttacacgtgccatggtggtttgctgcacccatcaacctgtcatctatgttaggtctttctcctaattctttccccttcctagccccctacccccaaacaggccctgatgtgttatgttcccctccctgtgtctatgtgttctcattgttcaactcccacttatgagtgagaacatgcggtgccagactg

SEQ ID NO: 115988 - DNA, 483 bp, Homo sapiens
ttttttgaaacagttgatattgggtaatttggccatcatcatatactgtagaaaaaaattgtcaagtgaaagggagaataggtaagaaggaagaaaggggaggaatttagtgaatatgaattattttcctttagatatattagtcttgtagatcgcaatgaattttttaaattactatttaagatattgttgagattccattacctccaatcagtcttgggacattagaacagtggtataattaagactgtatgtttaaattgagaaattttgcacaactttaacaagtagcagaactaattgttcactgatggctttaaagatgaaataattctgtgaatacatgaaactgtgagggactcttcgtggttgtctaggtttatttatatgcatactcattaataaaagtttttttttgtttgtctcttgaaaacaaaacagctttgttttaacaaaacagcaatggaacaaatttgaaaaccg

SEQ ID NO: 115989 - DNA, 364 bp, Homo sapiens
ataacctaattaatgacagaaaatgtcaggggaaagcaactaggaatcagaggaaaggggatggtaataaaaacataaacttacacaaaaggctaaaatgtcaggaggaaaagaggcttgtgtatcaatattttgcctgtcaggaaggttttcttcccaatcaaaagaacttccttttacataattacttgagaaacgtgccctcctaaaatgctatttttttaaaaaaaaaaaaagggcaggcaaggtggctcacacctgtaatctcagcacattgggaggccaaggcaggagaactgcttgaggccaggagttcaagaccaatccgggcaacacagggagaccttgtctttataaaaatttt

SEQ ID NO: 115990 - DNA, 442 bp, Homo sapiens
ttcactcacaaatacttagtacctactgtatcccaggaattgttttggaaccaagagatagagcactgagtgaggaaaaaacaaaacaggtcatttctttgccttcatggaacttacattctagttagtagagagagaacagtgaacaaataatttgtcagttggtgataattggagaaaaatataacagagtagggtgataaggtgcaccaagggagggaaagggagagaatgccgttttatataccataggtcagggaagtgtctgaaaaatatttgaataaagacctgaagaaagttagggaggaagagagcaatgtttacatctggggtaagagtattccttgtggagggaactgtgtgtattccagcaagagtaaggaggtcagcttaaccagcacagttaaaccagggaggagaatgtatgggaaacagggtgaga

SEQ ID NO: 115991 - DNA, 596 bp, Homo sapiens
agcagttaatgaagccaaagaagcacatgaaaggatatttctgaatacaggattctggccttaaaatacactgagtgcaatctgaagccacttcaaagaatcaccttgttttcttgctgacattgcagtggggacgatgagacccaaggacattcagccaagagggaaatatctgctagaccaggtggatatctatcaagttctctttctttcctgcagagttaactagacatccgtgctcctggatctcaggacttcgggcttggactgaattacactacggattttcctggttctccagcttgaagacagcagattgtgggacttcttgacctccataattgtgatccaagggaggtcttacttctcaataggagacaagtgacttgatttcaacacggatgggagaaattgggaggtgaaattgggagaaacatggaaatactggggaagcatgaacatctggccttttctttttcttcctgtaagtccattggagatgcaagattttaaggagcaggaggatggggggggaaggacaccctcttgcatgttgcaggtgatgagattgaagttcctaaagtttaagtaatgaa

SEQ ID NO: 115992 - DNA, 473 bp, Homo sapiens
aggaagttgctggactcttgagtgaccacaaggtcagatctatcctggagcattttattgccctaaaatcacccttgagttgcaaaggtgagttgcattgggaggctccaggaggcggccagcactctgaaaagagccccaacacaggagacaggtggacctggattcacacctgggctcacaatcttgtcactctgagccaggagacaggtggacctgggttcacacccgggctcacaatcttgtcactctgagccaggagacaggtggacctgggttcacacccaggctcacaatcttgtcactctgagccaggagacaggtggacctgggttcacacctgggctgtctatcttgtcaccctgggcatgtcatctgtctcttagaggtttttcccttctctgatcttgggacagtttccgcccttaggatgggtgaggacacaggtggactctctggcccaggttctgctc

SEQ ID NO: 115993 - DNA, 362 bp, Homo sapiens
atggggagaaatggatggattcaagacacatttggaaagtataatcaataggtctcttggggagttgtggtgaggaggtaagggtgaggacagggtggaaatgacttccaggtctctggctttggtccttgggtgaataaatggtagtttctgagataggaaatgtgggaagagggacaggtttgcaggaggaggaggtgccatgctctttaaaacaaccagcaatccgtgaactaacagagagaactcactcactaacacaggggacaacatgaagcaattcatgagggatccttccccatgatccaaacatctctcattaggtcccacctccttcataattgaggatcacttggaggcca

SEQ ID NO: 115994 - DNA, 516 bp, Homo sapiens
cttgcatattgtgggggctcagtcaatatttgttgcatcgtaaatagtgggtttgtgagttttccatttctcaactacaactctctgaagattccaataggagggagaaacagggtagtcagagagataataaacaaaatcagccaacgttgataaattcagagtatggaggaccaggtaggatgtgtcatcatacctaagaacgctgcctctgcttaaaaattattgttagctctagaaacaatgacatatctatttgtgtagccctttgcagtaaacacatatacattaattcattagattcccctaaaagattctattaaaatggtgtttaactttttagtgctgataatgtaagatcttctttgtaggattgcctctattttgttgttgttgttgaaggccagggagggtccctcctaggctggctccagtttttcttctttccaccctttgatgataacgtgatcttcaggctggtgctggtttaccagaaattctaggggtggtacctgt

SEQ ID NO: 115995 - DNA, 243 bp, Homo sapiens
aaaaaacaaaaaacaaaacaaacccatgtccttacttgtaagtctctttcccacacttccagtcagcatgcgattgcaacagcataggtaagatggattctagtccctaaaattcaatactctcctgaaccttctcctacagacgagactctgcaattcagaggcctcttctcagtctgttcactaggtcattcagagtatgccactaatgtaggaagaaagtattttgattgacagcatcat

SEQ ID NO: 115996 - DNA, 2096 bp, Homo sapiens
  misc_feature (3)..(4): n is a, c, g, or t
  misc_feature (6)..(8): n is a, c, g, or t
  misc_feature (883)..(883): n is a, c, g, or t
ggnncnnngtccgaggcttcctcgctgccagctgagtcgtgggcacctgagggactacctaccactgctcccggctgtgccatcgccaccagctcccagcctcctgctcagacccgggacagcccctccatggcccccgagatggaccagttctacaggtccaccatggccatctacaagagcatcatggagcagtttaaccccgccctggagaacctggtgtacctgggcaacaactacctgcgtgccttccacgctctgtccgaggcggccgaggtctacttcagtgccatccagaagattggggagcgtgccctgcagagccccacctcacagattctgggggagatcttggtgcagatgtctgacacccagcggcacttgaactctgacctggaggtggtggtgcagacattccatggaggcctgctgcagcacatggagaagaacaccaagctggacatgcagttcatcaaagacagccgccagcactatgagctcgagtaccgccaccgagcggccaacctggagaagtgcatgtctgagctgtggcgcatggagcgcaagagagacaagaacgtgcgggagatgaaggagagtgtgaaccggctgcacgcacagatgcaggccttcgtgtctgagagtcagcgggcggctgaattggaagagaagcggcgctatcgcttcctagcagagaagcacctgctactttccaacaccttcctgcagttcttcggccgggcccgggggatgctccagaaccgcgtgctgctgtggaaggagcagtctgaggccagccgcagcccgtcgcgcgcccactcccccggcctgctgggccccgcgctggggccgccctacccctcgggccgcctgacgcccaccngcctggacatgcccccgaggcccctgggagagttcagctccccccgcagccggcacggctccggctcctacggcaccgagcccgacgcgaggcccgcgtcccagctagagccagaccgtcgctccctgccccgcacgccgtcggcctcctcgctctacagcggcagcgcccaaagctcgcgctccaactcctttggcgagcgcccgggcggcggcgggggcgccaggagagtccgcgccctggtctcccactcggagggcgccaaccacacgctgctgcgcttctccgctggggacgtggtggaggtgttggtgcccgaggcccagaacggctggctctacggcaagctggagggctcgtccgcgagcggttggttccccgaggcgtacgtgaaggctctggaggaggggcccgtgaatcccatgacccccgtgacccccatgacctccatgacctccatgtcccccatgacacccatgaaccccgggaacgagctgccttccaggtcctacccactccggggcagccacagcctcgatgacctcctggaccggccgggcaactccaccccaagccgggtgccaagccgtgcccccagccctgcacctccacccttgcccagcagccgccgcagcagcatgggcagcacagcagttgccactgacgtcaagaaactgatgtcctcagagcagtacccaccacaggagctcttcccgaggggcacaaatccttttgccactgtcaagcttcgtcccaccatcaccaatgaccgctcagcacccctcatccgctgaggcggggtccgaggtcgtaccccacagtgcacctgcccaggggctgttcagagctggcaatggcagcgacagcagcaacagcagcagatccaagaagcgggtccctgagacggggggtggctgccctccccagaccaccccggcagcctgagcagctccaaagcactggcttggggtccgagaccttcaaagtaaagcaggcggaatggggggacaggacaatttctccccctccaggggctccaggactctccctggggggcccacctcttgccccctaacctctttcccccttttctgcccccgtggggaggagccccttgtacctgctccgtgcccaacacatgccctctctgtacatcttttgtaaatgatgagaaataaaggaagtggacgcaaagtgatgcggcaaaaggact

SEQ ID NO: 115997 - DNA, 2076 bp, Homo sapiens
gtaggggcttaaatgtgctcacctctttgcggtcaggctccgtggaaatcctgaaagcacttaaactgggctgttttgacacttgacgtggaggaggatttggggagtttcatacagtgaggttgccagaaagtgcggaggacagcagggctggcagctagcagagggaatggacaggcaccactgtcctgcaggggaaaacggggcagatggggctggctggagccaggcagtgccccctcggggcttcatgggcagggtagtgtacggtgcccactcctgctgcaggagagaagcagcgcaggatgaatgcgtgcatgggcagagcgggtggtggctgcccacaccagcccacggatggatgagtggtcctgtgcttaatggatggtggacaggcgaatgggtggaccaggggatgtgcgtctgggtaggtggaggtctgtgtgtgcaagtggatggccttaaatggcggggggggggtcactgactgggtggttagggacatgggaggatgcgcagatgtggtggacagacactgatgggtgattggagaggtgtgagtggtgagggggtgctggatggattcgtggctacacgggggatggagtatagacaggtgagtgggggataggtgatgtatggagggactcatagttaggcgcgaaggtccatagctgggcgggtgaccacagggacaggaacggaagggggtcagtggggagagagatgactgagaacgccaacgatagggacacctgctgctggagtggctgcttcacagacccacagcagaggacggtgtgctgcagatgccttggggacctgaggatagaaccttctagatggaggctgtcacaccctcctgggatgttctgggaccatcgttccatccttgactcacatagcctgttagggaaaaggatagcgtgtgttattatcagtaggcacttgcaggtgaaaacagaagtaaacatacggaattgattgtagtctgtcaattcgaggtgaagtagcttccagtgaccctgaggggaggatgtcttcttttggtcattgtccccaggcctggcttcttttggtcattgtcctctgcctctaccccacaggagcggttggttccccgaggcgtacgtgaaggctctggaggaggtggcaaggtgcagtcttgagtgggcccagcccccttcagcccctggagaaccaccggccctgagcccctctctctgccctgaaggtcactgcgtccatccctctgcctcctctcaggacctccctccggtcaacagtctcctttcatgcaggtgcggggaggaagctgtcggatgcctcctgcctaaggtgccccagctactggcaggacaagggattggacaggccccaacccctttccttccccctcctttctctggacttaggtcctacccactccggggcagccacagcctcgatgacctcctggaccggccgggcaactccaccccaagccgggtgccaagccgtgcccccagccctgcacctccacccttgcccagcagccgccgcagcagcatgggcagcacagcagttgccactgacgtcaaggggcacaaatccttttgccactgtcaagcttcgtcccaccatcaccaatgaccgctcagcacccctcatccgctgaggcggggtccgaggtcgtaccccacagtgcacctgcccaggggctgttcagagctggcaatggcagcgacagcagcaacagcagcagatccaagaagcgggtccctgagacggggggtggctgccctccccagaccaccccggcagcctgagcagctccaaagcactggcttggggtccgagaccttcaaagtaaagcaggcggaatggggggacaggacaatttctccccctccaggggctccaggactctccctggggggcccacctcttgccccctaacctctttcccccttttctgcccccgtggggaggagccccttgtacctgctccgtgcccaacacatgccctctctgtacatcttttgtaaatgatgagaaataaaggaagtggacgcaaagtgatgcggcaaaaggact

SEQ ID NO: 115998 - DNA, 2138 bp, Homo sapiens
  misc_feature (3)..(4): n is a, c, g, or t
  misc_feature (6)..(8): n is a, c, g, or t
  misc_feature (883)..(883): n is a, c, g, or t
ggnncnnngtccgaggcttcctcgctgccagctgagtcgtgggcacctgagggactacctaccactgctcccggctgtgccatcgccaccagctcccagcctcctgctcagacccgggacagcccctccatggcccccgagatggaccagttctacaggtccaccatggccatctacaagagcatcatggagcagtttaaccccgccctggagaacctggtgtacctgggcaacaactacctgcgtgccttccacgctctgtccgaggcggccgaggtctacttcagtgccatccagaagattggggagcgtgccctgcagagccccacctcacagattctgggggagatcttggtgcagatgtctgacacccagcggcacttgaactctgacctggaggtggtggtgcagacattccatggaggcctgctgcagcacatggagaagaacaccaagctggacatgcagttcatcaaagacagccgccagcactatgagctcgagtaccgccaccgagcggccaacctggagaagtgcatgtctgagctgtggcgcatggagcgcaagagagacaagaacgtgcgggagatgaaggagagtgtgaaccggctgcacgcacagatgcaggccttcgtgtctgagagtcagcgggcggctgaattggaagagaagcggcgctatcgcttcctagcagagaagcacctgctactttccaacaccttcctgcagttcttcggccgggcccgggggatgctccagaaccgcgtgctgctgtggaaggagcagtctgaggccagccgcagcccgtcgcgcgcccactcccccggcctgctgggccccgcgctggggccgccctacccctcgggccgcctgacgcccaccngcctggacatgcccccgaggcccctgggagagttcagctccccccgcagccggcacggctccggctcctacggcaccgagcccgacgcgaggcccgcgtcccagctagagccagaccgtcgctccctgccccgcacgccgtcggcctcctcgctctacagcggcagcgcccaaagctcgcgctccaactcctttggcgagcgcccgggcggcggcgggggcgccaggagagtccgcgccctggtctcccactcggagggcgccaaccacacgctgctgcgcttctccgctggggacgtggtggaggtgttggtgcccgaggcccagaacggctggctctacggcaagctggagggctcgtccgcgagcggttggttccccgaggcgtacgtgaaggctctggaggaggggcccgtgaatcccatgacccccgtgacccccatgacctccatgacctccatgtcccccatgacacccatgaaccccgggaacgagctgccttccaggtcctacccactccggggcagccacagcctcgatgacctcctggaccggccgggcaactccatagcaccctcggagtactgggatggccagtcccgctcccgcaccccaagccgggtgccaagccgtgcccccagccctgcacctccacccttgcccagcagccgccgcagcagcatgggcagcacagcagttgccactgacgtcaagaaactgatgtcctcagagcagtacccaccacaggagctcttcccgaggggcacaaatccttttgccactgtcaagcttcgtcccaccatcaccaatgaccgctcagcacccctcatccgctgaggcggggtccgaggtcgtaccccacagtgcacctgcccaggggctgttcagagctggcaatggcagcgacagcagcaacagcagcagatccaagaagcgggtccctgagacggggggtggctgccctccccagaccaccccggcagcctgagcagctccaaagcactggcttggggtccgagaccttcaaagtaaagcaggcggaatggggggacaggacaatttctccccctccaggggctccaggactctccctggggggcccacctcttgccccctaacctctttcccccttttctgcccccgtggggaggagccccttgtacctgctccgtgcccaacacatgccctctctgtacatcttttgtaaatgatgagaaataaaggaagtggacgcaaagtgatgcggcaaaaggact

SEQ ID NO: 115999 - DNA, 2091 bp, Homo sapiens
  misc_feature (3)..(4): n is a, c, g, or t
  misc_feature (6)..(8): n is a, c, g, or t
  misc_feature (883)..(883): n is a, c, g, or t
ggnncnnngtccgaggcttcctcgctgccagctgagtcgtgggcacctgagggactacctaccactgctcccggctgtgccatcgccaccagctcccagcctcctgctcagacccgggacagcccctccatggcccccgagatggaccagttctacaggtccaccatggccatctacaagagcatcatggagcagtttaaccccgccctggagaacctggtgtacctgggcaacaactacctgcgtgccttccacgctctgtccgaggcggccgaggtctacttcagtgccatccagaagattggggagcgtgccctgcagagccccacctcacagattctgggggagatcttggtgcagatgtctgacacccagcggcacttgaactctgacctggaggtggtggtgcagacattccatggaggcctgctgcagcacatggagaagaacaccaagctggacatgcagttcatcaaagacagccgccagcactatgagctcgagtaccgccaccgagcggccaacctggagaagtgcatgtctgagctgtggcgcatggagcgcaagagagacaagaacgtgcgggagatgaaggagagtgtgaaccggctgcacgcacagatgcaggccttcgtgtctgagagtcagcgggcggctgaattggaagagaagcggcgctatcgcttcctagcagagaagcacctgctactttccaacaccttcctgcagttcttcggccgggcccgggggatgctccagaaccgcgtgctgctgtggaaggagcagtctgaggccagccgcagcccgtcgcgcgcccactcccccggcctgctgggccccgcgctggggccgccctacccctcgggccgcctgacgcccaccngcctggacatgcccccgaggcccctgggagagttcagctccccccgcagccggcacggctccggctcctacggcaccgagcccgacgcgaggcccgcgtcccagctagagccagaccgtcgctccctgccccgcacgccgtcggcctcctcgctctacagcggcagcgcccaaagctcgcgctccaactcctttggcgagcgcccgggcggcggcgggggcgccaggagagtccgcgccctggtctcccactcggagggcgccaaccacacgctgctgcgcttctccgctggggacgtggtggaggtgttggtgcccgaggcccagaacggctggctctacggcaagctggagggctcgtccgcgagcggttggttccccgaggcgtacgtgaaggctctggaggaggggcccgtgaatcccatgacccccgtgacccccatgacctccatgacctccatgtcccccatgacacccatgaaccccgggaacgagctgccttccaggtcctacccactccggggcagccacagcctcgatgacctcctggaccggccgggcaactccatagcaccctcggagtactgggatggccagtcccgctcccgcaccccaagccgggtgccaagccgtgcccccagccctgcacctccacccttgcccagcagccgccgcagcagcatgggcagcacagcagttgccactgacgtcaaggggcacaaatccttttgccactgtcaagcttcgtcccaccatcaccaatgaccgctcagcacccctcatccgctgaggcggggtccgaggtcgtaccccacagtgcacctgcccaggggctgttcagagctggcaatggcagcgacagcagcaacagcagcagatccaagaagcgggtccctgagacggggggtggctgccctccccagaccaccccggcagcctgagcagctccaaagcactggcttggggtccgagaccttcaaagtaaagcaggcggaatggggggacaggacaatttctccccctccaggggctccaggactctccctggggggcccacctcttgccccctaacctctttcccccttttctgcccccgtggggaggagccccttgtacctgctccgtgcccaacacatgccctctctgtacatcttttgtaaatgatgagaaataaaggaagtggacgcaaagtgatgcggcaaaaggact

SEQ ID NO: 116000 - DNA, 276 bp, Homo sapiens
tcagtgatttaggggaagcctgatccaggacatgtaatttgcagggtgtactgagctgggggtaaagcacagaaggggaggaggggagaaggggatgggtaggtaaaaagagagaaatagggataaaggagagagataactagatagaggtgattaaatataccaatatttattcttccagaaactttaagcaaatattcatttattgcatgagacatcagtggtcataggatagaagagtatataactgattctcaaggagatacagaaaaacca

SEQ ID NO: 116001 - DNA, 685 bp, Homo sapiens
caaccttcgagactcagccaaatgtcatttctgtaaaatcttccctgagtcttccaagcagtaatttgccttctcctagagtttacctgccattttgtgcacatttgagttacagtagcatgttattttacaattgtgactctcctgggagtctgggagccatataaagtggtcaatagtgtttgctgactgagagttgaatgacattttctctctgtcttggtattactgtagatttcgatcattctttggttacatttctgcatatttctgtacccatgactttatcactttcttctcccatgctttatctccatcaattatcttcattacttttaaattttccacctttgcttcctactttgtgagatctctccctttactgactataacatagaagaatagaagtgtattttatgtgtcttaaggacaatactttagattccttgttctaagtttttaaactgaatgaatggaatattatttctctccctaagcaaaattccacaaaacaattatttcttatgtttatgtagccttaaattgttttgtactgtaaacctcagcataaaaactttcttcatttctaatttcattcaacaaatattgattgaatacctggtattagcacaagaaaaatgtgctaataagccttatgagaatttggagctgaagaaagacatat

SEQ ID NO: 116002 - DNA, 184 bp, Homo sapiens
tagtgtttatattagcatgggtttattggcaatgaaatctttcactttcctttttctggaaatgtttttgtcttcatttttgaagaatattttcaccaggtgtagaattccagatcatcagttgtttgctttcagaactttacgtttgccatttgtttgtcattatgctttcttcattctgtgg

SEQ ID NO: 116003 - DNA, 103 bp, Homo sapiens
tggaaatcaatgctacttttatgcaaatgaatatatgtttgtcttaacaaacatatgcaaagcctattttgaaattcctagtagaggtctctgaattctgaat

SEQ ID NO: 116004 - DNA, 343 bp, Homo sapiens
cccagatggtccctattggtcgcttaactcaggacaccgggagtggaaggcaaccggtacgcgctgggtctcagccgctgcaaaaacccggcatcgcagggcaagagttgttccagcgtcctccgctgactccaaaccagcgggtcttgaccaagggattccaagagagaggattaggcccggctaagcacctgggagcagctgtggaaaaaggagagacaatcatcaggcacgatgccaaaaatgaactgtgacctgaaaaagagaagaaaggaaaattgtgcaggatgctacgttttgttttttaaaagtgggggttgaggcaataaaatacggaatattt

SEQ ID NO: 116005 - DNA, 900 bp, Homo sapiens
gggaagccctgggataaataaattttacagatttctttactacaggacttttcagagcctttaatagactaaatgttcattgtgacaaaataagaaagacgtaccagtttaaacgttcccagttttacttcatattccaaccatcccccaccgtaccctgttgccctgttaacagctccctaaactctttgccttgcagaaaactggggggtggtgggcagcctttgaaatgatcctagcagaaggtcttgggggccttgttcaaggaatggatacagagatgccgccattgacaaactgcatatattcggggctgatcaaaagccaggaacaaaaaggagaggaaatccaagacggctcccagagttgcattcctgggaggacagagaggtctagggaagtggaaaagcaggaggatatagttaggaggaagaacagtgaatccaggttcatctatgttgtttcaggtgttggggccatgtctaggtggcagtgtgctgcagacagtgggaaaagtggaatcttggctgcagaaagtaccagaatggaagcaatatgtgaggacagtgtttaaagaggagcagttgggccgggcgtggtggctcacgcctgtaatcccagcgctttgggaggccgaggcgggtggatcacctgaggtcaggagttcaagaccagcctgaccaacatggtgaaacctcgtctctactaaaaatacaaaattagccgggcgtggtggcacatgcctgtaatctcagctactcgggaggccgaggcaggagaatcacttgaacccgggacaagtggcatcacactccagcctgggcaacagagcaagactctgtctcaaaacaaacaaacaacaacaacaaaaaaattgggaggctgaggctggtggatcac

SEQ ID NO: 116006 - DNA, 456 bp, Homo sapiens
ataaagaaataaatatagtcaagataagctataatcttgtcactcaactaaaactatgaaacttttggtgtatagacttttattacttttatttttttgagacagagtctcggtctgtcacccaggctggagtgcagtggcaagatctcggctcattacaaaccctgcctctcaggttcaagctattctcatgcctcagcctcctgagtagctgggattacaggtttgtgccaccacacccagctaatttttgtattttttagtagagatggggtttcttcatgttggccaggctgtctcaaatgcctggcctcaaatgatctgcctgccccggcctcccaaagtgctaggattacaggcgtgagccaccgcacctggcctttgtatagatttttaaatgctagacttctttgatattattgagcatatattttatctaattatgacacctgtttt

SEQ ID NO: 116007 - DNA, 639 bp, Homo sapiens
caagtgggaccgtcatagaaagctctcctataggtattgagaaatcgagataccacgtaagtttcaagaagcagttttttttttctttttggtcaaaactaatgacaaattctgtccccttgtttgtatattttaacttagtgagacaggaaacatttattctatagaagacttttaaaatgtagtttaaacaagttgacacatgcttactggttaatgaaatgtgcatcaacccactccaaacaccactaatttgacatgaactaacaattaacttttcttactcactgtcaaaagtatatcattctgccttaacttaacgctttaccttctaaataaaatttaatcttttaaataagtttttctgctatgttttccttgcatatgtcttaaatttcttctttcgtctttgctcactgaagagcattttctcccacattctagtgactaccagggtttgtaagcctagagcaccatccttcattctatctagcagcagttgagaataataacagccatatttctatatatggagctcctccaaaggcctagcctgcattaagcttgttaattcttaccacagcctaggtattacttttgttttacaagtgagcaaactgaggctagaaaagaggaaat

SEQ ID NO: 116008 - DNA, 352 bp, Homo sapiens
ctacgtttcttttatattcctgttccaaaggcacaataacaccatcatcttcatctaggtaaccatagtactcaaaatcgattgccttcatgagctcagcacgtgtctttctgggaggaggaagagctataagaaacagaaatggagctgagtttccaagtcataatcacactccagcgaagctgtctcctgatgcaacgctatacacacacgtggcacgtatgttcatgaaaataccaggtgggcgtagtggctcactcctgtaatcccagcgctttgggaggccgaggtgggcagatcatgacatcaagcgtttgagaccggccgggagcagtgggatgttatcccagca

SEQ ID NO: 116009 - DNA, 467 bp, Homo sapiens
cggcacgagggctatcagaagggtcttaaaaaacaaaaaacagaagcacatcggccgtgctatttttctgcggcagggtctctgccagctcacctggctcacagtgtaagtccacagtccctagctgaggactgaggacgcattcacagcttcctcagacccatccccgctcctctgtgtccagtttgagcgctggtcttctggccaggtgtagagtgaggctgggcagaggggtgttgctgatgtctgcaccgccatgctcccagccacagtttccacctgggagcctggggatgggactgtctattgattgcacactgtggataggtggtcagttctaggagcagtggatgccttcgcttttacaaagtttcagttaagaaaaatgaataagtcctagagatctattgtacagtgtaggacctacaattaatacaactgtaatgtataattaaaattttgctaag

SEQ ID NO: 116010 - DNA, 594 bp, Homo sapiens
cggaccccggttgttttaccacttatttggaaaaactaattttattaaaagaatgggtcaagggtgtggcccatgcctgtagtcccagcactttgggaggccgaggcgggtggatcatctgaggtcaggagctcgagaccagcctgaccaacatggtgaaaccctgtctacgaaaaatacaaaattagccatgcgtggtggcgcatgcctgtaatcccagctactccggaggttgaggcaggagaatcgcttgaacctgggaggcggaggttgtggtgagtcgagatcgcgtcattgcactccagcttgggcaacaatagcgaaactccatctcaaaaaaaaaaaaaaaaaaaagatgcctgtccctggcgctcactgtctagtgcagaagacagacatgaaatatagatatgccaaattgggattcatgctatgaaggaaatcagaagagtgcaaggagaaagaaaaatgaatagaaggtctagcttaaattgaggaatcagggaacttctctccaaagaggagacatttcagctgaggcctgcaggagatgcaagtcttagggaggcagtgactgtgggcatagaacattct

SEQ ID NO: 116011 - DNA, 541 bp, Homo sapiens
gccagtgtgccacacaaacggtgatgggctctatcctgtacgcaaaggtgacagctgcctggtgttttgttttgtttcctttttaaaagatattcctgacaggaatgtggatattgggagaagaaaggcaggagacagggactcgatgcagtaatctaaaagaaaaaccagcacctgaagcaagacagcagtgaagctgagaagagactcaagagatactttaagagctatccttggtactaaaaatgggagaggaagggaggaggaggggaatgagaaggagaaggaggaagagaaggaagaggtctgccaaaactggcagtgattaggaacaacggtttggaggttccgcagttggaagtcctggattcagatgcaggctctgccatctagcagcttagctttggataagttatgttaccttcttcagctctctgaactttgatgtcctctattttaccgggaaaaataaaaatatctaccctcgcggttgttatgagaactgaatgtggtaattcttttaaagtacaaaccagtacct

SEQ ID NO: 116012 - DNA, 331 bp, Homo sapiens
tctcccaaactttaatcctgcagcttcagcccactgctagatatttccattgatgacctgtcatctgaaacctagcattcatcatgtgctgtgttgtataattgtatgtctgtgttattgtattactttcccaagtaaagtttttgtgtaaggacttaacactgctttgaatcccctgtacctattatactgctgtgtacaaagtaggagttcaaatacatgtgatcacaatagtcttcatgactaaagtagctcttcgcttttttggtaaccgcagaagcctagaaatcatccagagttaggatacagtatggagagctctatagaacca

SEQ ID NO: 116013 - DNA, 514 bp, Homo sapiens
tcaaaaaaaaagcagtcagtagtaactgcccttgaggagctgagagtctagtgagggagtcagattccatttcttaagacagatttattgaggtataattgacataaaataaactatttgtttatacaattatgtaagtttggacgtatgactacacccatgaagctatgttttgtttaagttttcattgttttttgttttaattgagttttgaaagctttatatattttggatataaatcctttatcagatatttctagcatgtcttttcattctcttcacagtgacttttgaagcacagaagttttaagttttgaagtaagcttattaatgtgttgttttctttcttcctgttttggttgctatagctttataataagtcttaaaatcaggtagtatgggtccttcaacttttttctccttcagagtcattttgccaagttttagaatcagtatttcaatgtttaccaaaacagcttgctgaattttgagaatgctttgaatctgtagatct

SEQ ID NO: 116014 - DNA, 519 bp, Homo sapiens
  misc_feature (18)..(18): n is a, c, g, or t
  misc_feature (21)..(21): n is a, c, g, or t
tacggtgggggggacggngtntcgctctgtcacccaggtggagaaaaaaataaaaattaaaaattaaaataaaggatatatgcatacaattggcatgctaacaaaaaaaaatggtgaggtagggatacaactgttgaagccaggtccttgaatggatgagtggatgggatctaatacacctaaagataatttccaactacagcaaagaccacaatctatatgacttagcagttgccttttcgcgttatgcatatgtggaggaacagacttcaagcaggcttgaggcctcctaggaagatgagattcctgagaagttgatcatcaattcacccaatcttgccattcatactgaggaccgtcctgaggctgtgggcagtttctcacatccctggaacaggcaatgtcaccagtaaaatagggaggaatcaagaggacctcaggacccatataaccacaagaatggctagacctgatgggatccagatgcaatcagcatatcactggcaacagggcagcttt

SEQ ID NO: 116015 - DNA, 259 bp, Homo sapiens
ccactaggccacggcgtatgcctccgaggacggggtcctgaccgaggccatgatggacacccgcgtgcaagatgctgtccagcagcaccagcagatgatgcgctggctgaagagggggaggcctgggcccgaggacgagcaaccctcatcctgagtccatggggagaccacacctcacggagcctggccgcggacccctcccacccctgcctttgcggccccgcacatttaggaaatactccccgtaataaagtcccac

SEQ ID NO: 116016 - DNA, 711 bp, Homo sapiens
tcagttaggatgtctccagatacaaaccttgagaaatgtagtatgcacatatatacatgtaaatgtctttctttgttcttattcatttgtttagcacatgtttattgaatgcctactatgtgccagacactgatttaggcattagtggcaatgtagcaaacacaacaaagttcttcctttcatggactttacattaagaggaaatcactaaaatattgatagtaatagtcactcatggctctaagtgctttacaaatattaactcatttaatctttataatgatcttacagagtaacattattctcagttttgcaaatggggaaactgttataccagagtttaagtaacttgaccaaggttgtccagcttatgtgccagagccaaactcgtgtgactggccagtgtgaatgactagatgagctctcaccagattctttgaaatagtgtttttggggaggaactcatagagaaaagagttagtgaatggtcacctattgcagttttgaacagtaggcaggagtctcttcagcagggctaggtatcagtctccaaaagatagactaacttttgggctgtgaaacttttaagtagcatgcttagggaatattgttttgagtttttaagcatgcataatgagagtttctatctagctgcaatatgatatagcagaactctggcttccagacaaggtagagccgaggggtaccgag

SEQ ID NO: 116017 - DNA, 227 bp, Homo sapiens
tcggctctacctgtcgtggtttcgctggatagtaggtaggatacagtagggctaggtatcagtctccaaaagatagactaacttttgggctgtgaaacttttaagtagcatgcttagggaatattgttttgagtttttaagcatgcataatgagagtttctatctagctgcaatatgatatagcagaactctggcttccagacaaggtagagccgaggggtaccgag

SEQ ID NO: 116018 - DNA, 635 bp, Homo sapiens
tttaaggagtaacaatgcatcgaacgtgggtttttgcatgtttgcttgtctcatggagacagcttgttaccaactatatttggtaacaagcactactgttgactcatgatttccttaatgccttagtatctatcatgtatatgtttactttgacatcagggcatggaaagttctattcaacaattcctgggtctaatttcagtagttccattctctgtgacctcacaatgggagccagcagccttccatcttgtgatggtgacttgctcttctaggtggagtgggaggagcaccgactatgtgctgggacagggctggcttcaaggtctgcttcagccccttgctggctgcatgactctggcaaatcacttactggcatttgttgtaatgcacatactggcattcattgtagaatttctattctggtggtgatagtcaattggttctttatgcaaacggaggtgatatcaacactgaaaattctgagtgaattgttaaactctggtgaattgctctgtgagtggttaggcaaaattgaagaggactgctctgctggacaggcccaatttattaggccccgctctaaatatgacttttatccccatactttttaaataattagcttttgaactatt

SEQ ID NO: 116019 - DNA, 540 bp, Homo sapiens
acctaggaactcttaacctggtgtctgataactggtataaggcataacgatggggctcatggatacataatcctttcaaaattgtaggcaaaattttccatgttgagtgcatatgtacatttttgctgggaaagcatccattactctcagagcagttctatgattccaataaaggtctagacccatatgttgggagttaaagagatcagagaccagttaggtggctgtcactgtaatcaaggaaataaatgaccagggcctaaacaaacaaaaacaaacaaaaaaaaataaggacagaaaaagaacataagaacataggaagcacattttggagaagagagagttggaaagaagcaggtaagaaatactggctttgacaggctgatttgaaattctttgagatctgccattgcaataggcagtgggcccttgtttatatccctctgcagtcttttagaaacagctggactgggacaacatggtttggattttggagaatacacatagcaaatgaaaccatgaagttcggcatgcaaaaat

SEQ ID NO: 116020 - DNA, 187 bp, Homo sapiens
aattcttgaggaacaggaggagggcttttataccaaaaaatggattgttctggaaggcttttctttgtcactgcccggtcgccgtgactgtggaccatgggaccctttcagccccgaggcctttcggcaagccttcctgagtggcctctgcatcattgcttgctgagcggatggtactgcacggttg

SEQ ID NO: 116021 - DNA, 624 bp, Homo sapiens
ggcattccacaggaaaacacccatagtccaggggttttaaaggcatttctaactataaacatcttagaaagttaaatacctacatgcatcccacatatatgtgtctgttgaaaactggcgaaggcaagtgttaatatcctcacatacagttaaaagtgtaattttatacaccagagccagattctgggccccatcccagctgaagttgttaagtgagaaatctctgagctgcaaactgcccttctgttttttattcctagaaacagaggttagatcagggaaaaggaaaagttaaggcattctatttcgcttgttgtgctatcaaatagacaccacaaacatttgaccatcgtggtcaggagatgttttccaagtcttttcacttggttttaggtttctcaagatattgtcttacattgagtaatttttcttaaatgctatgttgcaagtaagaaatcttaaagaaaaattttctcttagtatttttagtagagtaaatctggaatgatttttaaacagatttgagtctagtgcttctaaatcacacccgttacaatgtgcttatgcagtaaacaaacagtagagaaaagtgctgcagagtcgcttctgttacatagggtaaga

SEQ ID NO: 116022 - DNA, 249 bp, Homo sapiens
gtgctgaggaggaaccccggacgccaccatttcacatgaagaggcaggcgacatgcgagtgctggagaggaaccccggacgccaccatttcacatggaagaggcaggcgacatgcgagtgctggagaggaaccccggacgccaccatttcacatggaagaggcaggcgacatgcgagtgctgaggaggaaccctggacgccaccatttcacatggaagaggcaggcgacatgcgagtgctgaggaggaa

SEQ ID NO: 116023 - DNA, 781 bp, Homo sapiens
taactcaaggtggattaaagattttaatgtaagacctaaaaccataaaaaccataaaagaaaacctattcaaaaccattcaggacataggaatgggcaaagacttcgtgactataacaccaaaagcaatggcaacaaaagccaaaattgacaaatgggatctaattacactgaagagcttctgcagagcaaaagaaactgtcatcagagtgaacaggcagcctacagaatgcgagaaaatttttgcaatctatccatctggcaaaaggctaatatccagaatctacaaagaacttaaacaaatttacaagaaaaaaacaaccccatcaaaaagtgggcaaacttctcaaatgaagacatttacacagccactttatgcagacacttctactgttcagatctctgtaaacatccttgtcagcagagatagcaacagaaagatagtctctgcctcacttctgcctacacatttcaaacacatccaattagtagaaatgtaatatcatctagaaccttagctgaaagaagtatgttttagttttccagtatctgcagtatagaagggcatataggaggaagtgcaaatcctgtaatcccagcactttggtactgagtaccaagtgaccaaatcctgcacactgtgtatctctacccttttttcccagatataggtaccacaaaatgtcactgaatatggtttcactaaatatggtttaagaagcattatggtagaagggaggaagctattagagtctttcaagtagataatgtgaactttcttg

SEQ ID NO: 116024 - DNA, 384 bp, Homo sapiens
aaatatgtgaagaaatggccttttcttctaatgcagcaagtttgctactttgtaccaaataatttttttgcttggttttgagataactttatgattttattttgaaacaagcaataaattttagtaggggaaatgtgtacattcttattaaacaactttttactggttttatgtaactattctagttattagaactgaaattccaagggcttagggataggttggaaaataagtttcattttatgctagtttattttaggaagctactaggcaaatagccacttatcacttaatatcaaaataattttttttttaagacagagtctcactctgtcacttaaactggagtgcaatggcacaatcatggttcattacagtctttac

SEQ ID NO: 116025 - DNA, 567 bp, Homo sapiens
gcctgtccctgccttaagtgcctactggatcccgggagcctgggctggggcctgggcactgcttcctccttggcccctcaggcccttggaagcagagagagaacctcttgcagatcccaggctcgtccccagcacagcagacaccaggaaggtggccagagcctcactgagccgaaccgacggccgcccacccacccaggctggagccatggataaattccgcatgctcttccagcacttccagtcaagctcggagtcggtgatgaatggcatctgcctgctgctggctgcggtcaccgtcaagctgtactcctcctttgacttcaactgtccctgcctggtgcactacaatgcactctacggcctgggcctgctgctgacgcccccgctcgccctgtttctctgcggcctcctcgccaaccggcagtctgtggtgatggtcgaggagtggcgccggcccgcagggcaccggaggaaggacccaggcatcatcaggtacatgtgctcctctgtgctgcagagggcgctggccgcccccctggtctggatcctgctggccctccttga

SEQ ID NO: 116026 - DNA, 313 bp, Homo sapiens
ttggcccctgcgtgatactattctgacccattcttcaaggtacagcttcaatctgaacctttgtaataccatcctggctcagttttcaccccttggagttcacagccttgtactgcccatttgaaaatcacccatgtactgacggcctcctaacgtctctaggcttatgttcctgattatttttgcttgctgcacaatatctttcatcttctcaaatagattctgaatctctgaagcacaggaaccatttgcaacacttgtaaaaatgaaagtaattcaataaatatttattacatgaaacattaaatgagct

SEQ ID NO: 116027 - DNA, 408 bp, Homo sapiens
tggttacatgaggcaggtgtgagggacccgagcactcctgaggagggaagaacactcctcttggccatgagtgtccatcccaaagctgccctgcagcctagcccagtgcagattgaatcagaaagccaaagccccttccacccgcttctctcaggcaagctgcctgcaagagagaaaagtgtattagtgcaggagcttgtgtctgctgaggatggcacctggccctctcctctcaccacgtccgggtcctcctgaggaccggtcccctgtccccggtccccagccagctcagcctgaccaggcttttagaggctccgcaccccagcatcggccagtgctgacccttgtacggctgtttgggtccccgatcactctcataacagccctgcccttgtcctataccctcta

SEQ ID NO: 116028 - DNA, 928 bp, Homo sapiens
aagaataaaactggattcctatatctcaccatatataaaaattaactcaagattgattaaatactcaaatgtaaaaacctataaaattcctagaagaaaacctaggaaaactttactgaatatcagccttgacaaagaatttatgactaagtcatcagaagcaaatgaaacaaaaataataataggcaaatgggacctaagtaaactaaaaatcttctgcacagcaaaggaaataatcaacagagtaaacaggcaacctacagaacaggagaaaatattcacaaattatgtatctaacgaagtactaatatccagaatctacatggaacccaataaataaataaataaacacattatgtcattacaaagtaggcaaatgacataaacagacatttatcaaaagaagacatgcaggttgccaacaaacattaaaaaatactcaagatcactgatgatcatagaaatgtaaatcaatattgaagtgtgtattagtctgttctcatgctgctatgaagaaatacccgagactgggtaatttataaggaaaagaactttaatggactaacagttccatacggctggggaacattcaggaaacttacaatcatggtggaaggggaagcaatcaagtccttcttcacatggcagcaggaaggagaagaatgagagccgagcaaatgtggaatccccttataaaaccatcagatcttgtgagactcactcactatcacaagaacagcatggagggtaaccgccctcatgattcaattacctcccaccaggtgcctcccatgacacatggggattatgagaactaaaattcaaaatgagatctgggtggggacacagccaaaccacatcaaaaagtgattcatttgacatggtcttccctatcttctctcatttagggtaacattatttccttgaa

SEQ ID NO: 116029 - DNA, 374 bp, Homo sapiens
cttcatatagtttgacaccatgagcaagatacttagaaatggatctgaattcagtcctagcttggccacttcctagctgtgtggctttgggcaaattacttaatctccattttctcattggtaaacttgaagtaaataccacttccgtatggaattgttgggactatccaataagataaagtacgtgaaggccttttgtagactctaaagagacagacgaacaggaagagagtcaacattgatagggtctacaattgcagcaggcagctgtgaaagggactgttttctctagctacatgtgaacttgaaaatttcaggtagatggtgcctaaggaagggtgaggtggaagcaaggaaaagttcaggggtgcttg

SEQ ID NO: 116030 - DNA, 238 bp, Homo sapiens
cctcagatcaggcctggaggaaagacttctcatgtggcggctaagtctcctagaggagactccatagacattgtcatctaatgacaatctgtagtgccatgagtttggactctcatttttactattatgttgaaatggcaacatgttttactgttatgaatccttaaagacagtttctttattaatttcagtcacctggaaggaatcggtctttagagagaggtaaggtaacatcatt

SEQ ID NO: 116031 - DNA, 579 bp, Homo sapiens
  misc_feature (207)..(207): n is a, c, g, or t
  misc_feature (245)..(245): n is a, c, g, or t
  misc_feature (378)..(378): n is a, c, g, or t
  misc_feature (385)..(385): n is a, c, g, or t
  misc_feature (390)..(390): n is a, c, g, or t
  misc_feature (434)..(434): n is a, c, g, or t
agcgggctgcgtccgcgccttctcttttccggtcctctccgccggccggggctcggctgagctccagatttccccacccgcggccgccgccaggggacaggagccgaggcgcggcagggcaccagcggcgggaggcaaggttggggaggcgagggcggtccgcgtgcgggggcgggagggggctgggggattcgagggacgcggcanccccgcccccgccccctcctcttctccgctccaagccngagaagctggggagcatggaccagaccccgcagcgctggcaccatgacgctcgcccgcttcgtgctagccctgatgttaggggcgctccccgaagtggtcggctttgattctgtcctcaatgattccctccancacagcnaccgncattcgccccctgcgggtccgcactacccctattaccttcccanccagcagcggcccccgaacgacgcgtccgccgccgcctctcccgcgcttcccgcgccccccgcgggcgctcctgaccagcgcccgcacgccctccaggccgggcacacgccccggcgacccctggggctgcccgcgggagccatg

SEQ ID NO: 116032 - DNA, 542 bp, Homo sapiens
tatgatcttggctcactgcaacctctgccaccctggttcatgcagctctgcctcagccttccgagtagctgggactacaggcgtcgccatcatgcccggctaatttttgtatttttagtagaaacggggtttcaccatgttggccagactggtctcgaactcctgacccctggtgatctgcccaccttggcctcccaaagtgctggaattataggcatgagccaccatacctgggccaagatatttcttttaaagctaaatgacatgtaatgttttgctttctctgaggatctggtatattttgtcttcttgattaataagaactaagaactaactatctacattatttatgtggtcatttcccacccattttctaatccagaaaggatttaaggcccaagggtttgcaacctaatagaccatgtctcccctttcactttgcacaccaggaaattaaaagccaagtgtgtatcatttatatatatatgtggtctatatatctgcacttttttaaagagatgaggtcccttaaattccaaagg

SEQ ID NO: 116033 - DNA, 842 bp, Homo sapiens
tgcgccggccaggtgagtgggcggcctcaccgggaaccgctcgcagcttttgggttgcttcatcgaaaaagtagttcttgtatggtgctgggaataccggtgtcctggctggggctcggtgctgacaggaacgggacggtgctctggctaattacttatggaagtcggccttgcgcttgcggaggggtgtcggcaccgtcactttggttctggcagtggcgggggtgtggtgctgctagttgtgttcctccgcaccgaatttatgagtgtgcccctggagcccctgccgcggacaaaatcggcaccataactttgggatagggaggctagaaggaggcgggtgttactagtagtgttcctccgccctggacgtgtgcgtgtgcgcttgtgcggccgcggggtgggctcacctgccgcctgttaatgctcctagcgcttggcccctcccgggccgcagtactcctcgtgtgacacggacatcattaagccagctgagaatcgtgcggttacagctgctgcagtttctttgcagagtaagaggctctttttgaagtttccctgatggtgaggctttacccctggaagtgtcttaggaagaagaccactgttaaagatgtcctattctagcttgacagccctgtggggaagactaatccctttctagaagcactgggttctctggactttgcacactccaggagaagaacccagaaaattgatcagttctaaaaaaagcatgcccatttgttggtgacttccagggattggtgggccttggacttcttctcagaaggaatgggattgcctggacctggtcagaggggctttgtacggggtgtgca

SEQ ID NO: 116034 - DNA, 223 bp, Homo sapiens
ctttgcttatgtcattaggcaaggctggcacttcacatatttttatgtagatggttctcccaaggtctgctagaacttcagccactttccatgacacccatttgactgttgaaaagttagggctcacagattttcagattgctgtgagaatgtcaatgcagaattcacagggacagcctttctatttgaaaatttaaattgcaaggaaattttttaaaggaag

SEQ ID NO: 116035 - DNA, 491 bp, Homo sapiens
gtaaaacggggaggaaatggataccagagaaaggaggtaatgagccacctatggcaacactgacagaaggcagataggggagggggatgctgcttacacccccagggttcagcccgggtccttctgatttccttaggaaaagtaggcttactctccctaaggacattcctgtgcccacccgaccctgcttttgcaggctgatcctgaactccctaaaccagaaattgatgaaaagtaaagagtgaagaagaaaaaagtgaaggaagaaaaactccaaaagtacacaaagaatcagggtgagcaatgaggttgagagtgaactgaaatgcaggatatcccaggtggaaaggtggctgcccaaatggcctcttgtgccttcgtacaagaagagtcacctaccagagaaaagcatcagacccttaggccagggtttgtactgggtccacacagaggccagtggagccaagagactgcgctgctccacactgccc

SEQ ID NO: 116036 - DNA, 786 bp, Homo sapiens
ctggagttcgctcctcattgcccaggctggagtgcagtggtgagatctcagctcaccacaacttccgtctcccagggtgtcaagtgattctcctgcttcagccttccgaagtagctaaacttacacattgtatgccaccatactcggctaatttttgtatttgtagtagaaacaggatttcaccatgttggccaggctggtctcgaactcctgacctcaagtgatctgcccaccttggcctcccaaagtgctgggattacaggcatgggccaccgtgcccagcctattacatgttttaaggtcataaaactgctacttctggaatatttcttaaacttgcttgatttgtctaaattgagctaaagctgtaaggtctggctgctgggctccctgaaaccttgcacatatcttactgtatgactgtatttcgttttgagtctctggattctggggtttggacagatgaccatagtgaggcctgcagaaatatgcatgtcctcagtgtttggactgccagctgcaaggcagagccaaacccaatatggccccatcatccctggctcagctgtgctacctggccatgctggaaggggtttgatcttccaggaatttgcttcacagctctttcctgtcccaagatctatgcctgatgtgtaaattcaggacccaaaagggcacaaaaaagcaataactactaaatataaggaaaacaactctgtatacagcatgtataaagaaaagcaagatatatttggggagataaaagttgtaaaggcattaagatgt

SEQ ID NO: 116037 - DNA, 745 bp, Homo sapiens
ttccgaggtcgctcagcacagcgcttccaaagttatttacctggtagcgagtgtcagacttccttcatttttctggctgaatcctattcccatgggtggatggaccgcattttgtcctccattcatctgctgggggcaactgtgctgtttccacctttcagccattgtgagtaacgctggtctctggagtgacagggatggccctgccccactgacccaggcgttcaccccagagaagcgtgcaggcaggtacaagaggccgagtgcggtcaacttgaagggacaggaagcctgcaggcagtgaccactctctaggctgtgctcagaggagaggccaaggggacacaggcaccagggccgtgggacacacctgggctaccccagctcctatcaggacttgatgtggcgtatggagcactgaccgtccatgtggcaggactcagaggacgcgggcaacacagtgcccaggacagagaggccacagaggagcaaacgggcaggccgaggacagtcaagaccaagggaaacggctaattaattaggctcagcctcttgaaaggcacttaaaatactaacgacttgctaaaaaagggcaggacttgaaagcaaagccaaggtccaaagtgcccaccagcgtgaggggtctgctgcctccctgcggggaagccctggcagagccccttgctttgctgctcacagagtccaggacatgagagccgagcccatgcaccagtgactcacgccc

SEQ ID NO: 116038 - DNA, 341 bp, Homo sapiens
cacctaggaaggcatactatcatgagatggtggtagcactctccaggagttcgtgcttacagcagagtccacacaagtcattaggcaaaccacctgctacccaagttcaaagctatgctttccagatttgagctgtgtgattttagggaagtttaaataaaataataaacataaaacatccagggcctgacataaattcagcatgtaataaatattagctactttttatcttgtttaatttcaactgattttttttttttttaagacagaatctcattctgtcacccaggctggagtgcagtgggacaatcagagctcactgcaatgtcagtctcctggga

SEQ ID NO: 116039 - DNA, 333 bp, Homo sapiens
cggggcggttgccgttggggccgagcagcgcagaggttctaggcgggtgggcgtccagggtccgaggttgggagactgagggggtccccctaactcgccagtgggagaggggcgggaaggctgggggcgcttcgaagcgtcgggtccgaatcccgcgactaagcctcctcctttatccccgcgctcgcccctgagcctaggacttgcgccctctttcctgccactccccccgtgcgcccggtgtcccagccccggcgcccgccccatagcccccttctcccagagctggcgccgtctcacgcccgctgcgaacccccggctctgtctccaagc

SEQ ID NO: 116040 - DNA, 258 bp, Homo sapiens
cctggccaggtgctctgaggagctcagtttcaggatgagggcctggccagaagtggtactgagttgctgtgtccctctggggtctgggcccccatgatgtctcttgacaggtgttcctgtccccattccctcagcctggccctcttagcaaagtcctggtgctgctggtctgcatgagccccctgatttagccttgcactttaccatggtggccatggatgagtcttcccacctcttgccctatttcctcactagtag

SEQ ID NO: 116041 - DNA, 448 bp, Homo sapiens
gtttttttttttttaaattgagcgggtctctcatggcactggttttctaagttactctgggaggtgaggcatctgcctgtaggatattgggtagggtgatattggtcaagatttgattcatactggagcaaatgttgaattcaaaacagtaaaaatgaagagcaggtgtggtggctcatgcctgtaatcccaggactttgggaggttgaggcaggaggattgctttgagcccaggaatttgagaccagcctgggcaacatggtgaaaccctgtctctacaaaaaaatacaaaaattagctgggcacagtggcacttatacctgtagtcccaagttcctcagcaggctgaggtgggaggattgtttgagtctgggaggcagaggctatagtgagccatgatcgtaccaccgctctccagcccgggcgacaaagcaagaccgtgtctcaa

SEQ ID NO: 116042 - DNA, 647 bp, Homo sapiens
acctttgcagggcagcctggggctggggctgtggccacctgtgtcctcggaccccaggtgagtgggtgaccaggccccttgttccagggccacgccatctcctgcctgagactcctccagggtgggaggaggccccggccggagctggcgcttcctgaccgtggccgtcgggctcccaggacagtcccagacctgcaggcggggccctggtcagtgtctcctgagggtggcccggtttcacccagtgaagacccagaacctttgagcgtgcagcattgcgcccggtcccgaggcaccagctccctcagcttcccgagctaacgggtcctgcgagtggagacgtcacaaagccctgcatagggctgcattcagaaaggccccggtgttcagcagggcacggtggctcacgcctgtcattccagcactttgggtggccgaggcaggcagatcacctgaggtcaggagttcgagaccagcctgggaaacatggtgaaaccccatctctactaaaacacaaaaatcagccgggcatggtaggcgcctgtagtcccagctattcgggaggctgaggcaggaaaattgcttgaacctgggaggcggagatcacaccattgcactccagcctgggcgacaagagcgaaactctg

SEQ ID NO: 116043 - DNA, 493 bp, Homo sapiens
tttctccagggtttatacgtggaagaaaagatctatgaccaaacaaaaacatcatggggtgtcctagacctgcatgaagatggtttggaagagcttcaaaatgctaagatagacctaaggactttttcagaactactaacagagaatggaagccgcaagctgacaaatgtcagctcagtacagtaaagaaccttcttagagcactgtccaaagatgaattggactgcatcatgagatggtgagttcctcttgctggaagtatgcaagcagagaccagagagaggtgtagttgtataaaaggccttaagccatagaccatgtggttatactaatgtaccagattggtgcaattctggaaggaaacatgccagtgaaccaaacagaatattccaagaaaaagttcgcaggttttaggagcactataaataaataattgccgaatccaaattaacacttcctttctcttaaatggcctgtaacattttcagtcatt

SEQ ID NO: 116044 - DNA, 492 bp, Homo sapiens
tataagtaaaaaccaaataaataaaaaaccttttcattccttcctttctttcctcctctcaaaaatatgtcattcatgcaagatgagggcatagtaaaaatataaataaacaaaagaaagaaatatgtcttgactctatccactccatctccagtcagctctaacccagccatttttcatggagactaatgcaatactctacccctataatcaacttcttctaccctcaaccctttacaatctttccctcagcagccagagtgctattttgaaaagcgtctataagattgtgtatctcccctatttaaaaatctttgatagcatcccattccacgtagaatcaaaaccaaacttaatacaaggcctaagaaatcctacattatccaggctttgcctccttttctagtttctgcttaacaaccatgcgcctcttggtcaccaagtctgttggcctctttttagtttttaaaacacataaaacatgttcacact

SEQ ID NO: 116045 - DNA, 676 bp, Homo sapiens
gataattggaatggcaggaaagaatcttatgccctgatattaaaatcaagctactatttttatcttctaggtagctactgggaataatttcacaagttgtttcaaagataaaataagctaacagatacagaagcactttgcaaaactacacttttgacttacctttttatgggctctgtttagtttctttcccttgttattcagatagtttctataaagtttattgtagaaattgtaaagtttttatcatttaggttacattaagttatttgggcttgcatttgtctgcttgatttcatttttgtttccattctttccatcttttgtttctgtagtcgctaacttatttgttaacatcagccaaaaaagaaattgaactaatgtcagaagagctgaggggtctgaaatcagagaagcagcttctttctcaggagggaaatgatttaaagttagaaaacggttcacttttatccaagcttgtagaattggaggccaaaatagctttacttcagggagaccagcagaaactgtggtcagtgaatgaaactcttaatttagaaaaggagaaattcttagaagaaaagcaagatgccgaaaagtattatgagcaggaacatctcaataaagaagctttggctgttgagagagagaaattgcttaaagaaatcaatgttgt

SEQ ID NO: 116046 - DNA, 222 bp, Homo sapiens
cgattgaaagttccagaactgcgttaaaattgtagttctaacatttactagcttatcttaggtaagtagcctctctggttatacccagtagaactaacacaatgccttgtgcattgtaggtgttcaatgtgtatatatctagttgaactcacttatttttatttttattttttgcatagcctattctcatacattgactaatatgccttttttttttttttt

SEQ ID NO: 116047 - DNA, 644 bp, Homo sapiens
ggctgagggaaaacccaacggctggtccctgcatccgctaggaccagcgccatccaaaggcttgttccatcacatggcactcaaatttacagatttttcagaagggcaattaaatgtcacctttgatggagaagtggcaagaacatattgtcaaaaagcaaatggaatggggaagtttttgtgacgatctttggaaaatacaattcgcgacagcctgtgaaaccttgactagatttgcttccttggtcaatcttccagtcttttagaaaacagaaaactgcatgtgccaacatgcaccccacccctatgctcccagcaacatgtatacaggaggtgagtttccactggagcaggcaagtcactcctttcccaggatcacttgggaaaacagcgtgcacagaaacccaacaaagaaccctctgcgacccacataggcagaacagctagtcaagcccctgtgatatcggatggcttacttcactcgtctgtgcctccactctctcttccatcaaatgggggtaaggtactgacagcgtagtgataaaaaattacaaaaagttgctttgaaaagtgtctgacaattggtaaatatacaaggcattttaataagaccctaaatatcatcagtgccttacattctgatg

SEQ ID NO: 116048 - DNA, 873 bp, Homo sapiens
gaagcattgagacagggggaggtttcaggtaagagttacgggaacgtacaggagcaaagactggccttcttgggaaatgtccaaggctttaggcagattttaattggaacaggagcaattcctttttctgccgtgataagtatcgtacgtttctttttgtctggcagcaacttccatagtaccatcagatactctctactatctactaatttaatctgtcatactctgtgccaccatacgttgctgcttatatttagaatcagctgtctccaaatcccaggcatatttcaagccctactaagccagagaatgtgtgttatgaccccgttgttatataaaacacatacacacatatattttaagaacccaccctgaaaaatatggcctttgcttaaaaaaataggaaaagaagacagtttacactgctgtgtagcaaagaccatattttctcgtatttaggaacaaagacatgtcaggctttattgagcacatcactaactatataactagcgttaaacactctatttgcaactgttgctgtgtattttgtgtgtgattatcacccctagatctgcatcctataaaaagatatttctgtttgcttaattataaagctctttatgaacaggctcatctgtaaatagcttggtgcagctgaaatagaaatataattataatgaaggcagatgtttgtgagatactggctcatgaaacttgttcagaatctacaaaggagaaacgttgtgagcctgtgtttactggtgggccaaagctgggagcaaggagtgtttacttccatacttattttagagtcctcttatttcctctccacctttgccttcctaggtctctgtaatttggaataggcgtggc

SEQ ID NO: 116049 - DNA, 476 bp, Homo sapiens
acattccttctcctggctcagaacctccccaactgagcaccttggacccctcggccctgcccgtaagagaaaaaccccctttgactgtaattttccactacctgcccaaatcctataaaatggccccacccctatctcccttcgctgactcttcggactcaacctgcctgcacccaggtgattaaaaagctttattgctcacacaaagcctgtttggtggtcttttcacacggatgcgcatgaaaattaccaaagttcgcacagcaaccagaagaaaggtggagcaggaaagtctgtttatacaaagagctgaaagtttcaaccttaggccacaaaagttgacatggatcggaaggaacttttataagaagctctaaacagttaatttgataactaaaactcttaagacaatcttccaatacaaacatgagtattcaatcacaaagattaacatgaaattcaaaagggagttttga

SEQ ID NO: 116050 - DNA, 439 bp, Homo sapiens
tcctattctctcctctatcacatgttaaatacatgttaaagatacatgttaaaaaactgtttgttaaccaaataactacagcccttttaagtaaagaaatatacagatttagacacattacatacacagaagtacatctggttttgttgcaggatatacctgcatctcaggattttaaaatctgcaatacatcaaccagttttaattctttttacagaaataaatggaggtgacctaactagtagcatatttaaaatgctgtttaagagtcaggtgcagtggtacacacctgtagtctcaactgtttgggaggctgagatgggaggattgcctgagccaggagttagaagctatggtgtgctatgatagagtctgtgaatagccactgcactccagcctgggcaacacagtgagaccctgcctctaaaaaaagtactat

SEQ ID NO: 116051 - DNA, 376 bp, Homo sapiens
attattagtggaggcacgggggaaggagagtgcagtgcgggaggcaggaagggaggaagagtcacatctgttcttagctcagcctccacccaagtccatccagttctctgtctctctctctctggagccttggctccacggctgctgctgtcaccctggcctctggggatgccctgctctcctccctgactaggctggcttccatgacatcagatcactactcctttttactgcatccgagaccagattgggatttttgaaaaggaatttgagcaggaaaattaaaagcaaaaaaaggactcatccgagtgtaggatgggaaaaattcacagagtatagattttttaaaaatattcaaattcagcaaagttcagtc

SEQ ID NO: 116052 - DNA, 332 bp, Homo sapiens
ctgtcaggtggcaggcctgcaagccaggtcacttgctatggtttgaatatctcctccaaaactcatgttgaaatgtaataatcattgtgacggtattaagaggtgggaccattaagaggtgattaggccatgaaggctcagtcttcacgaatggattaacaccgttatctggggagtgggcctagattcaactacagaagaggagacagcaatgtggccaaggaagcagtgatttagagcaaggcagccacaggccaaggaataccagcagccaccagaagctgaaggaggccaggaactaactctgccctggagcctctgaagaaagcagt

SEQ ID NO: 116053 - DNA, 398 bp, Homo sapiens
ctataaaatggagataacattacctgcctcaaaaaatcattctgaatgttaaataagataatgaatataaagtacatagtgtatataaagtgcttatattagtacctgacatacaagaccttgtattccaaaagtattttcttcttactcatgttacaaaatgtcaatgagagatttagtgagtataaggtttggtgttctccctctctgatgtgctaaaatttgatgtttgtatcttccctttctggtctacttttgcacttctttctagttagcacttaccactctttgtacattataggcatactgaccaagattcagttgatgaagttgaatggcataaaggggttaactctcctgaagtgaattttttttttatttcttctaacaaaaaaaaa

SEQ ID NO: 116054 - DNA, 499 bp, Homo sapiens
caggtggggcgaaaggcgtcgcagagcccgggccgcgggtgccaggaggatggggccacagcagcccctcgggcctcctttcttggattttctcagtctgttgctgcttggaacagggaagctccgcgtcctcgttctggggtgcacccagtcctttcgtgggatagagccttcgcgtaatccgtctgcgactcctcccttcccattttggctgctggctgacctgaaagccacgcccaacctgtccccatagcccagcgtgtaccggcagtggctccgccgccttggatgtcaccgtgcagtcgcacagccaggagtcaagctacagggatgtagctctccgcccgctgcgtcttgctgttctaacagaggctgtatgaaaacttggtaatcctagaaactgctcagatggacctcgcataaaagaagcctcacaaggttccgttggaaggggaagtttcccatgattgtatctgcagacggattcctaactgcgtaa

SEQ ID NO: 116055 - DNA, 404 bp, Homo sapiens
tctcggtaaatgttagctattattcttattatctgtaaaatgacagataataaagcaatgtttataaatgctgttaactctgcaggtcataatgacacttgtgaggaggtaaaaggagcaggtgaactggaggatatgtctgtctggaaagcagcatgttcccgacaatgttcatgtctgaaattgagcagtaattagtgagtgagctgaaatgagttggaaacagttaaaagcccttcttttctgttccctttatttatttctccagtgtagtagcttcatccacacggaagtgtcgtgactattactacctaggcaaattcactgttgaataccagctgactttgtactgaaaatcactttgggaactgaagtaagtactgagaagaataaatcttaaaaac

SEQ ID NO: 116056 - DNA, 2933 bp, Homo sapiens
tgcagaagctctttaatttgattaagtctcatttgtcaatttttgtttttgttgcatatgcctttgaggtctagtcataaattctttgcctaggaaatgtccataagattttttcctaggttttcttctagaatgtttaaagtttgaagtcttacatttaagtctgtaatccatctagaggtaatttttgtatatggtgagaggtaggggcccagcgtcattcttctgcatataggtagccagtttttccaacactatttattgaataggatgtcctttccttattgtttatttttgttgattttgtcaaaaatcagttggttgcaggtatatggctttatttctgggttctctgttctgttccattgatctctgtgcctatttttgtaccagtataccatgctgtttttgttactgtagtcttgtagtatagtttgaagtcaggtaatgtgatgcctccagctttgtatttttgcctaggattgctttggctattcggctattttttggttccatatgaattttaggatttttttttctaattctgtgaaaaatgatgttgataatttgataggaattgtgttgtatctgtagattgctttcttccaacccattagctgggatgtttttccatttttttgtgtcatctatgatttctttcatcagtgttttatagttctctctgtagagctctttcacctccttggctggatacattctttggtattttattttgtgtatgggggactattgtaactgagatcaccacgttcctgatatggttctcagcctgaacctgaacattgttggtgcatagaaatgctactgatttttaggccaggcacagtggctcacgcctgtaatcccagcactttgggaggccgaggtgggcagatcacctgaggtcaggagtttgagaccagcctgaccaacatggtgaaaccccgtctcaattaaaaatacaaaaattagccaggtgtggtaacacctgcctgtaatcccagctacttgggaggctgaggcaggagaattgcttgaacctgggaggcggaggttgcagtgagctgcgatcacaccactgcactccagcctgggtgatagtgagactccgtctcaaataaaaagaaatgctactgatttttgtacactgattttgtatcttgagtgtagaaagtcaaaagttttttttttgttaaggagtaaattatgtgttagaaataatagttttttctaaagactaactttttttaagccttttcgctttgtgctaataactttttgttaagccctatcatatgtagctgttagatataagggaatgagtacattctatgtccttgtactttaaccaagatatttgtgctggacgtgctcacaggcatgtcccagcttgcagcccatgccccttccttatttggaaatgttattacttttctaagtcctttcataagcaacttcctcttttcctttgtctttccactgcttttacctatttagaaaagttttaagttattagccagtcgggttttagtttagactgtgaggtttggctccagccaatggagacaggacacggtagcagggacaagctgcgtaaggaataaaaattgcttctctccattattcaggtgtgctctcgccattgttccatctgcgaggagcaccctttctgcagaaagtaaaattggcttgctaaaaaaactttttgtctaaatgctgatttttccttgcagtaccgaggaacaagcattctgtttctaaacaagcattttacttataacattgagactttactgaagttgtttatcaagtctaggagtcttttggaggaatcttcagggttttctaggtatagaatcatatcatggatgaacaaagataatttgacttcctctttttttttttttcatttggatcccttttatttctttctcttgcctaattgctctgactaggacttccagtactctattgaataggaggggtgagagtggacatccttgtcttgttccagtttttagggggattgcttccaatttttgcctgttcaatatcatgttgccggctgagctctttacctactgtgtgacttgggagagctgctaaaccagctggagcctcagtttccccccatgtaaaatgggtacagcaaggaatatctgccttgcagggtcaaagtgaggattaagtgagatagcatgggtaaagcccctagcacacaacaggggggctcctcggccccagaggatgtcaggaacatgtcagtgtcccagagccatcaggaacatgtcagtgtcccagagccatcaggaacatgtcagagcatgtggggacatgtcagaaagtgtctcagagcatgccaggcagcccagcattctagggcacagatcaggtatcagtggcccaggcatctcatgcaaacgggtgtggcagtggggaccctgagagctgggactctgtaaaagggacaagagcgtagttctgtgagaacctgggtgcagagttctgagaccttctaatttttcaagaaaaccaggtcattcaaatttttatgtgaaactgtctggtatttaaaagcagccaactaatctcaagtataaacagacaggcacgcctaatgtgcaagtcacactctgctctccctcctccctcccccctccttggtcctcagggagtgctgaggcttctggggtctctctgaccagggtggagccactggccaccagggctctggagcacttgggatttggctcgtccaaaccaaaacctgctgcaagtgcaaagttcacacctgatttttaagacttagaataaggaggtggggaatgtgaaatatctcatttaatagttttagattggtttcatgttgaagtgataatattctggatatattgggtaaaataaaattatattattcaccggcaaaaaaaaaa

SEQ ID NO: 116057 - DNA, 117 bp, Homo sapiens
ccttttaaatgacgtgaaaaaatcagaggtgaaaattgtacatttggaatgtatttatgtaaattttgttgaaatttagtgtaaacaaagattttctcagtggtctagaaaataaaa

SEQ ID NO: 116058 - DNA, 421 bp, Homo sapiens
aaacttccggccaactgctggctgctgctggtagcaaggaacagaggcgacagggcaggatgggtggacctgataagccagatggcgtggagctgtcccaagcagatgctctgggattattctgccttccaagagaccaccttgagtcccagaggctgtgggctaggggccagcaggcagggtctttagctggacctgtggactccagaccaggataagaaccagccctctgggtttattcctcatcccagggacctgtgtagggggcccccaggcatacgcccctacctcaggggactacgtgggtatcttgtagagccggttcccaaggttacgcccccatccccaccccagcctacagggctggccccagggtaatgcccctatccttggggcctgcatggataccctgcagggctag

SEQ ID NO: 116059 - DNA, 760 bp, Homo sapiens
gggaatcgttgctaaaacagctttttctgacattgacctcaacactgagaatgaaatagagagctgttattatctgaactatgcaaatgtgagagtaagtgagtgtgaagttcatcgaaaaggctcgttagggacaaataaaatcctgagtctggtgtttccatggattctctctcccaggtaatggagcagtgacggtttgtttcttgttctatgtagatacttcagtttgttaatggacgccctgtgttttattataaggagagtttatggaatctgcatgtctaagagaatactacaaaatgacacattctttcaaatagtgccttgtctttcctcagccttaattcagatattatagaccatggatgcctgtcaccactaggccttttactcatattactgagtttaattcttctatcagcattaattaagcacccatattaatagagtagagaataaatgagctttagtctatcttttcctttcctattcaggacagggctgggataagcaggtagatctgtaatagttggtggcaggggacaggaggtggcaggggaaagggggaagcggacatgggtgtgcaggtctaaccgcaagtgttcaaggcataatatcgaaagggtaagacagtccacagcagtcagcatcatggagtatgcagtaattaggcacaacgtaatgaggagaaaccaaaaagtagacaacttacaaagcttttgtgtgcctttgtcttcctcatctgtaaaatgtgtat

SEQ ID NO: 116060 - DNA, 606 bp, Homo sapiens
tattattgagtagaggtggttgctgtccactgtcacaacttgtatttagcattgcactggagatcctagccaatgcagtaagacaggaaaaggaaatgaaagggatgatgatggaaaaaaacaagacaaaaaacaaagcctcagtgggcatcctgacattcactcctgccttagatagactcaagacccctagtcataggtaataccagaccccctaggtcttcacccatgcacacactttctcagataaaccctatccccagaaaattactatggagcacagcagaaaatactgagagaggagaaacaaggatggaaagcaaggacaggaatgttcctttagcaaaagtcctttcacatatgaggtagaggtggtgatggatagtctcagtgcagtgaacaacctataccactatatggggccatttaacttgccctatagacagaagaagaaggggagtggtaagagcattttgggcaaagaatacaatgtgagcaagagcactaagacagtaaattcaggaagtgaaaggacactgaaggcttgagctctagagcagtgataatgaggttgaggtggaaagacctgatttaagagctatcagg

SEQ ID NO: 116061 - DNA, 290 bp, Homo sapiens
tttttctttaccatgcatctgtggggttttctaacctgctctatacatcttctgtgatttcactgtccacttgaatgacccacatgacaccatagctactcaattatttgcccgtcttctctctaatgagcttccctgtgccagttaagccatttacttcacagtctcgctttggacttgtcactcttaactgtttcacttccacaatattaatttagatatcctattcgtagaccataccgtctcctggtttgcttgtgcaactccttaaattataactattctttgac

SEQ ID NO: 116062 - DNA, 411 bp, Homo sapiens
tcttctgtcattgttgtgtgattctgctgcatcctgaggtcttctgatggccggactggatgggccctcagtgctgcactcccatctcaggccctgccccaccaccactaaccccagctctaattttgaagggtggcaacattcatcccaagttgcctcagtttacttcagttacgtggtggcctgtcagtggggtttccaatggttcctccgtcgccgtgtgtatcacaatagccagcagaggctgctcagctcatctgtgcccaccccctgactgccaggacagcctcctgccaccttgtcactttactcagtctgctgcagttgcagctgcagtcacaccccagactcgaaccccagcatccagggcctcccctggtctggccttgctctgcctttccggcttgcccc

SEQ ID NO: 116063 - DNA, 444 bp, Homo sapiens
aagtgagagtaattctctccttgaacccacaatattttctttttatcacaacctttaaacatacccagagattaattgtgcatgccaggattctaagaaatgagagatttagtctctatttgtagattcaacctcgcttttacattatgtgaagtttgttcactgagaacttgaaaccagaccaaataaactgggcagcttgaaaaacagacaaacaaacaaacaaaagctgaacatagatgatcaaggtaaaaacttgagtgtcaatatctttatcactcactggttaatgttcttggctagattaccttctttttccactcttgtacaattccaattaaaatttttattttgacatcaaaacctggcttcctgagtgtcttgaataaatacagattgataagcactttggccaattatatctgagaattcttctctactcat

SEQ ID NO: 116064 - DNA, 832 bp, Homo sapiens
caatactagtcttttttgttagatatgtggttagcaaatattttctcttggcctgtagcttctttcttcatcttcttcacatcatgtttctcatccaaaagtttttaattttcataaagtccagtttatcactttttccttttatggattatgcttttggtgtcaaatctaagaactccagatcctgaagattttcccttatacttaaaaaattatagtttcacattttaagtccatgatccattttaagtttatttttgtacaaagtttgagatttgggttgaggtttttttagggggtgctgagttgggcaccatggatgttcagttgtttcagcaccatttattttaaaggctatcctttttctattgatttgcttttgtatctttgtcaaaaagggaacaaagaaaagatgagacaaatagatgtagaatttaaactaattatattaataattgcattaaatgtcagtgctctaagcagcccaattaaaaggcagagattatcagagtggatgaaaaacaaaacccaactctatgctatctaaaagaaatctattgtaaatataaagacacgaatatgttaaaaggatgaatgaaaagattaggtcctggatggaactgaggttaactgaggataattttaagatttgtactatgggtgattaggtggttgataacacaattaaccaaagtaggtattgaaagaccatctcatagctggttggtgatgaaggaaatgagttcatgttaatgtttgaacctattatatttgagatgtttgccacatattcatgtggatatctttggtgtccagttggaaatatggatct

SEQ ID NO: 116065 - DNA, 308 bp, Homo sapiens
gaaacaggatgcttgaatctaatagtgtagtaactctggaaatcaggttctccctctttctcagggtttgctgatttctgattttacttttgttgtttgattgtggtaggctttgtctgtgtcagggggtctgcctgatgtgtaagcttaagtttttctcaggtcttttttgagcctgcacctttcattgggtgtgtgtggtaaccttctacattcccctgatatgtggttacttttgaatgtcctagactttaaatatctgtcttctgaaagtgggaaaagagaaaaatgaagaagaaaataaaagc

SEQ ID NO: 116066 - DNA, 654 bp, Homo sapiens
gatttgtttactgttgtgttgtttgagttcctcatattctatatattagtcccttgttggatgaatagtttgcaagtattttctcccattcaacaggctgtctcttcactctgttgtttcctttgctgtgcagaagctttttagcttaatatagtcccacttaactatttttgtttttgttgcctatactttttaggccttagctataaaagctttgcttagaccagtgtcctgaagtgattcccttatgttttcttctagtagttttaactagttttaggtcttaaatttaagtctttaatccatctcgagtttatttttatatgcagtgagagagaggggtctggtttattcttctgcatgtagagagagctccaattttcccagcaccattcattgaagaggggtgtccattccccattgtgtatttttgacatctttctcaaaactccattggctgtaactacgtggatttatttctaggttctccattctattacattgatctatttttataccaatacagtgccattttggctaaattagccttattttgaagtcagttactgtgatgcctcatctctactaagggtacagaaggttacctgggtgtggtggcacgcgcctggctactcgggaggctgaggcgggaga

SEQ ID NO: 116067 - DNA, 175 bp, Homo sapiens
gcatgtgactgtgtgtgggggtgggtgggtgtcaatgtatgtgtgtgttgtatgtgattgtgagcatgtgactgtgtgtgggggtgggtgggtgtcaatgtatgtgtgtgttttatgtgattgcatgtgactgtgcgtggggatatgagagtgtatgagaatgcatgtgtgtgtt

SEQ ID NO: 116068 - DNA, 791 bp, Homo sapiens
aaaattagcacaaatatattcattttcaaccaatattatgggctataacatgtttcagggtcctagggaaatacattaggtaaacaaaacagacgagcccttcccctcatagagcttccattctagttttggagattaacattaaacaaagaaaataacttaatttcagatactgataaagtgccatgaagacaaaaaaacagagtaaaataatagtggttggtggagttgggactcctttaggttagaggaaggcctttctgaggaattgaatgatgtgtgagctgtatctaagtgatcgaaaggagccagccatgtggagaaggcacaggacgagtgtcttaggcagtaggagcaggaattctaaaggtcaagagatggggaacaaactggtcaaaattaaagaataagaagaaagcaaggcaggcacactggagcatgcctgtaatcccagttacttgggaggcagaggtgggaggatcacttaagcccaggagtcaagaccagtctgggcaacatagcaagatcccatgtcagaggaaaaaaatgtgtataaaagaaagcaggccaggcgcggtggctcacgcctgtaattccagcagcttgggaggccggggcaggcaggtcacctgaggtcaggagttggagaccagcctgaccaacatggagaaaccccatctctaatacaaagttagccaggcatgttggtgcatgcctgtaatcccagctactcgggaagctgaggcaggagaatcgcttgaacccaggaggcagaggttgcagtgagccta

SEQ ID NO: 116069 - DNA, 150 bp, Homo sapiens
ttcgtgctgctgataaagacaaaaccaagtctgggtaatttacaaaaagatagaggtttattggacttacagtttcacatggctagggagacttcacaatcatgatggagggtgaaaagcatgtctcacatggcagcagacaaaaaagga

SEQ ID NO: 116070 - DNA, 822 bp, Homo sapiens
gtgccgtgacatgatcacagctcactgcagcctcaaactcccaggtccaagcaatccttccacctcagcctcccaagcagttgtgactacgggcacatgccactacatctagctaatttttttttatttcttgtagagatggggtttcactatgttgctgagcctggtcccaaacttctggcctcaagaaatcctcccatcacgtcagcctcccaaagtgctgggattacagggtgagccaccgcactcagccaacataatttatttttagagtcccttttaaactccaggtcttcagagtccacttttaatatatatgaaattcctacatattcttagaattttattctgttgcaagggtctttgtctcatcatgagccagtactacagttttaattagagataccttgtggtatgtttcaatatgtgggagtcttgacagagcaagactcgaaaagctcaaaaaaaaacacaaacacaacccaacaaaaaaacatttttgggccgcttgggccctctaaaaacttttttaacccattctgtttggcgcccgcgggccccaatttgctcacggcgcgaccggtgcgccaaaggctgttcccaagagaaagaccccgggggcccataacgcacacggcgctggagactttctccccaatttaaaaaacagcgcccggggggggcaacacccgagatgcgtttctctttcaaccaaaatctcccaaagtgaggggtttccagagagggcccacacaccgggggagtgctttcacaacagcggagattccccaaaggaaagctgcccgaattttaaatttagcc

SEQ ID NO: 116071 - DNA, 234 bp, Homo sapiens
taggggttattaaggacactgcagagtaaaacaaacaagcctgattatcttacagggaggaggagttataattcacctgtttatttagaaacctgctaatactaatcactaagaatctctgtgtggtggctcaggcatgtattcccagcacattgggaggctttggaaggaggattgtttgaggccaggagtgtgagaccagcctgggcaacatagcgagaccccccgtgtctc

SEQ ID NO: 116072 - DNA, 109 bp, Homo sapiens
gtctagagagtgcgctcagggtttctgtctaagctaagcaaagtcaacataatgattgcttttagactctttgaaatcagaatttttatttttgtttgtttgtttattt

SEQ ID NO: 116073 - DNA, 313 bp, Homo sapiens
tcaatacttacggtgcttttgtggcctttcacagacacacgcccacggcagtgaaaaatttgtgtcccagctggggctaaacaaggcgatggtctgctccctggtttctgccctcatattgtgaacatgtggccttttcttggtctatttagtgccaagtttcttgcatatttgggctttttgttggtgattttattgtttatgatggcccccaggcacagcactgaagtggtctggtgttcctaagtgcaagaaagctgcgacatgccttatggagaaaaaaatgtgtgtgagagaagcttcgttcaggcat

SEQ ID NO: 116074 - DNA, 293 bp, Homo sapiens
tccaagaccaattgaatcactataggaatgctggggaaaggaggcacccattggaatattttgaaagttctgcattcaggtgattctgacgtgcagccaagacagagaaacattcctttaagaggattattttgtaccttctgtttcctctaatcctcctactctcccttctcctttcaactcccagctgatgaacttgtctcatgcttcactgaggaaattgaagctgtctgaaggaaacttccctacccacccatggtcaaaaccattgaagtatctctgtctggagccat

SEQ ID NO: 116075 - DNA, 382 bp, Homo sapiens
aggccagtgctaacatcttgagagaatgagagggagtgttccggaagttggaagctgaaagtgacccacagggatcagcgtggagtctgagcagacaggactagcctctgtggaatagaggctcacacaagggaggacagaaggatttgaaagcagcactggagagcatgatgttgatagttcgcatctcttccttcccaggaattacgtgccttatttatacttcttgtcatattacattggctcagagcatcaaaacagtgttcgttaatcacagtgctcttgttccagatcgtgatgggggctgctctggttacccatttttgactgagtgtgaattgacagcttctccattatattgatgaagcatccgtttacatag

SEQ ID NO: 116076 - DNA, 616 bp, Homo sapiens
tgcagccgccagggctggaccgtgtggtgcgcaggtgagaagccgggagggcctggacaaccccgaccgcgagccggacccctgctctgaccgcaggaagcagtaccttgaagagaaattggagagggagtcaattcctaggatagcagagagatggacaacagacagaatagatggagtttcaccgattccggacacaataggttctacgtccatgaattcaaccaactgcaaatagaaaacatttgaaaaaataaaaataaaaaacagcaacaaggaaaaataatacaatttaaaaaaccaatacagtgtaacaactatttacctggcacttacattgtggccgggcgcagtggctcacctgtaatcccagcactttgggaggccgagatgggcggatcacagggtcaggagttcgagaacagcctgaccaacatggagaaaccccatctctactaaaaatacaaaaattttagccgggcgtggtggcgtgcacctgtaatcccagctactccggaagctgaggcgggagaatcgcttgaacccgggaggcagaggttgcggtgagccgagatcacgccattgcactccagcctgggcaacaagagcaaaactc

SEQ ID NO: 116077 - DNA, 752 bp, Homo sapiens
tagtagagaccgggtttcgccgtgttagccaggatggtctcgatctcctgacctcgtgatccacccgccttggcctcccaaagtgctgggattacaggcgtgagtaaccgcacccggcagtagtacctactttttaaagtgtaagcaaggaaagttggcccgcacctgtagtcccatctacctgggaggctgaggtggaagaattgcttgagcccagttggtcgaggctgcaatgagccttgatcacgccactgcactccagcctgggcaacagaacaagaccctgtctcaaacaaaaaagtgtatgtaagaataaaaattaatagattaggcacaggatgggtgtttaattctcggcaatcaccactaagttttcatactgaggcttattcattccatgggcaaaacattgcgctatgtgtggtgcctggggtgggctccaaattccagtcctctcctcgcttgcgatagctgtgtgatccattcctaagtttccttatttgtccacagagcgtacacagggtttttatgaaaactagatcagataatcagacacagttaaaatagcacgcgctcagtaaaattacatattagtggaagagacaagccttgaataaatcgcctttcggggagtatgaccccctccccgaaacccactcaggcgctgctcgctcgcacgcccactgagctcggagcggagcccgagccctttcccagcacacagggttcatttccagactgaaagacatccc

SEQ ID NO: 116078 - DNA, 298 bp, Homo sapiens
ctggacgccaccatttcacatgaagaggcaggcgacatgcgagtgctgaggaggaacactggacgccaccatttcacatgaagaggcaggcgacatgcgagtgctgaggaggaaccctggacgccaccatttcacatggaagaggcaggcgacatgcgagtgttgtggaggaaccctggacgccaccatttcacatgaagaggcaggcgacatgcgagtgctgaggaggagccccggaccgcaccatttcacatgaagaggcaggcgacatgcgagtgctgaagaggaactccggacg

SEQ ID NO: 116079 - DNA, 303 bp, Homo sapiens
gctgagggaggactgaggcgggcctcacctcagacagagggcctcaaataatccagtgctgcctctgctgccgggcctgggccaccccgcaggggaagacttccaggctgggtcgccactacctcaccccgccgacccccgccgctttagccacggggaactctggggacagagcttaatgtggccagggcagggctggttagaagaggtcagggcccacgctgtggcaggaatcaaggtcaggaccccgagagggaactgagggcagcctaaccaccaccctcaccaccattcccgtccccc

SEQ ID NO: 116080 - DNA, 537 bp, Homo sapiens
aaaagcaaacaaaaaaacatttgtctcataatttctatgggtcaggaatttgggagtagcccagctagctggttctagcttagatctctcataagattacaatcaaagcatcctccaagtcatctgaagacttggctggggttgtaggttctgcttccacaatggcttacttacatggctgatggcagaaagctctagttactcatcacatggagctttccatagagcaccttgaatgtcatcaagacatagccggtggctttccccagagagtgatcacagagagaacaaaacagtcacttagcctcaggagtcagaattcctcatttctactacattatattcatcagagatactttacgtagtatacccacattcaagaaaaggggaatgaaaggagcaaagaatttgtggacatccttcaaaactaccacatcagttgtaattttgctgtctagtctgtgattattcacatgtatatgttatgtattatgatctatcagggtgatgtcagcagtcaaagtggattggagcact

SEQ ID NO: 116081 - DNA, 499 bp, Homo sapiens
ccaaacatccaactagccagatacaatgactcatgctgagcccccaaaatgggaccattcctccaggagaccaaactgtcacctgcctttcctgcctacaggtccctagctggcaccactgcccatctagtctcccttcaaggaagggcctgctgtccaaatgtgcactgtgtagtcagcacacagcctgtagctattggctccttcagggtcaacctcagctgcagagccccctctcccaaggttgtgcccttcctggggtactttgctctggggactgagagagatggggttatgacagccattccagcacaacacacaaaaattctgacaagccaggcctgatcagacccacatcacaggtgaatagttcccacctctgctcttttcctgtcacaggtgttgatccctcgtcaacatctcagagctcccaacctgaggcatgtgcacaaacgctcacaagatgccaccttgtcccacaattcctcgctacacttgc

SEQ ID NO: 116082 - DNA, 570 bp, Homo sapiens
cctgggcaacagagtgagactctgtctcaaaaatataaaataaaataaaataaaataaagtaaagtaaaataaaataaaatataaaataaaataataaaatataaaaaatatacccttggccaaaaggaggggtccatttcattggttggggaatttagaattttatttttggtttacagtatctctttttttttcttttgttacaaatggggttcttactctgttacccaggctggattataggcatgagtcaccgtgccaagctatatacatatttttatgccagtaccacagtcttgattactctagctttatggtaaattttgaaattttgaaatcatgtaagtccttgaactttgttctttcattaaatcatattggcttttcttggtcctttggatttaaaagataaattttaggttcatcatatcaatttcttttaaagcaaaccctaatggtatttagatagaaattatattgaatctatggatcaattttgggaaaactgacaccttgatgatactgtattttcctatttgcaaacatgggacatatctccatttatttag

SEQ ID NO: 116083 - DNA, 477 bp, Homo sapiens
gtgccttggcatgttatagttgtagtgaaacaacagctagctcttgcttttggccgccctctttctggagagatgcgagaccatagcgtttggatcaatgtagggtgtttagaaaactacagatctgttctcagaatctggtctgttgctaggtcaggtttttcctgtcttccctggggctctctcaggccatccaggggaattctccatacatcatgcaaatagaattttatcaggaagtcccatcagcagagtgtctttatttctgtacctccgtgtcccatactgggactttccttcctgtctctggccacctacctctctaaaccactaaccctatagttagttctttgttctgtgttctttgcacacaggagacctcttctttcctcttactccccagtagttcccatcatctctatcatagcagtaaaaacttgccaaagacgaatgagaaaactcagggtgttgcaatgt

SEQ ID NO: 116084 - DNA, 207 bp, Homo sapiens
tcgatcgagccggccggcatactggacttctattgagcctaaaatgggctctcttaagctctgctctccaatcatagtattccctcatgtagccacacaaagccattctgctgccttctgcattgtgctgtgtgttttcatgctgattgtctaattcaaccttcctaacttccattctaagtaagcacaattattatttctacttta

SEQ ID NO: 116085 - DNA, 379 bp, Homo sapiens
gaagtaattaaggctggaggcggtgcaaagtgtgtaggtggtgtcctaggctcagaaagacctgggctagaattccagtcttttccagctgtgtgattgtgagaaggttacttaactggttggatactcagccaccctgtctgtaaaatggggagaatacacttgcatatgaagttgccaggggtattgaacatacacagtgtggcatggtggctggatcatggcatgtttagaaaatgagggcttaaatcagattagtgttggactcagggatgtgggagctggtacaggatgcgaggattcctcattcccctctttggtaaccagttctgcaggctgcggtagcactcagctgtcttctgggcatttgtttctggac

SEQ ID NO: 116086 - DNA, 790 bp, Homo sapiens
gccgtctgcgcgccggtctccttcctggagtgcggctccgacgagctgtctgtgggccgcgcgggttacctgtgtgccgcgctggtgctcaagcagaaactcgtccaggagtcttcacagggaaaaaagccaattcagtattaaaatgctagccaagattgagggcgagtacacagaagtcgtctgcacattcaaagaagcaagacaagcttttgaaaataacaaaaaagtcagatgtgcctttcacttttcaccatgattgtgaggcctccgcagccacgtggaactgctgttggccagatgcttatctgagctcctaagaaacaccaattcttttaccatatgtgcgctcatcttcaaagccagcaatggataatttataccttgtcaagttcctctcattcttcaaatctctctgacttttctgtctctgactagttgttgtccagatttataagggtcctgtgattaggtcaggccacactgtgattatctcccttttttcaaaagtcaatttgtattacaatattaacctagtcatgggagtctaattaatccttttgcagagtccttgggtaatattacacggaaagtacacccagagtccccagcacttttggtgggccaaaattctcttttagacttattagcaatattttattaatccaggaggtttccactttcacaataattttttcccctaaatccttaattgtgttccacattaccttatttgtcaccgctacactttgaggcagtttgtggctttcaagggaaccagagctaatga

SEQ ID NO: 116087 - DNA, 174 bp, Homo sapiens
tagcattttgtttcttaacctactctccttagtcctgataatgaatggtgaatgttcatctcactgcagatatgcagactgtatttgtattggccgaagagaacccaggaagagcacagttaatcctctcttgtaattaactatttttacttgctaaagatgcagaaaaaaagg

SEQ ID NO: 116088 - DNA, 461 bp, Homo sapiens
tcctggtggatgagtagtatggttgtgggcttgggagacagccagccttgaacttaggagctggcactggcctgagagtcattatctgtctctagtccttggccccagagtgccctacatcttcacctattttcttggggtaccaaaaactccattcctgaaaatgttttttgaaaatgtgttataacctataaagtcattattcttaatgatgctgagattgtctcaagttttgccagtggggatcccttcaatttggctcattgtccttttgacacaatatccgttagtctagatagctttcttgatttctggcacaagatatagcaggttcaccttgcacttgcactttttttagaaaccaaaatatgagcacaaagtgtgctcattgctactgagatgttgttgtttctaaggaaggtgcgtgttttttgagaattattctgctgttgatagcgtag

SEQ ID NO: 116089 - DNA, 423 bp, Homo sapiens
ttcaggctagaccctgtaactgctctgtatgtagtccgtaagctttgtttgaagtctgattatttttgaacaaagttttaaacatattgttcattaatctgaaattgctagttacatttagaatctttgttaatgtttagcatctgcttacagaggcttggaatgtaactgtaactgttttcaagccaatgaacagttcttcaaacatacctgcagtgtttagtgggtgtctaagtctttgtgatgggtttgttcctaggtaatctctcaaggattttggagtccctggagctgggtgactgtctcagagtctgtacccacatctcccacaaaggtcaagaatgaatgcccaggttgttgtgggataatgatgaaaaaaatacatagggacaacttggttgctgccaggcatttcttttctat

SEQ ID NO: 116090 - DNA, 336 bp, Homo sapiens
cacccacactctgataagtagcagaggtgctgctgagacccagatcccagggtcccagggtctgggtcccagcaggatctctgctacttatcagagtgtctgccggttccaaaagacagtggagggaggggatgggggcgcacatctttctcagaaagtcattgttctttgctagatgggcaggacccctgcctgcttcacagtggccagtcttagtgcatgcagtggcagagggtcagatgtggggccaaagggctgtgagcagcgcagatgaataaggaagacataacccagacattcctacttctagtgggaaagtcatatggggaaccagcc

SEQ ID NO: 116091 - DNA, 569 bp, Homo sapiens
atcatccaaaaacagaaccagtaggcatgtgcatgtgcatgtgtgtgtgtgtaaagtgggggagttaaaaagaattggctcacataactatggagtctgagaagtctcaagatccgtagttggcaagctggagacacaggagagtagatggtgtagttccagtctgagggcaagaaatgactgcttgacctagctcaagtagtaccagtcaggccagaggagccccctcctttttgtcctattccggtcttcaactgattgattggacaaggcccacccacattagagaaggcaatctgccttcttcagtttaccaattcaaactttaatctcatccagaaataccctcagggacactcccagaatagtgtttggccgaaagtctgcaccccatggcccagtgaagttaacacataaaagtaaccatcacataaccctagactactgctctcccacaccatccacatctacgtgacacaaaatccagttggtttcaccttctaaatatttctcttgtctgtcatgtctgcactccagcctgggcaacacagtgagactctgtctcaaaa

SEQ ID NO: 116092 - DNA, 251 bp, Homo sapiens
ttcatcaacgtataccaagaatggcacacagtgaatctcccattttccaatcaacattaaaaactctaatagcaaacacgggagggtgttgtctgtactttctacagttatgcaaaagaatcctatggtactcatatatatcctatggtaattatagagatgtaggttaccatccgcagttcctggctcattaacccttgttgcagtcttttacatgttggggcattttagcctcaggaaactatctgatc

SEQ ID NO: 116093 - DNA, 208 bp, Homo sapiens
cacacaccagccagcccgcccgaaagctgggaccagagcgggtgtcgtggctcccaatctgggcctccatctgcctcacttccctgcctccagatgagcagccacggctgtgtgcggccccgtcctgacagcccctcactttggtcttactgggttcaaggtcctccaagcactcctgagtcaaaggcctggcctggcctctctgact

SEQ ID NO: 116094 - DNA, 743 bp, Homo sapiens
ggatgatgttatgaggtgcttctgagtctgcaattccatttttcccaatccccacctctttccagcttcaatgaggcctcctgggagccagtagtagttaggtggtcaaaaagaaggacagagacaagaaaagttgagctcaaatcccactctaccacttaatagctgagtgaccatgagcaaatcccttaatctttttgagcttccatttcttcacctacaaagtggagttttctactaattcttttcataaggaataagagaggtattatatgtaaagtgctttgaacactgcctggcagagactaagtgtgcaacaaatattagttgttattattacaactcaaactacgagaaaattagaggactcagaagtgtattggaaaggacgtcatgatgatttaataccaactctggctacaagagggtaaacacacagtggtggagataacgttaggcaaagggcaaaggacttactctgacagctccattagcatgcagggctgcatgatcaatgccaagcataaaacatcatggggatttaaggccggacgcggtggctcacgcctataatcccagcactttgggaggctgaggcgggcgaatcacgaggtcaggagatggagaccatcctggctaacacagtgaaaccccgtctctactaaaaatacaaaaaattagccgggcgtggtggcgggcgtctgtagtcccagctactggggaggctgaggcaggagaatggc

SEQ ID NO: 116095 - DNA, 224 bp, Homo sapiens
tagaggatttcgctcctagccgcgccagtggagcaggtgtttggagggacaggccaggagctcccagggggagttcctcacatgactccgacccggcagaatgctgggctggggctgctgggctggggctgctgggctgccgggagaacccacgctcccactgcagcagcaactaccctcccacccggtcaggcacccacaccccctgggccgaggctgaagga

SEQ ID NO: 116096 - DNA, 464 bp, Homo sapiens
acttgtaatacagcaaactgagttcaagcaaaacgcatttgaaatatgagactgactggcctaagcagtacatttcaaaaggatgggtaggatttttgtacttgggcagtcacagttctgaaagttggcctgtgatcagagagagtccgggctgcctctgctgaacctctggggaacactgagcaagcaagctgagatctgttcttccagggctcagaagctgctggacccatgcccggactggcagaggctgtaactctcttccactccttctctacctacagatcctccctgtcctctacgtgctctgagaagtcaagaggaggctttagagcttgttttgacttcactcctgccctgggactctgttctgtgcaaaggcacactcatttagagaagaaaaaaatatgaacatgctcttggctctgcctttgaaaaccagaaagctagttttgtttttgttt

SEQ ID NO: 116097 - DNA, 260 bp, Homo sapiens
taaaaaaaaaaaaggtatgatttcttaatttctattcttggcataaattttctttccagtgcaaccaaaacttacggaaccctcttcagcactgttattcagaacttggagttctattgctggataaaaaattcattcacaaataagctgtgcaattcgatcaccttgaagttttgacttcaaacttttctttgacaaaacaccaatgtttctcctataaccttcatctaagatacccagctcctaagtgttgcagccaa

SEQ ID NO: 116098 - DNA, 582 bp, Homo sapiens
ggtaaatattggctcgagaaaatgtgtttaaagtttacagaggcaatgatgcttctagaaggattccttattctgtcctaaatatcatagaacaagtgtaaaagctcacagtctgactctgccaagattcctcatttgtgagatttacttaacttcacagaacgaacaaaaatgctttccaaaagattatctgcaaatgatccaaaaatgcctttgtgagtacttttatttaatttttgagatcaccactcatagctatgatttggcaagtgtttgtcttttccaaatacctcatcatctttcacaggttgtgaaaaatgagtttgagaccgatcttatctgcgaattttgttacctttctttaatgttgagagcaactttttgtgagaacaactggctgagactctagatgagggttttttttttttcaaaaaagctaagagtagtaaaagaatagaatatttgttgatatcctattatgtggtaaacatgttgaacaagataatattcttgccctcaggtagtttatactgtattgaaggactggagcatataaaaaggaaattcagtataatcttatgt

SEQ ID NO: 116099 - DNA, 325 bp, Homo sapiens
aaactcctgacctcaggtgatccgcccacctcagcctcaaaaagtgctgggattacaggtgtgagccactgcacctggccctctttggagggctttttaaaacccagatggctgggcctaccctaagatctaattctgcaggtctggggccagggatggggcgggcctgaaaacattcatcccaggtgatgctgctggtctagggaccacactccggctccctttgagaaccagtgaatagatgatccctgtgaagagctgctggagtgatgatgaggggagggggtttgctgtttgtccctggccatcagtgtccacagcaggt

SEQ ID NO: 116100 - DNA, 319 bp, Homo sapiens
ttagacatgcttttttatgaataatgctattcacacttaatagactacagtatggtatatattataacttttatatgcactgggaaatacaaaaatttgtgtgacttgctttattgtgatattttctttattgtggtggtctggaaccgaacctgcaatagctccaaaataggcctgtatgtataattcaaataccctttttcatagctacttcggttagtggttttatttcttatccccttagatgagattattgttatgggttcctcccacatcctggttgattttaattatttatctattttggggtgctaaaata

SEQ ID NO: 116101 - DNA, 421 bp, Homo sapiens
gagcggaggcagcgagaccagttaagaggatacatctgggaggcaggacacacaggacttgatgatggagcacacatcgggaagacaggtgggggagggactttaaaatgacctctagatttcctactgagaccggaagcccagggagaagatttgggggcaagaggagaggaagtgaaaatttccatttagacacacccatactgagaggcgtattacccaccaaaggtggccctgggtgggccattgcctgtgaacatggagctcagaggggaccctgcggggagccacagctgggtgccctggtcataaagaagtagttacagccatggggattgtattagtctgttctcgcattgctataaagaaatacataagactgggtaaattgcaaagaaaagaggtttaactggctcacggt

SEQ ID NO: 116102 - DNA, 273 bp, Homo sapiens
atgcctaaaacagtgcagaatagccaccctggaaggtagaataaaacttctctctcctccatttgcctcctcactcagaggcaaaagatttgaggctgtaagaaaagtgacacatctttacactgaacatgcagtgctccatgaggcaatcttttctagatccacctaaaacaactacgaggagtctgggaagccaacgaacaaagggggcaagttacctgcctaggatgtggtccagccctcctacctccctactctgtttcacatcctcca

SEQ ID NO: 116103 - DNA, 271 bp, Homo sapiens
agcctcacttgggcggagcctgtctccattgctctggcagggctctcacacctggtcttgtgtttgccaggcccacccacactcatctcgcccctgtctttactgttgcctgtatgtgccagccacttgccagtcagatacccccgacagggaggagacagaccaggcctctggtgggggacacgggagtgagttgtgctaacatcctgtggacagcagaggtggccgtgtgcctggggtcgtagggagaaccctagggtggctggccggg

SEQ ID NO: 116104 - DNA, 237 bp, Homo sapiens
ggctgccgccggagctggacgtgggcggcggcggggcctgaggtctggggctcgggcggtgggcgctgctgtggccggcgcgcgtgggccccggcgaggcggcactgcaggagctttgcgggcagctggagcgctacctgggcgcggcggcccacggctgtggctgcgccaccgtgcgcgacgctctcttcgcggctaacggccgcgcggccgactgcgagagcccgcgcgagtttc

SEQ ID NO: 116105 - DNA, 109 bp, Homo sapiens
tgcatgtgctgctgctccatacgggtacgagccctgcctagtgtctgtctcctgtgtcacggacctgttcaacctcgtgctgctgccagcctttatcgcgactcagctg

SEQ ID NO: 116106 - DNA, 278 bp, Homo sapiens
taagaagcagaggacactctgtgtttagatttggttttgtttgtatatgtcatgattaagttctcctggcacgattttcttctaaagcatggtgctaaccttgaggaagcgtagtgaaatctagggagggctggaaagtcaataccgagctcctagggagggatcttcagagtgtggtgctcctgatcgtagaaaagtctggaaacactgcccctcccctacctgctgaccccccagtctcttcttccttcccttctcagacttctgcacccttccaa

SEQ ID NO: 116107 - DNA, 266 bp, Homo sapiens
gtttctcttgctcttcagtttcaaatttctttctgctcttacctacaaggaccctgtgactggattaggcaccatccaggcaatcaggattctgtccccttccctccttaactctttaaactctccttcagagtctcccctctgaaaatccttaactcaatcatatgtaagttaacagtcacaggttccagtgattaggatgtggacatattgtatggaggccaccattcaactctctacagcttatatccatcaatatattcagt

SEQ ID NO: 116108 - DNA, 682 bp, Homo sapiens
agaggggctgggctgtgggccatccccagctccttgtctcggtcatccgggcttgtaggaccccctgtcccgagccacagcccaggtgggtgcacttggggagcatggagagagacagccactccctgcaaagggcctcagatggagggagaggcaggttccacgtgcctggagcaagaatgcagcaggagaagcgggggaagatgagacccaggcccacgtctgctaggagcacctcggaggaggaattcccacctgaagaccccaccacaaggatgtcgcaaagctgaaacctgagctcgggtcataccaactaaatccgggttcccatcaccccacaacgcagccttcaagccccttcccccgtggaatgatgacacagcggtgggctcggctctgcactgcccaaccctgcccggcagtgaacaggcgagaccacccagctgggacccagggaagaggcaaagaggagacccctcagcagggtccgtttctcctgcctgggcttgtcctgcacccaggaccaatgtggccctacaggacagctagaaccctcccctcctcttctccccaagtgtccccagagcttcagaaaagtgtgtgcttaaaggacgattcaatgaaataattttctaaaaagagaataaatacatacatacataaagaagcaggagtgtaccag

SEQ ID NO: 116109 - DNA, 432 bp, Homo sapiens
ttaaattcatggaaaatcagaggcaagagtagccaaaataatactggaaatttcttacaaagctgtggtcatttgtagtatgatattgcctcgggaattgacagctaaaccaatggaacagaatagagagcccagaaaccaacctatgaatatatggaaacttagaaaagtgtgctacagaggtggactttcacattaatgggaaaagaacgaattatttaacaaattgtaccaggacagctgacaatgtatttatggaatatttttaaaattaggccatagaaatcaaaaattttaaacagaatatagacttgtattatttctgggtagagaaggagtttttaaaactccttaaggggtaagattggtaaatttgacttctttacaacttaggtttgacaaaagatggcaagataaagttgaaagataagc

SEQ ID NO: 116110 - DNA, 182 bp, Homo sapiens
ggtgtgtaatatatgtatgtgtacttcagtcctagcactgtagtaacgaactgccacacacagtgtggcttaaaacagaaatgtattctcatagttctcagaagtctgaaatcaaggtgttgacggggttggttccttctgcagcttagaggttgaatctgttctatgtctgtgcggttctg

SEQ ID NO: 116111 - DNA, 774 bp, Homo sapiens
cgaggccccggcaatacctcaggttctaggcctctgtctccttcgtcacagcatgcacttcccataattctttccttcacttcggagtcttaataccaaaggaagacacgccattttgagcagcctattaatttgaaagtgtcaagtgtaactagggaataaatgagactcctcaaaatgagagcttagtgaggcatgaggtagtgagcaaggtcaagcgcttagcttaaaacagctggattaattagggtaaagtctttgggcttgggatttgggggcctttctgactcatgcaatttttccagaaatgaatgggtcatatgttttgggaatctgatatttaatgactagttttggggttaaaaaagttcacagtaagtttatgttagcaataattgtccttggggagattttgcagagcaagggaaagagagatgttaggttctcctttccttcctagctttttgccctcatcaaacatttatagctggaggccctgtgaatttcaatatcaacatcatggttcaggtgctcaaggatttcatagtctgtgagaagacagacacacagataaacgcacactagctaacaagccatggagccctggggcaatttgtcagcctctccgggctctgtttcatttggaaggaccttgatggacaagttcagtgcttctcaaccttggctgttcattgaaagtacttagggaacttagaaagaacaccagtgccccagctggcctcatggctctggagtaaggcccaggcgttggta

SEQ ID NO: 116112 - DNA, 168 bp, Homo sapiens
aaacattgcaggtacaggaaagagagacagcagttgatggagctagggtcaagagaagagaggaggaagtgggatccagggcccttgggggagattaactttccagtggataaaagaaggaagagatggttgcagatgtaagtgggtctataggaagggtttcaggga

SEQ ID NO: 116113 - DNA, 662 bp, Homo sapiens
atggaataaaatgctaatatccccatctgacaactcagaaaactgaggttcaagcatgctcttcactaactcaggaaatctgcatgctatgatatacatgtcactttcacttatctaccttattcgtttcccaaaattatattttagtaacattgcactatattgccctgacattaaagacaaaaattcagaaatcatttaatggctattaattactaagcactagacacttcacatatgcaatggcatgtactcctcaatctgattaagtagctattaggttattcctctatttcaggtgaaaatagaggatcttagattaagacactgttcagtgtcatatgaataagtggcagacctggaatttgaatctataactctattattcacaagtctgtaaacttaacaccttattatacagtggtggtaaatttgtgatttaattaacatttcctattggtagcatgcttttatgttcttttccaggtcttcaaatatttcctattgagaattcataatttggccaggagcagcagctcacacctacaatcccaacgctttgggaggcctaagcaggaggatcccttgaggccaggaattcaagaccagcctggtcaacatagtgagactatctctataaaaattttaaaaatcagctaggc

SEQ ID NO: 116114 - DNA, 394 bp, Homo sapiens
ttattgctttttttttagttttttgatgagcattgttaggctgtttatttgaagtctttttttatactgtaagcatttactgctataaactttcttcatagtactgcttttgttgtatcccatagatttgggaatgttgtgttttcattttttccaagactctttaaaatgttattcctaattttttaaattaattcattggttgtacaggagcatgttgtttaattttcatatatttagtggttccaaagtttctcttgtttgtgcccttgtttgcaaacgtgaccttctacttacaaaatctaaagacaccaccaaataattgttagaaccaataaataaaattagtgaaggtgcagtatactaactcagtgtaaatagctcattagcattt

SEQ ID NO: 116115 - DNA, 425 bp, Homo sapiens
gacagaccgggaagtgctcccacaccatcatttctgagatggtataatcctcacagcatttctgggaggtggcatgtgctatccagatgagaaatggaagcgtgaaactttggtggtgagtcttgactaagatcacacaatgaaccgatgcaagaatgggacaggaatacagccttcctggcagcccatactggatcaaacagaaggtggcaaaagctcaactgattgcagtatttgcttaaagatagaaaaatgtttcatcaggaatacagcagatgcagaaaggagagttaacagaaattaaatttcaacccaatagtaaatcttaactgagaagtcactggagaaatctctaatgatgaacaaggatgttagcaatatctgtactctctcttatcaaactcacaaaccaaggagaatgaatt

SEQ ID NO: 116116 - DNA, 298 bp, Homo sapiens
ggaatgtgagttcccagccactggccaccttcccctgcaaactttacaaagagctgcttgcagagggtcagggagcaggcactctcccctcaccatcccttggcacctgtccagacaaggtgggtagtagctggattccaggggcaaccaaacatcctctgttctcgaagagccctgtcctcctgcacttcagtggtgagaggaaggttccggaagagaggccagtgcatagcttctgcccataccctccccacagaaacaattaagtagctcaggctgtggctgccaagttcctctg

SEQ ID NO: 116117 - DNA, 736 bp, Homo sapiens
gccacgtctggctgatttttttgtatttttagtggagatggggtttcaccatgttgaccaggctggtctcgaactcctgaccccaggtgatctgcccgcactggcctcccaaaatgctgggattacaggcatgagccaccatcatgcttttaaaataggtctttatttctttattgtgtcttagtgtctggtagtttgtctcctcttcttgttcttctttaaaatcatcgctactctttgtgttttgcttttccatatacattttagagttctgctccatgaaaaaccctcctttgattgaggtcatgcattaactatatagattagtttgaagagtaatgatattcttatgggatagatatttcctgtgtatgtcttctttaatatctatatttaggtctttttactgtatacatcatttttataactttttaaatgttaataaagatatttcttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaaaaattagccgggcgtagtggcgggcgcctgtagtcccagctacttgggaggctgaggcaggagaatggcgtgaacccgggaggcggaacttgcagtgagccgagatcccgccactgcactccagcctgggcgacagagcgagactc

SEQ ID NO: 116118 - DNA, 245 bp, Homo sapiens
gaggcactgcacctggcctgttcttgatttttttcttatcaggcatactatgcaaatgccttgctttatattttcattaacttagtattaaggagaaataaaaccagaacttcaaggacgtttttatatgtactaataagaatttacttactttaattgatagaattgaaaaagggagaacaaaatgataatgtaagactgaagactcaaaggagttattatttaaatgtaattttaatagagtt

SEQ ID NO: 116119 - DNA, 413 bp, Homo sapiens
ctcttttatccaaccattttatttcactatacaatgttaggtatcctcagggcttgatttagatccccttcttctcccagacctttatccaccacattctcctatttaacaaaactgacagcccttcttccttagtgtctcttaaacttttcagtcccattgcttcaaggtgccatcatttcttagctagattattacaataacctccctttttctgttcttatgtctgcttatgcatactgcttcccccatcccccacactgtgtatagaatgatctctctgaaaggcaccctgcataaaatccttccccatcactttcaggctaaaatacagaaacctttctgttcatattagtgggtcagtctcctgctcctgaattcccttagcattttgtttctcgctctataaagac

SEQ ID NO: 116120 - DNA, 683 bp, Homo sapiens
cagacaacagacaccggacacagcagtagcgtggacgcgtaaagttataaatgaccctgtctcctttgttcagtgtactcttgtggcaaaactgctggcgagtgtaccctttctgcagaaagtaaaaatggccttgctgaggtagttaaaatttatgttcaagtgctatttctttacagcactggggaagaagcatttctaacaggagcctgcatgctgaggatggcagaggaaaaagacagagccatactgagcccttggagatgccactgaggagctacgctaaccaatcctggaggcaccataacctaggacttcttcttatacaaggatgctagagagcagtcttcagcctgagacccatctctagcttctaacaactcagtatactcctatgaacaaaatttggagcatatttgtttctctctacctgatttcttcagactgtggaaactatttgaatcaaacttgacttatggatccaataaagccaatgtgaaaggaaaatgtcttcagccccttcaagctgggaactctcagtacaaatctgtctctcattctattcaaagtcatttctctgctcagagatagatgcatattctgattgccttctttggaaagacttaccagaaactcaaaagaatgcaaccatctgtctctcacctacctgtgacctggaagcc

SEQ ID NO: 116121 - DNA, 569 bp, Homo sapiens
gaccccgtctcataaataaataaataaatagaaaattgagaactccccaaagcttttatttattagggttatatgtattgatagctgctgaattggaagttattacttaggaaacttaaaatatatattaattcatcaaaaataataatcctgttacatggtaatgtaaataacatatttttatgaaaaacaactattttccaaagcaaattattgaaaagagtgaattgtttaaattctttgcaaacccctttaatatctggcttaatagaagttagctgggttcctgtgtctgctctgcattcacactatttaagtatgttgttttggttgaagtgtataaagaaatgtagctacaaaaggaagggagcatattaataccttttcaggtgattgtggatattgttctttgacattataccaaaactcagcaagtggtttcttgggggtgggtagacagtgatgaatttttattcaaaacaactgtagtgactgacaaaaaaagttaaaacccagaatgatttgcttcaattaaaaattaattatatcccaagagcaggggtctacca

SEQ ID NO: 116122 - DNA, 344 bp, Homo sapiens
caattgtaactccccagaccagttagatcatagatccagatctcattgaaaattatccttttggctaggcatggtggctcatgcccgtaatcccagcactttgggaggccaaggtgggcagatggcttgagcccaagagtttgagactagcctgggctacctggtgacaccccgtgcctacaaaaaatacaaaaattagctgggcgtggtggtgtgtgcctgtggtcccagctccttgggaggcctgaggtgggaggattccttgagcctgggaggcggagattgcaatgagctgagatggtgccattgcactacagccttggggacaaagaccctgtctcaaa

SEQ ID NO: 116123 - DNA, 650 bp, Homo sapiens
catctcaaaaaaaaaaagctttacagtgaaaaatctgccttccaccttccccacatcctctcattctttgaataataggtagccatcattattagttacttatatgtaattccagagtgtattcacttcctaggacttccttaagaaattccacaaaccagttggcttataacaacagaaatttgttctctcacagttttggaagctagaagtccagaaatcaaggtgtcagtagagccatgccttcctctgaaggcttgaggggagaatccttccttgtttcttcgggcttctgggggttgctggcaatcttcagcgttcttggcttggctcactgaaatctctgtctccatctttccctcgtgtccctatctccctgtttcttctgctcttgtaaagacagcagtcatataggatttagggcccacctaacatccagtgtgacctcatcttaatataactattttttttttttcagtcttgctctgtcatccaggctggagtgcactggcaggatctcagctcactgcaacctccacctcccaggttcaagcaattctcctgcctcagtctcctgagtagctgggaatacaggtgcctgccaccacacctggctaatttttgtatttttagtggagatggggtttcac

SEQ ID NO: 116124 - DNA, 322 bp, Homo sapiens
ggcagaaagatgctttagactctgaagagccagaaaatgataaacatttgtccaatacagctggagacagtcaggaagaaggtgtgaaagatctaaaaagagcatgatccttggaaagacaatagacatttcagacaaagtaaaaattgtagattacttggtagacagctccattatgaagcagccagtgaaagttcttgatattgtgaattaatcatttgagcatttcctaattttattgcattgattgctaatattaagtgaggcattaatgtatcattccctccaaaacagttgtttaaagttgagataagtttagaaa

SEQ ID NO: 116125 - DNA, 159 bp, Homo sapiens
ccattagtacaatgcacagagtcctggcattgtggagagtgagaggaaaacatggctggcaccatattgtgattattgtaatatagcctcagttcttaagaatacaactttttattggtttatctttgtatattgaaccagtgcagtgtgccaacttaa

SEQ ID NO: 116126 - DNA, 344 bp, Homo sapiens
tagttatttcaagtacgccaagtgcggtgactgcccgagggctcctgtcggcattgcagctgcatgcccgccctctgctggctgtcgggtgttttagcctcactgggctgtaaatgaggagcgctggcctcagtgtcacagtcattgcgccctttttcctgtgcacgctcttcacttctgtattttttattccaaatatttaaaaagtgggtttaatcatttcagagacctcttcaaatgagtaggaatctacaaaaagtaaaattttgtattcagccaaaagaaagattgtaatattcttctggaggattacgtaaattatttaattttttaatttaaaattt

SEQ ID NO: 116127 - DNA, 437 bp, Homo sapiens
tatagaggatctgcccctggtatacccatcctacagacacttgacctgaaatagggggcaacagagaccagaaaagggagcagctgacagcagggatttgagatcaagagaggtcctggctttaggactgattggtccgcactcaccactgtgttggagtgtaccagagggcaagtcaggaagaccagagatgcagtcaggtttgagcaacagtcgggtcattgaaggtgaaaggagttggacgaagggcaggctcactgggctgaatgagggcagagagccttggaggctcgggtagggcgtccacgctctcgccggaatgtgtagatacatcctggaaagagatgctctctgagatacatcctgtagccctatttgccatgagactttctggcaccttttagtactactttttgccaggggtgggatacaatcct

SEQ ID NO: 116128 - DNA, 538 bp, Homo sapiens
gtactgtcgttattttaaagacctagaatctgaggcaaaaaaagggttacaagacttgtcaaagtcacttgaactcaggcgttcgagaccagcctgggcaacacagggagaccccgtttctacaaaaaatacaaaaattagccaggcatggtggtgcagctactcaggagtgggaggaaagcttaagcctagaagattgagactgtagtgaacaatgatgggtggcaccactgcactccagcctgggtgacagagtgagactctgtctcaaaaagaaagtaaaaatcataatgccccgatctatgggggcactatgggatatgtacttgccccattacaagaacattccattgatgaacatactccttcctgaggttttgaaagaatttaagaaattacttcaaaaatatggaaagcactctgctgcatggtggtaaatcaaaaacgttcctttgaggtacatttttcttatacctaaaatatcatttttaagaaactagcatagaatagaggatgcgaaccaaactctgggaatcct

SEQ ID NO: 116129 - DNA, 307 bp, Homo sapiens
ctcaacttgtggccctagagttcaaaaacaccagcaggcatgaagccaaggcttcaccagtaacttttgcagctcagcacttgactagaaaaaagtgtcctcactgggtaattttccccccaatgaaaacctggcagagttctcctttttcacctgccttggttggatacccttgtagatcaagttcaggaagcagttcttaaacaacaacaaggccatgtcataggtgatgggtaagaagaggttattttttccctatttaaaaagaggctacttttagcggggaaaccaacccttttaataaaaa

SEQ ID NO: 116130 - DNA, 564 bp, Homo sapiens
ccccttcccaccattagcccacactagagcaattctttaagcattcaataatcagaacccacatagaatgttaattgcctcacatctggtaaccagagagttattctgtcctctggatagtgtaccctatgtttttattagcttttagtgcccacgatatttgcacttattctacttacagcagctacaaccctaagatgtgatttttcattcatcctgttcccctgaaatgattttggtttggccacgaacagaggacttcacatatatcatttatttatttgtttcatgaatacttttaagaatgcagtctgcataatggaaacagttcctgcctttaagagacttggaagttaataagaggactgaccaaggtcaccaagacatccaatatgaggcagtggtgtgagataggtggcactcgagggcagacttggtgcttatttgattttgggggactgggaacttcttcatgaaggaagtaacttttgagttgagccaaacaggatgaataggatgttcagaaacaggtgggagacaggccggcaccatcttagcctgttc

SEQ ID NO: 116131 - DNA, 584 bp, Homo sapiens
ctcgtttggccatccgaacagcaccgtgggtggctttactgagcaccatttaagttaaatcttcacccaagggactattttgacgctaatccttatttttctgaggaatctttaccaccaattaaaaaagaagagaagaagaaaacaatttcaaatacttttaaaccgtcttctcctggtaaaaagcctggtggaatgaaggcaggaacatttgatccttacccatcacattctgctgacccttatgtggctaaattggcaaatatttctggcaaagatgataagattttccacccaccaagtggaccaaaaagcagaccagttgaaagtataatgactttgaatgtcagaagggcactaaattcaaagaactacaagacttcttcagtaccatcctattagcaactggaagacaagtagctttctagatcttaactatgagtaattcactatcaagagctaattatttgaaaaaatataagatgttatggagcagatagctcaagcagttaaaagaaattctgcaactctaattctcttccttattttaatactactacttaataaatagtatttgctaataa

SEQ ID NO: 116132 - DNA, 388 bp, Homo sapiens
aaaagcctaggaggttgaggttgcagtgaactgtgattgcaccactgcactccagcctgggcaacagagcgagacccggtcttaaaaaaaaaaaaagaatgtacaggtatttgacttgcacctataaaattaatgtgtgtttattttccaattttagggcactaaattcaaagaactacaagacttcttcagtaccatcctattagcaactggaagacaagtagctttctagatcttaactatgagtaattcactatcaagagctaattatttgaaaaaatataagatgttatggagcagatagctcaagcagttaaaagaaattctgcaactctaattctcttccttattttaatactactacttaataaatagtatttgctaataa

SEQ ID NO: 116133 - DNA, 443 bp, Homo sapiens
cccaggcgtgtcgcgcgcttgggaaccctcgccgctcccgcagcgcagttaacgtggacaagctggggcaacctggacgagctggggcaacctgatctcggctgtcggagtgggtgtcctcaagaaaggtgacttggtcctcgcggacgccaggtgttgccccttagatacctgccacctcccagcctccgtttcctctctgggaaacagactcctcatcacctcctccagttttctgccccttcttcacctctcctgacgctccatccgtaccttttgcaagggaacgtgccataattcggctatgctctattttcttgtctaatagattgtaagctccttgcgggcagcatctatgccttcttaaatctgtttctagtttctaccagcaagcttgccccgaaggggattgcagaatatctgttaaataagtgaatgaataa

SEQ ID NO: 116134 - DNA, 361 bp, Homo sapiens
acaaaaaattagccaggcatggtggcatgcacctgtagtcccacctcccaagtagctgggatgacaggcacaggccaccacgcccggctagttttttgtgtttttagtagagatgggtttcgccatgttgggcactaaattcaaagaactacaagacttcttcagtaccatcctattagcaactggaagacaagtagctttctagatcttaactatgagtaattcactatcaagagctaattatttgaaaaaatataagatgttatggagcagatagctcaagcagttaaaagaaattctgcaactctaattctcttccttattttaatactactacttaataaatagtatttgctaataa

SEQ ID NO: 116135 - DNA, 1805 bp, Homo sapiens
  misc_feature (1805)..(1805): n is a, c, g, or t
cccaggcgtgtcgcgcgcttgggaaccctcgccgctcccgcagcgcagttaacgtggacaagctggggcaacctggacgagctggggcaacctgatctcggctgtcggagtgggtgtcctcaagaaaggactttgctataaaacacgtgaccctagggaaacttttgaagttagcggtatagagagtaccaccaccagacgccaccatgcctgcggaaggaggaaaaacggacatggaaaggattggcctctttagtgagatggaatatattactgtgggtgataaatatgtgtcacaatttaatcatgtggcttaggaagctactatggaacaataggtggtccagtcccatttttcagcgcacagtcaaaacctcgagaaaaatacaaggcacctggaaagaatttatacacaaacccgggaaagaaaggaactggatatggaaagcgaatgaagagcaccatcgtttacttaaaggagcaccatttaagttaaatcttcacccaagggactattttgacgctaatccttatttttctgaggaatctttaccaccaattaaaaaagaagagaagaagaaaacaatttcaaatacttttaaaccgtcttctcctggtaaaaagcctggtggaatgaaggcaggaacatttgatccttacccatcacattctgctgacccttatgtggctaaattggcaaatatttctggcaaagatgataagattttccacccaccaagtggaccaaaaagcagaccagttgaaagtataatgactttgaatgtcagaagggcactaaattcaaagaactacaagacttcttcagtaccatcctattagcaactggaagacaagtagctttctagatcttaactatgagtaattcactatcaagagctaattatttgaaaaaatataagatgttatggagcagatagctcaagcagttaaaagaaattctgcaactctaattctcttccttattttaatactactacttaataaatagtatttgctaataaaaaaaacaaaaaacacccaaaaaccccaaaaaacacacccccccccccaaaaaaaaaccaaacaaaaaacaaaaccaaaacccgcccccttgcgcccgagggggggccctcggggccgttttctttataggaggggaaaacaaaaaacccccccccactccctccttgcccccgcccctcggttgggggaaccggttttatcttctctaagggcgggatacgggtgtccctcaccaccgcgggatacatcgcgcaaaaaacacgggcgcaacgcgtcccaaaagcgctcgacatccctcgagcgcggggtgtgggggtttttaatagtcttcgccctgcagagattcaaaaatgcgctttatttaggtggggcccccccgggacttttgaccccgcccccccgggaaattctttggccttccgcccaccctgcgcttcgagaacgttttgtttttcttggagagggggttctcaattagcgtggttctatatgggggggttgttccggtgggggcgagacccccccgcccaggtctctttcacacaccccgttgccacccttaaaataactcccgcgccgcctcggacgatagccggcgttgtcgttctacgcttacgcgccacaccccacaacaaaatcgttcgtcgcggcacctcgcctacttcgtgcaactacattcgagttgaccggacacgcattataggacttgctcgcgcgcatacttgtttcgcacctcactcgcgcccgccgctggcctgtcgctctcatcgtgtgcgccatcn

SEQ ID NO: 116136 - DNA, 443 bp, Homo sapiens
  misc_feature (33)..(33): n is a, c, g, or t
attaaagtatctcacttatacccttctttattnatataattatcacctggtggaatgaaggcaggaacatttgatccttacccatcacattctgctgacccttatgtggctaaattggcaaatatttctggcaaagatgataagattttccacccaccaagtggaccaaaaagcagaccagttgaaagtataatgactttgaatgtcagaagggcactaaattcaaagaactacaagacttcttcagtaccatcctattagcaactggaagacaagtagctttctagatcttaactatgagtaattcactatcaagagctaattatttgaaaaaatataagatgttatggagcagatagctcaagcagttaaaagaaattctgcaactctaattctcttccttattttaatactactacttaataaatagtatttgctaataa

SEQ ID NO: 116137 - DNA, 1022 bp, Homo sapiens
cccaggcgtgtcgcgcgcttgggaaccctcgccgctcccgcagcgcagttaacgtggacaagctggggcaacctggacgagctggggcaacctgatctcggctgtcggagtgggtgtcctcaagaaaggactttgctataaaacacgtgaccctagggaaacttttgaagttagcggtatagagagtaccaccaccagacgccaccatgcctgcggaaggaggaaaaacggacatggaaaggattggcctctttagtgagatggaatatattactgtgggtgataaatatgtgtcacaatttaatcatgtggcttaggaagctactatggaacaataggtggtccagtcccatttttcagcgcacagtcaaaacctcgagaaaaatacaaggcacctggaaagaatttatacacaaacccgggaaagaaaggaactggatatggaaagcgaatgaagagcaccatcgtttacttaaaggagcaccatttaagttaaatcttcacccaagggactattttgacgctaatccttatttttctgaggaatctttaccaccaattaaaaaagaagagaagaagaaaacaatttcaaatacttttaaaccgtcttctcctggtaaaaagcctggtggaatgaaggcaggaacatttgatccttacccatcacattctgctgacccttatgtggctaaattggcaaatatttctggcaaagatgataagattttccacccaccaagtggaccaaaaagcagaccagttgaaagtataatgactttgaatgtcagaagggcactaaattcaaagaactacaagacttcttcagtaccatcctattagcaactggaagacaagtagctttctagatcttaactatgagtaattcactatcaagagctaattatttgaaaaaatataagatgttatggagcagatagctcaagcagttaaaagaaattctgcaactctaattctcttccttattttaatactactacttaataaatagtatttgctaataa

SEQ ID NO: 116138 - DNA, 907 bp, Homo sapiens
gggccagagcttgcggggcgcacagagcccccaggcctcatggcgcagaaacctctcagcaccgcggcggctgaacgcatgaaccttgtgggtcaggatgagatctggaaataccgtctgaaggctgaatcggaagcacggcagaactggccccagaactgggggtttttaacaaccccttttgaggagttgatcaagtgtgaagaagatctccccaccccaaagcccaaaatcgagcttcctgagcgtttccgcatccggccggtgaccccagtggagaagtacatcaaggtctttccatcccccccagtcccacagaccacccagggcttcatcggctggagatctgcagtgccaggcctgaacaagtgcctagagctcgacgatgcgatcagaagctgcaaaggtgcttttgcacgagagctgtgctggcccaagcagggcgtgcactgaatccagacggagttctgcccaggggtgctgcatatcggtcaccaggcacccagggccatgccagggaaaggaagagctcccctgaatcccgaggacacagtcccctgcgtacttgctcatgggatgttgcaaagaacacaaagtgtgccttagacattctcaagtcatcagcgtcacccttccagaatgttcacgtccacacccattcttggctaatgtaatgaataaggcttctctcatttgtttttgataccttgggaatttctatgcagggctttaaaaaaaaataagtgattcaattttaaaaatatttgtctaggtccttcaatgtagcttttcattgcacctatcatcatccttatttataacgaacttgttgatcaggtgtttctctatccagatatccctgggcctgtttttcaggaagaagaatacacttagagaatcccttggc

SEQ ID NO: 116139 - DNA, 253 bp, Homo sapiens
gcctcagtgatcttgttaatattcgatttcttgagctgtatattatttaaatttttttatacacacatgtatgtgtataattcacatgtataacatataattatgcatataagtcacacactctttggcattatttattttatgataaaatgttaaattctaaaataggcttcagtgcaccaggcttcagtgcctgaccgggcttcagtgcctgaccaggcttcagtgcctgaccaggcttcagtgcctgacc

SEQ ID NO: 116140 - DNA, 473 bp, Homo sapiens
aataataatatatattttttttttttgagacaggtctccctttgtcatccaggctggagtgcagtggcaccagtctccactcactgcaacctctgtctcccgagttaaagcaatttctctgccttaacctcccgagtagctgggatacaggcatgccccaccacacctggctaatttttgtatttttagtagagacagggtttcaccatgttggccaggctggtcttgaactggcctcaagtgacctgaccacttcggcctcccaaagtgttgggattacaggcgtgacaactgcgcccagccaaatggtaataattattatatctaagaaagagtaaacaggtgtctactgtgttagtcttttgaattttctgtacatctgaaacattttcaaaataaaaactggggagtcagaattagatttttaatattattgtaggaggttgataggttcttttctgtttcatcctgcc

SEQ ID NO: 116141 - DNA, 741 bp, Homo sapiens
ggcaagagagaaaagccagagtggctggtggatgcggggagtcacagctccgagtgggaggagggcgctgagggctctaggagagggtatgggcaggtgtatgaatgtgcagcctctggagtgggtagagtggttttctggaatgcccggggactggataaaaaggtagagatgtaaaggcttttaaagttctagaggccacggagctttccagccaggacggtgaacttggccctcaagggagggcagcacagagaggaaggccctgagctggagagagaggaggcgggtggtgatggggagagcccggctgctgctcggcccagaggaggaagggtacgttcgggagaggatgaagacttgggagtggtgtgtttgctgtagacaatttccagagcaagaaggcaggctgggagcaggggccgggggtaaaaggcagatagcaaggtaaggaggtgtgggggaagaccagcggctgtgctcaccgtggttagtgacactgtcaccatccagccccggtcagacatggtcctatagctgagggtctcaccaggcagtgggggcacaggtcaggggaatgggatcgccagaggagcattctcaaaatgtgcctgtgcaggcatctcccacccctgacattctgcatgggaggaccagggggtggccaccctacatgcagcagacccctggtggtcattctcctctcagcctcccgtcctcccctccccacctcaccacccc

SEQ ID NO: 116142 - DNA, 535 bp, Homo sapiens
agaggcatggtggcaaccacaaggtggccaagacaatttgtctccagttggatgggatgtctgtctggacatagtctgtgcttgcattggttgcaattctgatggatggacatagataccttggccttggacaatttgggctgactgtggagcatctgtgggtcctgtggctggcagtggaggcggtaaggagatgactagcagtgagctgccctgaggcccccttgtctaccgcctctcgtctcaaagtcctcatcctcctgtacacatgactgcatggacagccagtaggtgctttcttcttcagtttcttgaaacttgaacagtcatctgttttgctgatagattaagtttgttaaaaccctgccttgtccaagggcagtggttcatgcctgtaatctcagcactttgggagaccaaggtgggaggatcacttgagcctaggaagtcgactctgtttttataattctaccatccgctctccaccatggagccagactgacctttggaaaacatccccccacccctcaccgcc

SEQ ID NO: 116143 - DNA, 539 bp, Homo sapiens
acctctttaaatttctttattgtgtctgagtttgtctacatcttaccctccatatagagacatttacttttggtatttgttaagatagttcacctgatctgtccttttacattcttgctaatactggttaattaagctgaaagcaatggtcagaaatggtttcccgacaagttctttttttgagacttgccataccataaaagtcgtgctagaaaaaccacagaaacagcttaatggcaatgccggcttgcctcactgggagggtgctaggggaagaattacacatccacttcatgccactgacatgcactttatactacaacaaccgggccaggcatggtggctcacgcctgtaatcccagcactttgggaggccgaggcgggcggatcacgaggtcgggagttcgggatcagcctgaccggcgtggtgaaaccccatctctactaaaaatacaaaaattagctgggtgtggtggcacacgcctgtagtcccagctactcgggaggctgaggcaggagaatcgcttgaacccgggagt

SEQ ID NO: 116144 - DNA, 442 bp, Homo sapiens
aacagattagagtccaaaggagcttttgtgctaagcctgcttctggtattaagaccccagaagacctaggttggttgctagaaatcactggatctcacccatttaaatagatcctaagacttgatttcttgtcaaagaaaggtgctcagcgctctgtgaaatccgcaacctctatcgtaaaactggctcatctactcgcttcttctctagtcttaggcctctcctcaccccgcaagtagctctttcaggcaatgaaacctcttgacattttccagattcctggtggggccaagcaagtattcctgcttcccacatgagatattacagattcctgccccacagtctgtgccggctgggtgcaccctctgtgttggcacttactacatggcaaaaacctagttttcctttatttgggtcacatgccaccctatcaagtcaccag

SEQ ID NO: 116145 - DNA, 457 bp, Homo sapiens
tataagatacattccaaggctgggcacggtgtctacaaaaaatacaaaaatttgccagtcgtggtggtgcgttcctgtagtcgcagctactctggaggtgggagaattacttgagcccaggaggcagaggttgcagcaagccacgatcgtgccactgcactccagcctgggtgacagagcgagacactgtcccaaaaaagaaaaaaaattattttatagtccacagtaacagccagcatttactgagagcttatgtgtgcaaatcactagggtaacaacttcctcgtgttatagacactcatgggcctatgttatcatcctcattttacaaaaggggaaattgagccccagagagatgaattcacctagttacacaacacaaaatagtaactgtctcagctgggactcaaacccaggcagcggagagtagccaaagacgagcagagaccaggtccca

SEQ ID NO: 116146 - DNA, 700 bp, Homo sapiens
gagaggtttctgtatggaactgagctcaacttctaatacagcaaagacagttgtggatttatagccaaggagtagagcaaggtggtaagcagatggaaatttactaagaacttacctagatatcaaaggtagagggattcttgctaaactggcttaataaaattattttaaataataaaactgttaattaataaaactattaataataaaactactttctaaaactaagatatccagagtggagagtgagaaacttgatcaaatatccagtagtctaatatcaagaattagtaaattcttgataaattcgctaagcaggaatctttactaaaactcggctgggcaggccaaggtcaaagtctacttaggaagaatgctccaaggagcctaactcaagtttggtcaagggaagagtctttttcagtggataattgtgaactattttcatacacactatttcgtagcagactaatagatcttatgaatatacatctcattatttttgcagtaataaacatccctataataaaactcactgtagcaaaaaataaacatgctcattaacacacccaaatatataggctctccgtattatataaaaaataagcagcaaaaagtctacaagcagaaaattatacttagtaattaatgcttcagtattttattatagttagataatctaggtatctaatgaatgccc

SEQ ID NO: 116147 - DNA, 860 bp, Homo sapiens
agcggggggacagggaagactgaaaacggacatgagggaacttgctgggagaattgttttcttccttgctcctaaatcacagaggagatagtccataaccagtgagctgggccagaagctaagtacttttatccctcttcccaaactggaaataatgcttttctttggctacctaacagtgcagtggcaaaaggttcagattcggttttcaggctcagagtagaatgagcaaaaaccaatgacatttccacttttccaactataatgctgaaaaaaatagctgctgcactgtatcttttaagagtgttgtggataccagctattgtgggtttgttcaactcccaacccctggcaactcagaatatgactttaactggagatagactctttacagaggtaattaaaatgaggtcattagggtgggccctaatacagtatgactggtgtccttacaagaagaaatttgcaaaaagacatggacagagggaaaactaaagggagaagacagcgattttgcaagccagagagagataccctgaacagatccttaccctctcagccttccaaaggaatcaatcctgacggcaccttgatctcagacttacaggctccagaactttgagtaaataaatttctattgtttaagcaacccagtttgtagtacttgttacagcagccccaccaaagtaatgtaccagcactgaagtcaaaaagaagagacacatactttagggttcattcttaatggcagaaacatcagaacggtgttttctagtaaggagagtattttttataaaaggccaatcgaatgaatttttgacaaatgccttccacaatgcagtcatttaaggacttaatac

SEQ ID NO: 116148 - DNA, 343 bp, Homo sapiens
atttcagagtagtcagttattacttcctttaactgaaaatattttttgacattaaattcatatctatcttacttattttttagaaagttaacagaacaaatctccaaaatcacaaaaatagttgatctagcaaggcaatacttgcattatactacttaaattaaatgtaaaacagcatcaaaattttactttgtaaatattttagccatagtcaaagtataaactctgatttagggatgcttttgtattgatgataagatgttaagaattagaagagaccttaaacctgtatatatgacagtggtaattggactaattgattgcaacatcttctttcaaataa

SEQ ID NO: 116149 - DNA, 182 bp, Homo sapiens
aaaaatccacagaagagtcaaatgcattttggttaaatcttctttcaaaactcagagatctttttttcctccttaactctcggtaggaagtgatctccatgccgcacgaacagcatggaaatccacggctttaaaagaaccttgccataaaatgagaaaacctctccaaatgactaatcttt

SEQ ID NO: 116150 - DNA, 564 bp, Homo sapiens
atgtttgatattgcccatcaattgttaactcattttatctagataggcatgtgaaattatctaggaaatcaaaggattgcagatggaatcagaaccacgttgccacagtttcattctggctttagccttgagtacagtatggactgaatggagactactaggctctcagccatctgctgtgttctggtagtgctctacaatcatgtgtctctactacttctttgcaatgtaaatactagtgtaaaactactcagccacaagctctgagagagatcgagagatgttcttctcttaatagaaataagtcatttggtggaataactcttcgagtcaaccagtgtaagtaacagagacaccaaaaactagccattagtttagtttgcttgacccagcaatctacctcttagtatatgctttggtgacactcatgtacttatgcaccaggtggcaggtgtgtactagaattaagatattcatagtagcattgtttcagatagtaaaaaagtgttatccacaaaaaaatggatgaattatcagtgaaaattactgaactttggacacaca

SEQ ID NO: 116151 - DNA, 337 bp, Homo sapiens
aaacagaaccccgacatcatgcaagtctgatgataagcacgctctgcaaatgtattaccaagatcagcagcatcttcaacgttgcttgtctcaaacagtaacactctaaagggatgcacgatcttttcttttatacaacagacagtgcttccatctagagggtcactgcctgagatcttcttttttttgacacggagtctcactctgccgcccaggctggatgcggtggtgggatctcggctcatggcaacttctgcctcctgggttcaagcgattcttctgcgtcagcctcctgagtagctgggattagaggcacccaccaccatgcatattgcat

SEQ ID NO: 116152 - DNA, 651 bp, Homo sapiens
tgtataaaaagccagctaggagtaagaattagaaatgagctttctcaggggcattttcaccattaattatctagagttttttttttgttttttcagagtagtagccattctctttgtttatcttaatgagcccagttatgccatctggtggccaaaataaattgaaaacatgcaactatgctgtcagaaagtgtgaacgtgtcctttttagagttattccctttcaccccttagttttctccccattttccatgagcatctatcactcactacataaggagtaccagggcattgatcttgatggtgcctgtttccctgcatggaaaggtaagaaagtttggtcttggtacaagtgaaactggttaagatcaaaagaaaaagaaggacaagttagggacaggacccttgcccatgtccaaaggaacagaataatgtttccagaagaaagagcaagagcagaagccagtgcccccagcttatcagtaagcagcatggaatttgactaggaaacagcagaacggccactgctaagtgggaatcaccataacacctgaaaaaaataataataacagcaagagtagctgctccaaatgtgttcaaacctcctggtctgaatggattacattcctaagtaccaaaaataaaaattaa

SEQ ID NO: 116153 - DNA, 179 bp, Homo sapiens
aagtaccttccacctttttttaaggttgtggcaatataacaacagagaacactggtggccagggtcctaagggaaggtttgatgctgcttgtaagttctgataccttccaaaattcataatactgagagtatattgaaagacaggccgggcgatgtggctaacccctgtcatcccagca

SEQ ID NO: 116154 - DNA, 548 bp, Homo sapiens
tgggcacccatctgtgcctgcgccctaatagatctggcactccctatgagatgaacccggtacctcagatggaaatgcagaaatcacccgtcttctgcgtcgctcacgctgggagctgtagagcggagctgttcctattcggccatcttggctcctccggcttacattcttgtatagggattactttcctcactttgttatatatcctggaagctatgaacaatgatgcttcttcatactcttcaacctcatcatgataccttgcacgaagcaggagctcaactaatttgggttgaggccagaatgccaatagtgagcaaaaaaggatgatatttgacacttggcattgaatatctgaatcatgatgtccacataactacagctatgcaccacataatgatgttttactcaacaacagaccacatatacaatggtggtttcataaggctataaaggagctgaaaatttcttaccacctcatgtcctcatgtcatagtgcaacatattgctcttgtgtttgcagtgatgctggcataaacaaacccact

SEQ ID NO: 116155 - DNA, 139 bp, Homo sapiens
gggagggcaaaagtttccttggtcatgggctgaggcccaggcaggtgagcaatgtcaaggtgactgtagggagtgggctttctgcaggcgggtggagggcgacaggagggtgtgccagctgtcagcccgcatgacagtt

SEQ ID NO: 116156 - DNA, 748 bp, Homo sapiens
cgggaaagcatctctgagagggacccaggtcctacccgtcaggtgagcgcccagcaacctgagcattgtgggcgcgtgtctgcctttgagccacggccggtcagggaggggacgcaggagagctctgtgtcccctgcctgcccacccactaagttcacaaagcactcactgtcccatcaggttgtgacaaccccatgtgttcaagaagccatttactttgagagacctctgtgggctgtggatgaggcttttgctaagtcctttttactcgtcaaacagatgggtttgctgggctgttacaccctgggcaccagggttctagccacgaaagagacactctctcttccctcgccatgtcttacaaaattgtgggtccagacaagtcagcaggcaggggctggactgtgacaagagccctggcaaagcgtggacggcattgtttctgggagcactgcagagggaggtttctccagagggggcagcagagcagaggtcggaaggtgtggagtcagccaggcccaggactgcgcaaaagtgctcctagcggcgaaccacaaccagcagtcgggaggcagtgaggacgtgggggtgcatcagtgtggctggggagcgtcgggaccctctgcagtatccagagatgcctcagggacgccaccctccccaggaaggctggatgctgtggtgccagcaggcccctttctcttcgctctgaccctccaggagttgaacctcctctttctagttcata

SEQ ID NO: 116157 - DNA, 258 bp, Homo sapiens
agcgcccggggagcgcgcccgggtagccaagagggaggagcgcggggagcgccgacagccgcccgcccgcccgcccccgcgacgcccgcgcgcaacagttcccccaaagttgcagcccgggaggcgagcgcgcacgggcggccgaggggcgggcggttggcggggacgcggcctcgcggcccagagcggagagtcccggcgggcggcggcggcatgggcacccggcagaccaagggcagcctggcggagagagccagc

SEQ ID NO: 116158 - DNA, 255 bp, Homo sapiens
cggtgtagtctcagctactcgggagactgatgcagaagaactgcctaaacccaggaggtggaggttgctgtgagttcccacaactgcactccaggctgggcaatagagtgagatcctgtctcaaaaaatgaaaaacatttttgctctacaagattacatttaattggcaactacctagctttgaaccagcaaggggaaaagtaacagaacggcatgtctgtctcactaacttcttgtttttttgagacaggttct

SEQ ID NO: 116159 - DNA, 869 bp, Homo sapiens
agcgggcggaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcaggggcagcagaggcagtggctggagtggccccttcggccatcagggaccgagagcagcaggctcccgtgaaccaccactctgctttaaaataaagaacaatatggttggtgtggtcattggttacagtggatcaaaaataaaagatctacaacattcgacaaacactaaaatacagatcataaacggggaatctgaagcaaaagtcagaatttttggcaatagggaaatgaaagcaaaggccaaagcggctatagaaacacttattagaaaacaagaaagctacaactcagaatccagtgtggataatgctgcatcccaaacccctattggaagaaatctaggcagaaatgacattgttggagaagctgagccattgtcaaattgggatcgcattagggcagcagtcgtggagtgcgaaaagagaaaatgggcagatctaccaccagttaagaaaaacttttacatagaatccaaagcaacaagctgcatgtctgaaatgcaggtgattactggagaaaggaaaatttcaacataacgtgtgatgacttgaaaagtggtgaaaagcgtctcatttcaaaaccaacttgcaggtttaaagacgcttttcagcaataccctgatcttctgaaagctataagggtagggattgtaaagccaacgccaattcagtcacaggcatggccaattattctacaaggaata

SEQ ID NO: 116160 - DNA, 396 bp, Homo sapiens
tgatctagaggacctggctcagtggtccagtgggtgacaagtcagtgggtgacatccaagccgggcctcagctggacctcgggattggagcggggcctactcttaggggtgcaagcagtgagaggctgggacttgggctatggcgggggcattctgtgggccctgttctcggtagggggtcactgccttttccctggggttttcccacatgttgtgccttcctgaaagcacttctcctttcctgggctccgtcctgactcagcagtgccctgataccctgtggtaagcaggcaggcagggagcagccaggagacttcctggagaaggtggctagaatttcccagatgcttccgagaggcccctgtgttccaccttcgtgagacacggtcccttccc

SEQ ID NO: 116161 - DNA, 194 bp, Homo sapiens
gtggtcttcttcccccaagccattcccttgatacttggtgtcagtgccttctcccaccttgatcttggctttcccttcaccacctccatcattcgcttcctctccattggatcccattagcttacatacatgctcgggtatcaccgtgactccatatcctgccccagtctctgccctccatcgtgccaagccag

SEQ ID NO: 116162 - DNA, 404 bp, Homo sapiens
gggctttaaaaaaatgaaaattgacaaagtaatacaataacaatgtcatgtgattattccagtggaagagaaaggatttatgaagtcacctcacatctgcatccattcggtcattgtctgttttatcccagaatgtctcttaagttattctcatctgtagttcatgcctgctttgtagcttctgaccgttctaaccaaacacccatttacaatggtatgcagttggtcctccatattcacagcttctgcacctgcagattcaaccaactatggattgaaaatatcttttttaaaaaatgataaacagtaaaaaataatagaaagttgaaaacaatgcagtgtaacaattatttacatagcatttacaggcatacttcattttattgtactttgcacatattgct

SEQ ID NO: 116163 - DNA, 406 bp, Homo sapiens
ggagacggctggtgggaagacaggcaggtgcctgagagcctgagctgtccatgctcctggggggccgagatgcttcccagggatggatggggaaatgggaaggagacagtgtggattccgaggtcccagctggcattccagctctgtctgagtgctccctgtacacggagcgtcacacccactcacacggtgtctgtggggcacgagaagagacctgtgtcagcagcagcctcagagccacgagtgggcttcaacaagtggaaggagccgaggggggagatggcaaaggcctgtgagatgcaaacctctggggaagaatgacgacccctccagggatgcgcctccctgtccccagaggcttcatcctagggaggccctccaggagtcctcccgccctctcacagag

SEQ ID NO: 116164 - DNA, 319 bp, Homo sapiens
tgtgtgtgtgtgtgtgtttcttttaaaagtctcttcccctgaaaatacttcatgttgatatttcttcttaaagatgctgtaattatgagagagcagaaagaacccccgaatgactgtataacttgaaatattacaagcacagtcaccccacttccccactccgcggggaaatttacaggcttccaggctgccaccaagagggaaggactagagcccagcagctctcagagttcttggagttctcggcctccgaagcacactgtccagccacctgcacaaagtccatcataaacccatgcggggcacaatgggagtagct

SEQ ID NO: 116165 - DNA, 200 bp, Homo sapiens
gtagacggggtggggtgtaatccttgctccagatcctagagttcaggactgctgtgccagggtgaccttatgtgtgtcaagtagatatagttatatgaagccatggtttgtaacctttatggggccgtagatacctgggagactgaaattcattgccctcctctctgaacactgcacattcacatgtattcaaataattg

SEQ ID NO: 116166 - DNA, 165 bp, Homo sapiens
agtgctctcatctctctaaggccaatctctctaaggcttggagaccagctaggattaagttcagctgcatgaaacagaaaaatctaacgtcctcgggctttttaccactggtatggtattcctcacataaaagcaatctggagacagccaagagcgactgacagg

SEQ ID NO: 116167 - DNA, 913 bp, Homo sapiens
tatgagagtattttgttgaaaaaaattagccaaagctttagcagaaaaacgcctgagagagcttcaccaaaacgtactctaccccaacaatgcagccaaggcccttcatcaaactagggcagttttgtaagaattttgatgggaaaatatgaggcatctaccttgcagccctgatttggctccttctgacttcgattcctaatcttaccaattttttttaagggcacccatttttcttctgttaatgtaaaaaagactgcattgacatagctaaattcccaggaccctcagttctttaggaatggactgaatgactggtattattgcttacaaaagtgtcttgatttggtggaacttacgttgagaagtaaactttatgttttttatcatttaattgtttttccacaaattttttgaagtcccttcatatatgtatgttttaaaagggctcaaatggaatagagtgaaatatctttctttttcccctcttccagagtgtactaatttttgtgtattctgttttagtttatttttaaaataatgtctagagggaacagatatttttatggaacatgaatgtttagccaagattctttatctgaaatccaggtaaaggtgtcaagtgtctgtggccttctaaagtgctgggatctacaggcgtgagccactgtgcctggccgacaatttacttgtcttagtatcatatgtcgatatgtgatttccgagacggtatttcagacctgaatttgactaacgacttacttatatactgagattcttacaaaattacgtacactgactaacctaggctggtggtcagggcctttaaattcattacggcggtctctggacacatcccttaaaccttacttctgccccattatgcacaacaagtcccccccaacagcaacct

SEQ ID NO: 116168 - DNA, 831 bp, Homo sapiens
tatgagagtattttgttgaaaaaaattagccaaagctttagcagaaaaacgcctgagagagcttcaccaaaacgtactctaccccaacaatgcagccaaggcccttcatcaaactagggcagttttgtaagaattttgatgggaaaatatgaggcatctaccttgcagccctgatttggctccttctgacttcgattcctaatcttaccaattttttttaagggcacccatttttcttctgttaatgtaaaaaagactgcattgacatagctaaattcccaggaccctcagttctttaggaatggactgaatgactggtattattgcttacaaaagtgtcttgatttggtggaacttacgttgagaagtaaactttatgttttttatcatttaattgtttttccacaaattttttgaagtcccttcatatatgtatgttttaaaagggctcaaatggaatagagtgaaatatctttctttttcccctcttccagagtgtactaatttttgtgtattctgttttagtttatttttaaaataatgtctagagggaacagatatttttatggaacatgaatgtttagccaagattctttatctgaaatccaggtaaaggtgttgtgtcttgtttttataaatcatttttatttcaacaaaatgttcagtataagaaattacttttaataattacgtcaaaacatgcagtaggtggacttttgagctaaccctggagaaggagctggatttcaccagttagcctcctatggatctgctaccatcatcaccctcccaccccacctccactgccttttttcccaagacttttaaaaa

SEQ ID NO: 116169 - DNA, 116 bp, Homo sapiens
ggtggcttgggcgagggaagctgggtgacagaggggaccatgccagagaggagacctacagagtgtggcttgggccaggggagctgggtgacagaggggatcatgtggcacggagg

SEQ ID NO: 116170 - DNA, 116 bp, Homo sapiens
aaaaacaaaacaaaacaaaaactgtcaaagactgccctgcatggttgttataaaaactggatcatgtcggccaggcgcggtggtcacgcctgtaatcccagcactttgggaggccg

SEQ ID NO: 116171 - DNA, 438 bp, Homo sapiens
atataaaagagaatatatttacatatatatgaaatataatttattaaggagaattggctcacataattacaaaggcaaagtcccacaataggccatctataagccggaaaatgagagaagcctaaagcatggctcccaaggaagccagtgacatggctcagtccaaatttgaaagtctcaaaaccagggaagctgacagtgcagccactagtctgaggccaaaggcctgagagctcccaaaaggctgctgatgcaagttccagggtccaaaggcaaaagaacctagagtttgatgtgcaagggcaagaggagaaaaaggcatactgctctggaagagagagaaagtgcataaaaaagaaatccaagcaagctgaatgttcccattcttctgcctttttgttctagccacacttgcaaccaattgcatgatgcctaccc

SEQ ID NO: 116172 - DNA, 901 bp, Homo sapiens
atagtatagatgaatgtgagtgatattgaagagcttattttttgtggtttatgtgtatgtctttattaatgaattactcaataaacaagtgtaggtaagaatgaagagaaagaaggccaatcctggactgttgatgacaagtggtggcttatgtggttgtacatgctggttgtatatgaagaatattacatatctgaaactttgaggtccaaacacaaatagaatctagttcattcccgtgtttaaagtgatgtaatagacagataccggaaatatacaaggagtttgtgattagtcttgtgagcatgaggtttaaaaagattgtaaaagtggcaatagcagaataagcaaatacatgtacaaataaaataaaacaaataaaaatgaagaggacaaagcattgttcattgctgaaatatgcagtaaggaaaatattgctaatgtacattggaatggataataaatggaccacgtgtataatatttctgactaaagatgatagagacaatggtaataattactgataagtaatagccagttattgccccaagtcaattacaagtttgaagtttataagaagaaaaataaataaaaaaaaaaaaaaaaaacactggtctgggcacgcatgggccccggaaaacgctcaaaaccatggtatagagcgcgcagcccagacagagtacgggcacacggcgctacaacagcggggtcccccaagggaaacaccctggtgcgaaggacaatgaaggcggggggaactccaccacgaattaaaaaaaacgcgccgcggaggacacaacagaagaggttctgcaacaaaaccccgagagagcactcgaaagggcacaacgggagcacttcaccaccagagcagcacaggagaccgccatattcaaatagg

SEQ ID NO: 116173 - DNA, 576 bp, Homo sapiens
gtgctctagaggatctcctccataatgtgtgcccacgagaaataatgaaaattgctgagactttttttaaccccagtaaactaagggatgaaggtcaaatcagaaacactctttaaacaggtgtgagttgattaaagggatgatggtgaccaggctggttcccaacttccccagtgctgagtgaaagaatacttgtagcgagagagaaattgttgtgaaacagaagttctgaaacaggaagaaatatggacacaatgtcacctgcctcttgcaaggctctaggagagatgctttcacagggtaaaatgaaagggaaaacaatttcaaatgtggtcattgtgacctgtaacatcttgggcacacattatggagatgtgtgcccagccaagggtttcattttgattgcattatcaagagatttggtgcttttaaaaaatggatagtgtccatttaagtgggtgtgagaggattttgtttctcattgtgattttaatgcatttctctacaaattagtaattttgtgtgtcctttcaaatgtttttttatttgtgtttttttatgaaaatttattttaat

SEQ ID NO: 116174 - DNA, 177 bp, Homo sapiens
ccccaccagaagacagccggttgaagagcagggatttgcttgtccgtttccctagaaactatgagaatcactggtgcagcgggcactgagctggcatctgctgagcggaggaggggcaggcggttccagcgaaggccggaggccggctgacctgggcgccctgtctggctctctcca

SEQ ID NO: 116175 - DNA, 328 bp, Homo sapiens
ggttgttatgaggattaaattagttgctttttgtaaagtctttggaacagtgtctagcacatagtgatttaagtgtttgctcttatgataattatgttcatgcatgaacacaaatcaatctaagggtgaatggcttttttattcatggattattcttgttaccactaacagataaatagctacatcttattccttcatttttacctccttctcattttctatagaaagctttttaataggccctcaaaaaatgcttattgaatactctatgtaaatggacagagttttagaaaacccaacctaaagaaattaaatgacttgggctggg

SEQ ID NO: 116176 - DNA, 196 bp, Homo sapiens
attcctcagggccttctattttcattctcaaaagccctttttttctcccaacaagtctccttatatatcaaaagctttggctttcaaagcttttgtttctcatgtgggctttaagaacatattttaggattcagaaaaactaaacatcgatttttttttgttctttttacatttctgctgtaactacatcagttct

SEQ ID NO: 116177 - DNA, 568 bp, Homo sapiens
caacaacaggagaggcaagcagagcacagtaggaactgaatggggtttgcgtgaaagaaaaatccagagaaaggtgtcctgcagaacgtgcacgagacggggcttcaccatgttggccagacatgttggccagacgggtcttgaactcctgacctcaactaatccacctgcttcggcctcccaaagtgctgggattacaggttgcctcccttgaacacacctgaatttgccaacatccctcttaaaaagaggcaccaagaggaatgcagaaggccagcatgcaatgctatagcccaagttccatgccagcacttgaactttgagatgctcttagcttttctagcagtcataaggcacttttgcccaagaccaagcttgcagtcagggaaagcctccaggtttttcgaaatggccttgaacaggttttaagccagctctcttgcttttaatcagaggtcatttggccaagttgcagcctgttgttccagcccaggatttctccacctaagcagatacttctaattggggagagtggagaagcggcaacttcaattgtcccccctgacat

SEQ ID NO: 116178 - DNA, 406 bp, Homo sapiens
caacaacaggagaggcaagcagagcacagtaggaactgaatggggtttgcgtgaaagaaaaatccagagaaaggtgtcctgcagaacgtgcacggtggagtctagttcctgtcccctagagtgtgggttagcgtttatgacggccttcatgaatgagtgcaatagaagtgacactgtatgatttctgaggctggatcataaaaggcgaaagagaaaccactgcaagctggcttttgggatgctcacctttggaacctggccgccatgttgtgagagagcccaggcctcgtggagaggccacaagtagatgttctggctgacagcaatcaacaattgccagataaacaactgaataagcattcagatgacatcagctcccaggccttggggattccagctaaggcct

SEQ ID NO: 116179 - DNA, 489 bp, Homo sapiens
ttgattcgttagcattttttagcaatgatgtatttctaaatcatggtaactatatttattttatatatacataattgctattgcactgcttaacagtactatggccaggccgtggtgggtcacgcctgtaatcccagcactttgggaggcagaggaggatgggtcaactgacgtcaggagatcgagaccatcctggctaacaaggtgaaacccctgtctctactaaaaatgcaaaaaattagctgggtgtggtggcatgcacctgtaatcccagctatttgggaggctgaggcaggagaatcatttgaacccgagagacggaggttgcagggagccaagatcgcaccactacaccccagcctgggtgaagatcgagactctgtctcaaaaaaaatgagtactccccacttgtgtgtatctgactacctggctctgatactaagccagtgaagagctttcctcatctacatctggtcttacaatagatgg

SEQ ID NO: 116180 - DNA, 2763 bp, Homo sapiens
tcccagttggggcccagccttttaaagccatcgctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccagaaaaaaaaaaaaaaaaaaaaaaacaccgagggaataaacagaacaggatagctggaaaacagagggtcactgaaattggccacattgttcacaagcatagctccctgacccagactctcagtttgttccaataggttgtgtagaactccttagccggtgtaccaccccttcaatacgttgcggtgtgcataaacttccgcgctaaggcccatgggttataacccttgtcaagtaaatagacatctcgtgctacacccaacacaccggcgacattatacaaccagctatcacaagagtcgcgctctactcgatagtatcatcgccacgtaaacc

SEQ ID NO: 116181 - DNA, 2429 bp, Homo sapiens
tcccagttggggcccagccttttaaagccatcgctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctccaacctttctttcttttttttc

SEQ ID NO: 116182 - DNA, 2837 bp, Homo sapiens
tcccagttggggcccagccttttaaagccatcgctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagggtctcaccagtcttgcctgaaactcttgggaaactggcttcctgaggcgtttctgttgtcattggggctatagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccagaaaaaaaaaaaaaaaaaaaaaaacaccgagggaataaacagaacaggatagctggaaaacagagggtcactgaaattggccacattgttcacaagcatagctccctgacccagactctcagtttgttccaataggttgtgtagaactccttagccggtgtaccaccccttcaatacgttgcggtgtgcataaacttccgcgctaaggcccatgggttataacccttgtcaagtaaatagacatctcgtgctacacccaacacaccggcgacattatacaaccagctatcacaagagtcgcgctctactcgatagtatcatcgccacgtaaacc

SEQ ID NO: 116183 - DNA, 2785 bp, Homo sapiens
cactcgggagtgggcaagagatatcgttacgcagctgctgtgtgcccgaccgaccctgtccgaaacccttcctatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagggtctcaccagtcttgcctgaaactcttgggaaactggcttcctgaggcgtttctgttgtcattggggctatagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccagaaaaaaaaaaaaaaaaaaaaaaacaccgagggaataaacagaacaggatagctggaaaacagagggtcactgaaattggccacattgttcacaagcatagctccctgacccagactctcagtttgttccaataggttgtgtagaactccttagccggtgtaccaccccttcaatacgttgcggtgtgcataaacttccgcgctaaggcccatgggttataacccttgtcaagtaaatagacatctcgtgctacacccaacacaccggcgacattatacaaccagctatcacaagagtcgcgctctactcgatagtatcatcgccacgtaaacc

SEQ ID NO: 116184 - DNA, 1796 bp, Homo sapiens
tgaagggccatccttgtgtcctgggctccactgcctctcccttcctcctcttcaggctggaccagaccctgagtgtgcgaggggaagatattggtgaagacctgttctctgaggccctgggccgggcagtggggcagtgggcgggggccaagctgctggaccatggctgtgtggagagcagcattctgggtgagcctccccaccggctcctgcctaccatccttgagctacccttcaactcctacctcccctgccaggggactgctaggaaagagataagcctcctttactactcctacaaaagtccttctctgcatctaactctcatccatcctgctgcagtctctacccattttctttcctgatctgtctcctatttaggatcaagctctaggttcctctccatttaccccacgtccccaccaagaaactcttttttccctatgaatctcagagtggggaagaacagatagggcagaggacactagacttggcagctgcccattcaccggaagtatgtgtgcacatggggtctattcacagattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccagaaaaaaaaaaaaaaaaaaaaaaacaccgagggaataaacagaacaggatagctggaaaacagagggtcactgaaattggccacattgttcacaagcatagctccctgacccagactctcagtttgttccaataggttgtgtagaactccttagccggtgtaccaccccttcaatacgttgcggtgtgcataaacttccgcgctaaggcccatgggttataacccttgtcaagtaaatagacatctcgtgctacacccaacacaccggcgacattatacaaccagctatcacaagagtcgcgctctactcgatagtatcatcgccacgtaaacc

SEQ ID NO: 116185 - DNA, 2031 bp, Homo sapiens
tcccagttggggcccagccttttaaagccatcgctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctgggtgagcctccccaccggctcctgcctaccatccttgagctacccttcaactcctacctcccctgccaggggactgctaggaaagagataagcctcctttactactcctacaaaagtccttctctgcatctaactctcatccatcctgctgcagtctctacccattttctttcctgatctgtctcctatttaggatcaagctctaggttcctctccatttaccccacgtccccaccaagaaactcttttttccctatgaatctcagagtggggaagaacagatagggcagaggacactagacttggcagctgcccattcaccggaagtatgtgtgcacatggggtctattcacagattcctctgcgggctctgctccccactacgaggtgtttgtggcgctgagggggctgaggaatctgtcagaggaaaatcgagacaaggtaaaggagacgaggacagggtctgactgtagaccccttcactctgcacactcccagggtgccatggagatcagggctgat

SEQ ID NO: 116186 - DNA, 2611 bp, Homo sapiens
ggacccgcgtcgccacgcgtcgagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccagaaaaaaaaaaaaaaaaaaaaaaacaccgagggaataaacagaacaggatagctggaaaacagagggtcactgaaattggccacattgttcacaagcatagctccctgacccagactctcagtttgttccaataggttgtgtagaactccttagccggtgtaccaccccttcaatacgttgcggtgtgcataaacttccgcgctaaggcccatgggttataacccttgtcaagtaaatagacatctcgtgctacacccaacacaccggcgacattatacaaccagctatcacaagagtcgcgctctactcgatagtatcatcgccacgtaaacc

SEQ ID NO: 116187 - DNA, 2852 bp, Homo sapiens
tcccagttggggcccagccttttaaagccatcgctccttctttctggccggatgtgtgctgagacccagagtcacccaggggtctccgtcacgtgccaggagtaggcagaagtgggctgtgacagatcaggaaacagagctcagtgcagcccactaaattgctcagggccctacagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctctgaccaaggccagccagacccagcaggaagacagtggagagcagccactgcccccgacctcaaaccaggaccttggggaggcctctctgcaggccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggagtggggaagaacagatagggcagaggacactagacttggcagctgcccattcaccggaagtatgtgtgcacatggggtctattcacagattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccagaaaaaaaaaaaaaaaaaaaaaaacaccgagggaataaacagaacaggatagctggaaaacagagggtcactgaaattggccacattgttcacaagcatagctccctgacccagactctcagtttgttccaataggttgtgtagaactccttagccggtgtaccaccccttcaatacgttgcggtgtgcataaacttccgcgctaaggcccatgggttataacccttgtcaagtaaatagacatctcgtgctacacccaacacaccggcgacattatacaaccagctatcacaagagtcgcgctctactcgatagtatcatcgccacgtaaacc

SEQ ID NO: 116188 - DNA, 2518 bp, Homo sapiens
ggacccgcgtcgccacgcgtcgagctaacaagcggcagaggcaggatctgcactcaggagctgcttggagatgctgctgtggccactgctgctgctgctgctgctgctgccaacattggccctgctcaggcagcagcggtcccaggatgccaggctgtcctggcttgctggcctccagcaccgagtggcatggggggccctggtctgggcagccacctggcagcggcggaggctggagcagagcacgctccatgtgcaccagagccagcagcaggccctgaggtggtgtctacagggagcccagcgcccccactgttccctcagaaggagcacagacataagcaccttccggaatcatctccctgccaccttgctgggtctggcagccctaaacaaggcctacccagaagtgctggctcagggacgcactgcccgtgtgacgcttacatccccttggccccgacccctgccttggcctgggaataccctgggccaggtgggcacccctggaaccaaggaccctagggccctgctgctggacgcactgaggtccccagggctgagggcactggaggctgggacggctgtcgaacttctggatgttttcttgggcctggagactgatggtgaagagctagctggggcgatagctgccgggaaccctggagcgcctctccgtgaacgggcagctgagctccgggaggccctagagcaggggccacggggactggcccttcggctctggccaaagctgcaggtggtggtgactctggatgcaggaggccaggccgaggctgtggctgccctcggggccttgtggtgccaaggactagccttcttctctcctgcttatgctgcctcgggaggggtgctgggcctaaacctacagccagagcagccccatgggctctaccttctgccccctggggccccctttatcgagctgctcccagtcaaggaaggcacccaggaggaagctgcctccaccctccttttggccgaggcccagcagggcaaggagtatgagctggtgctgacggaccgcgccagcctcaccaggtgccgcctgggtgatgtggtgcgagtggttggtgcctacaatcagtgtccagtcgtcaggttcatctgcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctggtggggcagggagccttccgagcactccgggcagccctcgctgcctgcccctcctcccccttcccccctgcgatgccccgggtccttcggcacaggcacctggcccagtgtctgcaggagagggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccagaaaaaaaaaaaaaaaaaaaaaaacaccgagggaataaacagaacaggatagctggaaaacagagggtcactgaaattggccacattgttcacaagcatagctccctgacccagactctcagtttgttccaataggttgtgtagaactccttagccggtgtaccaccccttcaatacgttgcggtgtgcataaacttccgcgctaaggcccatgggttataacccttgtcaagtaaatagacatctcgtgctacacccaacacaccggcgacattatacaaccagctatcacaagagtcgcgctctactcgatagtatcatcgccacgtaaacc

SEQ ID NO: 116189 - DNA, 1320 bp, Homo sapiens
tgaagggccatccttgtgtcctgggctccactgcctctcccttcctcctcttcaggctggaccagaccctgagtgtgcgaggggaagatattggtgaagacctgttctctgaggccctgggccgggcagtggggcagtgggcgggggccaagctgctggaccatggctgtgtggagagcagcattctggattcctctgcgggctctgctccccactacgaggtgtttgtggcgctgagggggctgaggaatctgtcagaggaaaatcgagacaagctggaccactgccttcaggaagcctctccccgctacaagtccctgcggttctggggcagcgtgggccctgccagagtccacctgggtggtgtcctgagtcaagtcctgccccaccgcccagctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcctccggggttagcagatgccagcagtgcctgcccgtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccagaaaaaaaaaaaaaaaaaaaaaaacaccgagggaataaacagaacaggatagctggaaaacagagggtcactgaaattggccacattgttcacaagcatagctccctgacccagactctcagtttgttccaataggttgtgtagaactccttagccggtgtaccaccccttcaatacgttgcggtgtgcataaacttccgcgctaaggcccatgggttataacccttgtcaagtaaatagacatctcgtgctacacccaacacaccggcgacattatacaaccagctatcacaagagtcgcgctctactcgatagtatcatcgccacgtaaacc

SEQ ID NO: 116190 - DNA, 369 bp, Homo sapiens
cattgtccttgagcaggacaattctgaagtgtattctacataaactctcagaggatgcccagcaggatggagtcccagttgcccgcagcagtaacccactcattcatgtacttcctgcgggggctctcccttccctctcttccccactcccccgccttgggcttcctgggatggctcccaaataaacctcttgcacccagattcttgcctcagggtctgctttggggaaacgggagtggaccccggcccagccattcccccactgagctccaggactttcccccaacattctgctctgggcctggcaaggctgcatgcgcacacaggagccttggaggactcgtggcacatcctaggccagcacccaca

SEQ ID NO: 116191 - DNA, 819 bp, Homo sapiens
ggttcacatgtacacggacacttgctttatgacaaaacgcacactttagtagggaaagaattagtcaataaatcgtcctggaacaagtgataatctgtatggaaagaaatgacttatgttccataccatatgcaaacatcagtttaagaatgattcgtatatttcaacatgaaagacaaaactgaaacttttggaagctaatatagatgaacaggttcatgctctttggccaggaaaatatttcttaaaaaaaaaatcaaaacggcaagtattaaaaaattgataattttgactaccttaaaattaagaaattttgttcttgcaaagtcaccattaagaaaagagaggcaagtcagagtagagaagatatctgcagtacctttaacagacaaaagacatgtatcagaatattcaaagcgcttctacaaatcaatgtgacagagacaatccaatagaaaaatgggcaagagacatgaaaaatacttcacaaaagaaattcagatatttaagaaacgtggaaaaaaaagtgcttaaccttattaataatctgggaaatgcgaattaaaaaaaactaggctccaccatatgcccactagaatggctgaaattttaaaaagggatttatagtacaagtttttgagaggatgttaggttatgggaactcagccactttaagaaacatcttgacatttacataccctgtgatgcattaatttcttttcatgggtatacacttgagtaatacatgtacatgtgtgtggagggatgtgttaaagaacgttggtagctgtttgtaatagcctcacactcaatatgatg

SEQ ID NO: 116192 - DNA, 713 bp, Homo sapiens
ttctacagtgctgatcagacctagtaagcacaaagtcgcaaatatcccagacaccctgaccacagacacacatgtataccaaggacaggaataaatacctaaaactgtaaggcactgccaccttcttagatgtcttggtgagaggtccactgttcagagggcacactgagatataaggcgaaggcctttttggatctgtagtgtgctacctctttaatgggaaatcttagaggctatcagtattgaatggtgaccagaggaaaatactgctctacatataggtctgggctgtcatacaaactgatctgctactggggcctcatgacctagcagatccaaaagtattcaacatgtttgtggcagatgcaaatgctgtttagaaccttcgagaggtcgctgtagaagcacaatgcaaaacttcaggattttggagcaaaactttgtcatcttttgcacacacagtgttctcttttgatagctcctggtgtgctactggaccttagtagagatagaatgtctgactctgagccactaagtaaccattcaacctcttctgcccttcaagaactgggaaatgtctgaaaaaacaagtaatgaaacgtgtgtatagcagcactccattacaagttgtagttttatatacgagattggtctcaagcaagacctaaaggtaaaagtaagaggctcagatttgcatggctcctcctcttgct

SEQ ID NO: 116193 - DNA, 402 bp, Homo sapiens
agtcacccagggccattggaacaaagaggaagaatcaggccccacgatgttttgggagagtgtttagcacaggaaaatgcgcagaatacacgcacgacacgggggcactgtcagtgtgggagcaatggtttacaacctccagccctaatctgagcactctcacctgtgcaatctgaaaggaacaggagacttgcaggaaagacagtgcctggatttaacttaaaggaactaaaaatgttggaatttttactcttgatatccttccaaatcaactctctcaatgttcccatcctcaaaactatcatatggggtaactgaggcagtcagagatttactgactcaatgtcactcaattgattctgagttcactgctgattacatccgaccaaactgctttttctg

SEQ ID NO: 116194 - DNA, 570 bp, Homo sapiens
taccctccccatgatcgctcagggttgtaattttgcatcactggcaagagttgcctgggatgagctctggccatttctctggggtactgaaaatacacggcaggtgcagaatcacacagatcaactgagcacgaagcaggacagtgcggaagggcccacaggagccacacagagaaagtgtgcgtccatttctctcgggtggaagtagaaatagcaccagctcgatgaggaggctgtgtggcagagggaaggattgctgggtttgattcctagctctgctgcctcgtgaacatgggctgggatttccacatcgctgtgcctccgtttcctcagctgccagtgggaccttgaccctcccccagaggaccacggggaaggtgaataacaccctgtgtgcaaaagcccagggaacacagcaggagcttaacacatgctcattgaacttgagcctgattgaggcccaaacctttccaccccctcccccatctctccttctggatctcttgttttcccaggaaaacagagaacccggatctcacacttctgccttcagagaggggcggagcaggt

SEQ ID NO: 116195 - DNA, 430 bp, Homo sapiens
cttggccaacgcgtcgaccccatctctactaaaaatacaaaacttagccagatgtggtggtgggcgcttgtaatcccagctactcgggaggctgaggtgggaggatctcttgaggctgggaaacagaggttgcagtgagccgagatcacgccactctgctccagcctgggtgacaaagtgagatcccatctaaaaaagaaaagaaaaagctgcctttgttgaggaagtcacaggatgacttggcagagcagtgtggctgcactcacccagctcctcctccaagcgcttggttaccgtggaaatgtcgccaccagcagatgctgctggatgtttgctgatgtttgccctcagctcatgctcctccagtcaccccacagatgccatttcaccaagaaaatggggtggtgggaggctggggagctcccctctg

SEQ ID NO: 116196 - DNA, 492 bp, Homo sapiens
ttttttagtttaatcaagttgaaatttcttgttaaaaggaataaaagatccaacttcaagcaacccccttgtatataaggataccgtgctattctgcctatagcagcagtcagggcagcaaggtgttttcttttctatcagatttcagcagactaataaaactcaaagcctgaaaaagggagagatgaggtagtctctccaaacatgctcacgtggatggtgccaggaagcccctaggcaagtaaaataacttctttggaagcctcaaatcactttagcctcaaataaaccttgacacccaagtaggggtatcaggcaacccaccaaggccatatatatctccgggttgctgtggaaaaagaaggacagagtttcctaatccagacattgaaacactaagtggtaccctcccatttgtaaccgatgagtattcacaaggacaggtgggtaatggaggatgaacattccctcccagcatttttaattaactgg

SEQ ID NO: 116197 - DNA, 371 bp, Homo sapiens
gagagcattcggtggccagtcctgttgaatgaaatctgagcactgagctggatttgcgtgccttgtaggtgactggtgcagttgcagcaccaggatagatagtgccccatattccgatttttacctgggattaccagccaggctggagtctcagcacaggaaccgagcgtagggatttgtgaatgaatgagtgttcgtgttttaagagatgtgggaacggagcagagtggaacctgttgtttgtcactgtaacgtttctctgggttggctgcatcctagacagaattgagagaaccgggccatgagttcggagtgtcagcagagccaccgtgaggggacgtggtttccagtgcagtacagctgtctgagga

SEQ ID NO: 116198 - DNA, 682 bp, Homo sapiens
ttatcccctgcctgtaccatctatgggttcaaccaactcattcttaactttatgctgaaagagcagaggtgagtggtgaactgtatttggtttggggctaggcacacctgtcttcctcttttcagatgtcagcttaaatgatcatgagatctttgctgccttctcttcttctagaggcactttcttctttagccaagctggtctcccctttcctccttgctggcaggggtgccctcgcctcatctctctgcctgtccaacccttccgcagttttctgtgctcagttcaaacctggctgcttctggtagcccatcacatatccttgctgtagtcagtgctaagtcatcatttgatgaatgtgtactacctggtagttcgtagaagaatattggagtgacaagagactagaacccctggtctaatggctgcaagttcaactgccatccagccagggtgagtcagtttaaagcactggtaggcattcataggccataacgaaacaaaacaccgtgctggcctgtaagccaacctgccaagttacacaacctggcctctttttttggctatgatttcaggagcatcccttacatctccaaataggttttgtgtctttagctcccagcatagttcagtgcatagtagggtcctcaataaatgcatagatgttacaggtaccgactga

SEQ ID NO: 116199 - DNA, 736 bp, Homo sapiens
cttagggctgcgtcgacatcacaaactaggaggcttaaaacaatagaagtttatcctctcacttcccgaggccagaagtccaaagtcagggtgtcagcaggattggttacttcttggggactcctggggagagcctggtccgggctccggggaagagtctggtctgtgtccctcgctaagcttctgctggctgttggcagtccttggcgttcttttgctggaagctgcttgactccagtctctgcttccattgtcacatggccattttgcttttgtgcatctgtgtcttaacatggcattcttctctctgtgcctctttgtctcttcttttcttataagaacaccagtcatattggattaagggcccacccctctccagcatgccctcatcttaactaatgacatctgcaatgatcctatttctaaataaagtcacattctgaggttctaggaaggacataaattttggggggatgctatgcaacccagtatacctacatgactttcaatttaaagtaggctgtgttattggagctatacagtagtcctcccttcttcgcgggggatacgtttcaagacccccagtagatgccagagatgtcggttagtactgaaccctatatatagtatgttttttcctatacatacatacctgtgataaagttttatttataaattaggcacaataagagattaacaacaataatgaataataaacaactatgacacattaaaa

SEQ ID NO: 116200 - DNA, 423 bp, Homo sapiens
tcatgatctgcccgccttggcctcccaaagtgctgggattacaggcgtgagccaccgcacctggcctaaaacagcgttttggggcaggaaatgacaagagaaaaacatggtgaccaggtgagatggtggtcagggaatggcatctgggcaggtggcatctcagctgccatctaaaaggtgggatggaagccaggcatggtggctcacacgtgtaatcccagcattttgggaggccaaggcaggaggattgcttgaggccaggagttaagagaccagcctgggcaacacaggcagaccccatgtgtacaaaaaattaaaagattagccaggtgtggtggcatgtgcctgtagtcacagctactcaggaggctgaggtgggaggatcacttgagccagggaggtcgaggttacaatgagccaaca

SEQ ID NO: 116201 - DNA, 748 bp, Homo sapiens
aggggatatttccgttgaaccgtttggagtttaagctgaaaatattaacgaatgtatctaaagttcactttgccttgactttatgcatccatcacatagagatcacgcagcgggcacccactatgggtttcatcatcgctcacttcccttggatcaactagaaatcaactcagatgagagtgctgagtctcagaggatggacgtctcactccttgccatacagataagtagaaagggtggtattgaaattaatggccagactctaagtcccgggcactatacttgatggtctcccaaccctcaaaatgttgtgggttcttttttgtttttgagacggagtctcattctgtttcccaggctggagtgcagtggagcgatctcggctcactgcaacctccgcatcccaggttcaagctattctcttgcctcagcctgccgagtagctgagatttcaggcgcccgccactacgcctggcttatttttttctctttttaggagagacggggtttcaccgtgttggctaggctggtctcgaacacctgaccttgtgatttgcctgctcagcctcccaaagtgctgggattataggcgtgagccaccgcaccaagccctactttgtattttgaatagaagcaacagcagtgatgggattcgtactccaaacctcagcgtcacacaacattcccatgcagcaaatctgcacatgtatcctctgtatctaaaataaaagttgaaatgtttttaaaa

SEQ ID NO: 116202 - DNA, 128 bp, Homo sapiens
tccagctcggtacctggctctgtcaattttacagcaacactggctcactcggtgcccgcctgtgccgtggctgatatgccaagccccagaaacacatcccatacacacacagagaggggcggagcagt

SEQ ID NO: 116203 - DNA, 379 bp, Homo sapiens
tatacgttaaaattggagaggtaccttctaacttactgtgacttctccatatgagaactggacagaacttactgtgtataatgtaaatatggcactcaaaactgtatatgcttgtgtttatgccataaattttatgctgtattattcagaaaactacagtacctacactggttttgtggatcttttttcattttctttcctcagaatgcaaaaatatattacagaatctttctctatttaacaatattttattggataattccagtctctgtaactctcaaacacctagagtaaaattaacaattctgcccatggccatttgctaaatatgtgtgggtgtttgggtttgtttaggaaatgttaacattcaaggctttgg

SEQ ID NO: 116204 - DNA, 399 bp, Homo sapiens
ttcattcatgctgcagcatgcaacaggattcccttccttttgaagtctgagtactattctactgtacaggtttgccatatcttccttatccatccatctccagtagacatttcagttgcttccaccccttggctgtgagccacgccttctttttaaaccaaatttcaatacgcccgtagctatatccatccctcctcacaaccctctctcctactcagctccccaccctagcctgttctttcagttgactcttctatttgttctgtcccatcaatctctgcccctcagtgatcattcctatgcacataccagatgtgctttcgaatctacccttaaaaaacaacagcctgacacagtggctcacgcctgtaatcccagcactttgggaggccgaggcag

SEQ ID NO: 116205 - DNA, 710 bp, Homo sapiens
ggtactgaaagagtgctctaagatgagattcagtctctgcctttaaggaacttacagtgtagtagggaggtagcatgcactcaggtaatcatgagcaagagaagatatgatgagaagagtcataaagcattgcaaactctaagaagcaattgttgacttgttttttgcttgggaataaaaaatggagatcgattttgaggggagacttggaagattaatgtagttgagttgaggagggatagagataatttgagagagagtgttccagatagaacagcatgagcaaagaggggtgggaattctggataggaaaacctctaggtaacttgtcagcttgccatgtgacagctaaccaaggggagcttatcacgcagcattcataatttgggcgacatcacttgaatgcatttagattgtagcagaatatccttagctgtgctaggagaccttttattcaacccaggcttcccttcttcccagcacacagggatcctgaagcaaggtcccagtgtattctgtctctggttttgaaaaatgatttctaaggtgtaatttcaagaatatcacatcagtctattttaataaccttctctattcactattaaaatcttatattttttcacaatttctaatagtggtgaaagatgtgacaaattttcagaatagcaattgattgtatcaaatagagtataattttatgaacatgccaa

SEQ ID NO: 116206 - DNA, 513 bp, Homo sapiens
cgtgcggcgatctagaggaccccctcggtctaccatgttttgctaagcacccggagctggcagacaagaatgtgcccaaccttcatgtcatgaaggccatgcagtcttccaagtcccggggctatgtgaaggaacagtttgcttggagacatttctactagtaccttatcaatgagggtatccagtatctccatgattaccttcatctgctcctggaaattgtgcctgccaccctatgccacagccatccagagactggcaagcctcagcctaaaggtctggagggtaagtgacctgcaagactcacaagaggggaagccgacagagatacccacagacaaagtgttttgccccctggtgccaacaagaaagccgaggttggggctgggtcagcaaccgaattccagtttagaggcggatttgatggtggatgtgttcagccacctcagtaaaattggagaggattattttgcattgaataaacttacagccaaaaaaaaatttaagaaaact

SEQ ID NO: 116207 - DNA, 436 bp, Homo sapiens
gactctcaatctccatctctgacttcctccatctgctgcttcctccttcttctttccatcccatagctatgagaaatcaggtgggtgctcttctattcatctcatgaactactggacatgtttacatttggggaacttaaaaataaaaatgaaccagatagctgttggctgttgtctttttgtgaagaataattttagggatcaaaagacaaaaagaaaaacattctttgtatcagagaatagcattatgatctccacacatagtgccagctcttttaactttgaaggtcaaatttcctagttttccaaatgtccactgattccctttaaacaaaaccctgtctgggcaaaataaaacatgtccatgaactcaatttagataaagctgatttggcctatgagccgtgaatttaaataaagaaatcttaaataatgg

SEQ ID NO: 116208 - DNA, 258 bp, Homo sapiens
tgctgagcaaggatgacatacaaattcatgaaacattccattaaaaaaaattttaaacttatgttaagttgtacaaaacttcaaactattttctaaacagcaaaaagagaaactaaaggtcagcagtcaacaaagaaaacttctgacaagtaatctaatacatgacacaaaaataggcatctcctactattgaaacttctaaaactaggactattgagacttctaaaactaggtgctattgaaacttctaaaactagg

SEQ ID NO: 116209 - DNA, 802 bp, Homo sapiens
tcaagctgttatttttgtttgtcaaatgttttgtctaaatatttttgtctgcttgaaggatcagtactgtgtaggaaaatctcccacaacgataatgaattgatcaatttttttcctgtggttctgtcaatctttgctttatgtttattgaagtatatgttagttacacgtcattagttacatgtaattttttcgttatacttcagtaaatttctgctttatgtttattgtgctatctcattactatatgtatgtttatagttgtttaaagtgaattaaattttaatcatatattttgaacaattaatctccagtttctctagtatctttagatattgttttaggtcttaaacctatattatttgtaataatacagctatatcagctttcctttgattcaatttgcttggtccttctttttttattagagcatatttatttcttttttttctctttttgaaaatttttatagatttaggagctacagttgtgcatgtcatgcagttatgttacatagatatattgcatagtggtgaagtttgggtttttagtgtacccacaacccaaatagagaacactgtaccaaataggtaggtagtatgtcatccctcagtcccctctcactatcccaccttttggagttgccaacgtctgttatttcactttgtatgtccatgtgtactcattggttacctctcacaaataagaacatgcagcttttgactttgtgtttctgagtcatttcacttaggactatgtcctccagttctatgcatgttgctgcaaaaaaaaaaaaacatga

SEQ ID NO: 116210 - DNA, 324 bp, Homo sapiens
gttaggcaaggccatgtgattatttctgagcagttagttggcagtgagtggaagtgatgtgacatgtgtcatttccaaggtgaagctcttactagctggcttgagaacttttagatctcttttcttttgcatggaaaacctggaaataccatgttgagacagagacacccaagataaaattgcctggaaggctgagccaccacatgaaaatgccaaactacccatggcaaatgctgtgtgagcaagaaataaaattacattctgtttttttcttggagaaataagggaaaaaataaaaataaattacattctaataaaccatgg

SEQ ID NO: 116211 - DNA, 658 bp, Homo sapiens
gttttaatggcctgaatagaagatcaaaccagccataacattcccttaagccaaagcctaatccagagcaagaccctaattctgttcaattatatgagggctgagagaggtgaggaagctgcagaaaaaaggtttgaagccaaatagaggttggttcatgaggtttaaggaaagaggccatctatgtaacataaaagtgcaaggtgaagcagcaaatgctgatgcagaagctgcagcaagttacctagaagaacttctttatcatttttcttagaattatgtgttatggttatatagatgagggcttgctaagttgcccaggctggtctcaaactcctggcctcgcctccttatgcaccagaaccataggcctgagccaacatgcctcaccagaagaactaatttagataattgatgaaggtggctaccctgaacaacaaattttattgtagttgaaacagctttctattgcaagatgctgtctaggactttcatagctagagagaaatctatgcttggtttgaaagcttcaaaggacaggctgactctctacttagccaatgcagctggtgacttgaagttaacatttaccattccagaagtcctagggccctttaagaatgatggtaaatctactctgtgctttatgaatggaaca

SEQ ID NO: 116212 - DNA, 296 bp, Homo sapiens
ctattttcatatcctaatggctgcaaattggtagcttatgggtttttatttgcatttacctaaataaagcctaattaaaacatcagacaagtggccgggtgcggtggctcacgccggtaatcccagcactttgggaagctgaggcgggcagatcacgaggtcaggagaccgagaccatcctggctaatgcggtgaaaccccgtctctactaaaaatacaaaaattagctgggcctgcttgtggtgggcacctgtagtcccagctactcggaaggctgaggcaggagaatgatgtga

SEQ ID NO: 116213 - DNA, 858 bp, Homo sapiens
ggaggcagagatgtgctgaaatacagcatcaaacatgggcacgggcccttggagctcacactcttgtgggaggaagcacgtaattacacagatgctgaagcatagtcatggtgtctggtgtgcaggagaaagccgtggggcttagagactcatgtgtctgtcactcgttcattcagccactcacccattgccatttttggccatctgctaaggtaccaggaagtgtgttaggatccagatccccaggggtgaaacagactctagccctgctctcaagcagtttattgtcatcaaacaccgccatccaggcagggcaatcggtgctggaacccggaccaccgtgggtaccgtggcacacggtggacagagtgaccaactgccaggagtgagcagcacttggggtaggcttcctggagaatatgatgcccattctgggtcttgaagaaatgagtgggcatcttctggttgatgaaaggcatgagaaaggcttgtggggccaaagaacaacttgggtgaaaacgggaggaagtgaacgagcatgatgtattggggtcagtgctaacagttctgggatgctgatgtacaaggtggggctgggagatgaggccgggaaagtagccacaagctagagtgtaaaggtaccagggtggccgggcgcggtggctcatgcctgtaatcccagcgctttgggaggctgaggctggagtatcacttgagcccaggagtttgagaccagcctggataacatggcgaaaccctgtctctacaaaacattaaaaaaaattagccgggcgtggtggagcacacctgtggacacagctactcaggaggctgagggaggaggaccatttgactcca

SEQ ID NO: 116214 - DNA, 312 bp, Homo sapiens
aggcctttgggaagtaaagattacatgagctcatgatgtaagagcactcatgaatgggattagtgcccttataagggccatgagagagcatgctactctctgctctttcccatgtgaggatacaatgagaagtcagcagtctacagcctagagtgacctcaccagaagtcaaccatgttagcaccctgatctgggatttccagcctccaaaactgtaaggaataaatttgtactattcatatgccagctagtctatggtatttttgtcaatagaagcccatacagaccaacacagggagaaaaagaatgaat

SEQ ID NO: 116215 - DNA, 251 bp, Homo sapiens
gaatgtaaaatcctctgcctcagcagcataccccaacatgcaaaggcttaggaaggcatgaaattagcccagcttgtcaatcatggagcttggtcagactctggctaaattctttcaagtagaaaggggaataaaacttttgaaaattaaactaaatgaggaaccttttcctcagggcaggagaggtacttctaattgacttttcaactagagtgaaggttcacgcatggccccaggctttactcctctgg

SEQ ID NO: 116216 - DNA, 442 bp, Homo sapiens
gaggaaatgtaaaatatagttaccttgtggaaagtaatctgatgtaatatattaaaattttatccatgtatgtcctataattcagcaattccatgttggggaatccatacaaagaaatacttatacacatgcagaaggagctaagtttaagaaagcacacatttcagcgggttgtggtgtctcacccctgtaatcccagcacattgggaggccgaggttggtggatcacctgaggtcaggagtttgagaccagcctggccaacatggtgaaaccctgtctctactaaaaatacaaaaaattagctggtgtggcagtgggtgcctgcagctactcaggaggctgaggcaggagaatcgcttgaacctgggaggtggaggttgcagtgagctgagatcacaccactgcactccagcctgggtgacaagagcgaaattccatctc

SEQ ID NO: 116217 - DNA, 98 bp, Homo sapiens
tatccatactaaaacaatcctaaataataaaaatacagttttctctcccatagatagatatggactagtcaagttggttgtaggataatatctataaa

SEQ ID NO: 116218 - DNA, 674 bp, Homo sapiens
agaacatgtttattttgcataatttctctggcttccaaaatctgaagaattgcctctgtttaaactctattttcttctttcgtgtacttgctcttgatttgctgaccttctaaatggggaccagcatctaatgcttaatgcagagtgctggggacatggggaggcaggaggagctggaggctgcgtcatggaaagaccttggcgccccctcaggaaggaaggactggcttggcaggatcccaggctgttttcctggttcagccctcccgaagacattgtgttctctgcagccctggagggcctctttctctcaatttctcagtgaggtacctgttttgtaatcagtcctgtcaggtgaagcagccatgttactactggacaatcatggattatcttttcccttccttcctggatccaggtgtctgaatttataccaccaaaattcttccagattttctatctagtggttcattctcttttgtactttgtagtgccgttgtttattctcatgattgatttttttctgagccaattggaaggaatgtctaacactgactgatcaacccacagtgtttaagaggaaaaatatattttagaatcttgagggagttttatttcagtgtatgtgaattgtattggctatgtagcgtcttcattttcattgtaagaagaat

SEQ ID NO: 116219 - DNA, 419 bp, Homo sapiens
tggggattgtggcgcatgtgttgtgtgcacacgtttgtgtgtgagtgtatatgtgtgtgcttgtgtgtagattcctggtgtgtgtgtctaagggttgaggtgtcaggcagagcgtggggaactctgaggaacttggtcccagctgccccctcctccccatctttctccttggggacggaggaggctctgttctctcctgcccacctgctcagtgccagttcccagctctcctgctgctcagctcttaagcagacctttttccccaggtgtatctgcctatacctctttaccccatgtgtgcacctgaaggcaccgggactggtagggtggtgttcacatgcagcacacaggagggacacagggttccatagtctcctttgacagaagaggaaagaggccaagcaggggacattgacctg

SEQ ID NO: 116220 - DNA, 624 bp, Homo sapiens
ggagggagagcttgggagaagcagtttggaactaggataatgctgatacctcttcctaactctgttttgaggtaccctagacttctccatctttacctgacaggagtaaaaggagagaaatgttcttaggggagaagcagatttcctgaaggcctggaggtaaaggcagcacactgtctgatgtcagagagtgtggggaagtttatttacaatggaaaagagttttcagtgtgcacaatggaaagcactggaagagaaatcagcaaaaggaagataagctattggaagaaagggaggatccctgtatcgcatgacatcctcagggaggattcatgaacccagaggcttcggacaatgagcaggagaggaagcggagctgaggataaccaggtaaaggccaggatggtggtaccatagagttgtattaaaagcacaaactttggaattaggtcctggattggctattgactccggaatcttggtcacattatctaaaatcctatgcctcagtttccttttctgtacaatgagaataaatagttacctcatcagacaattttgaggatgaaatgtaaaatgctaagctccactcttggcccacaataaacactcaataactgttca

SEQ ID NO: 116221 - DNA, 537 bp, Homo sapiens
cacatggtcactgtcagatagtcactgaggctgaagatatctgaagactcaactaggctgaatatccaaggtggctttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccagatgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgttttta

SEQ ID NO: 116222 - DNA, 916 bp, Homo sapiens
ggtagccttctggtagtcaggaggaccccagctgtttctccacatggctcctaaaacaggcaagaaaatggtggatctagacctgtactgtcaaatatggtaactgctagtagccatatgtgactattgagcacttgaaaatatggcaaattgagatgtgccataagtgtaaaatacacaccaaagacgtagtagaaaaaaggatgtaaaatatctcatcagtaatcttttattttgacaagaggatgtaacaattctaaatatacatgcaccaaatactagagtgcccagaatcataaataatattagacctacaaaaagatgtagaaccaatacagtaataagggggacatcagtaatctactgacaacattagacagatcatcgaggcagaaaaacaacaaaccctggacttaaattggactttagaccaaatggacctaatggacatttacagacattctgccttacaaccacagaatctacattcttttcatctgctcatggtgcagtctcaaaaattgaccatatgctaggccacaaggcaagcctcaatacattttaaaaaacaaaaaaacaacaacacaaaaaaagcgtgtctgaggagcagaggcactggcgcccccgagagaagagttcaagaacccactcgtatggagaccgaggggcccacaaagggaaacaggccgaacccggggccccacaacggcagaggagccaccaaacagaaaacctccgcgggcagacaacagaagcggcgccgggagacttcccaccaacaaaaaaagagcgccgggggagggaaacacacagccgcggttgtggagacaaaattcccgaaagggggaatcgaaggagagcaaaacgggggtctagaccagacggggggcccaaggcagccaggaaataaattcgg

SEQ ID NO: 116223 - DNA, 931 bp, Homo sapiens
gaggacccagcatagaagagcacagctggccccggcgtttcatgaagtcagaaggcctggcagccatttcctggacgttgagaggatgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaagggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctagagccccttttctctgctggcaggggctttgtttaccagctcactgtttaggctaaatgttagggaccagatcactgcagttgaaaacaggcactccaggcttagtgacagtggcagcagaaacagtgttggctgcctttctgaccaccccactttcctgccctgagacagcagcccagggcaggtgcttcatattcagaccaggtaagcctcatttgcacaacagtcaaattgtttgttcctttaaaaaggacacaattagcctggcacggtgactcatgcttgtaatcccagcactttgggagggcaaggcaggcggatcacctgaggtcaggagtttgagaccagcctcaccaacatggaaaaaccccatctcta

SEQ ID NO: 116224 - DNA, 312 bp, Homo sapiens
tgcttcctaatgtatcattattactattactacataccacttttccttcaatttcttccttttgctataatgaaattacagaatccaaaatttattttagtttcttagacttcttatttttttgtgctgtaggtactgttgatcctcactccaaaatttaactcagcagcggcagatccttcagccaaacaatggaagaagacatttggttgttttttaaccagggtcactagaccaagaatcatctacaagaggcaaaatagcagtcccacttaaatctctaggttgtggtgtgctacataccccagccag

SEQ ID NO: 116225 - DNA, 541 bp, Homo sapiens
ggttcgagggcgcgcgctgcttcccgggagagggcgggctccgtggcagccccctgtgggcggagccggcggccggggctcacaacccgccggaagacgcgcgggttgtggcagctgcagcgggaccgcgtggggtgggccccgggaccgccagggctgcagcgagagcggccggcggtgcaagcggccgggagggcgcggccggaggcagaggccaggcgagacacccggctgcggcctaagaggccaggctgggtgggcttggctgcagccgccagccccgtgttaaagcggcagccagggaggtgtatcctccccggggtctgcaagacgccggctcagggcatccctcccattccggccctcaaagcctcgctcctgggggcgctgctgggaaagcccacccgcctgggcgggcccttgatgggaatgtggagcagaccctcgtccactccggaggccgagggtcctccgggcttccgaaggaagccgacctcaacgctggacgcttcttggagaatgattgcgttgagtggagatg

SEQ ID NO: 116226 - DNA, 316 bp, Homo sapiens
atttattccagatcttgttgcttgacagtatgctagtatattggcctgcatttccatggtcaaaggggctcagtttcacatgtgccttccagcctgtgggaagcaggaaacaattagcccctttctagagtagttttgtttttgtttttgttgttttgttttgttttgttttggtgacagagtctctctctgtcatccaggctggagtgcagtggcgccatctcagctcactgcaagctctgcctcccgggttcatgctattctcctgcctcagcctcccaagtagccaggactacaggcacccgccaccacgtgc

SEQ ID NO: 116227 - DNA, 174 bp, Homo sapiens
tattgtgaggattaaacttatgtaaagcacccagcctaatgcttggcatggaacgggcactcaataaatagtagttattaacccacattggctctataaatagcagagtcaaagtcgacagacccagcctgaacaagaatttcgctggggatctagccttcaggccagtattgg

SEQ ID NO: 116228 - DNA, 765 bp, Homo sapiens
tgccttttatcaaagtaagaaagtttccttctattcctagtttattgagaattctaccatgaatagtagttcaattttatcaaatgctttgtctgtgtctattgagatgattatatggctttttcctttaagggtcagcaacattttccagaaaaggctatatagtaaatatttttggttttgtgagccatatgagctctgttgcaaccaatcaactctgctttgtagcagaaagcaatcatagacaatatgcaaatgaatgggcttggctttgtttcagtaaactttatttgcaaaaacaaatgtcatgccagatttggcccaagggctatagtttgcttttggctatagtttgctgaccactgatttattctattaatatatgtattacatgaattgatactcagatgttaagctaaagaacattcctgtaataaatcgaccacacttggtaatagtgtataatcctttttgtacattactggatctaatttgttgttatttaaacaattttagcatttacattcatgacgagtgttgttctataattttcttgtgatatctttgtctgtggcttttagtatcagggtaaaatgagctgtaaagtgtccccttttcttctattcttgaaaagatttccattggattggtattattaattatttaaatgttaatagagttcccaataaaaccatggaggcctggactttgctttgaagaagattctaaaataatttaattaaacgctttaatgtttttcactga

SEQ ID NO: 116229 - DNA, 151 bp, Homo sapiens
gagcttagacgacccagtgctgcagagaaggggcaggtgactaggacagccacttccttcccagcacttcagttttctggatgtgtctctggctgccccagaaagggaccgactgtcaagaggcaatatctcctcttgaagtaaccctggc

SEQ ID NO: 116230 - DNA, 560 bp, Homo sapiens
aaagtttcgtgtaatatagctgtacccattcacttacgtgttacttatggctgctcttgagttacaacagcaaagctgattagttgcagcagagacaatatggcccatacagcctaagatatttactgtctggccctttaaagaaaatatctggctatctctgtcctaattgttgaagtccttagtctacaaaaatggcagttttgttcatggactttggaaattgttaaaacaaaaaaatggcagttttgtataatttgaactaatacataaaagggactataagctttggaaaagagataaaagctgtgggggatgtgtgtgtatgtgtgtaaaaatttaaaaacttgagggtatagagagaggtgaagtctggaacattattgagaatgagaatgggaagtgaatagtaatagagaataattactcagaagaatgctgaatatccggcctccctgctggtctccagttaggctgcatggagaaaccttgaatccaagtggggcagtggatcaaacctcataccagccgggaaactggtagagtcaaggaaaaaaaaa

SEQ ID NO: 116231 - DNA, 651 bp, Homo sapiens
tgaaagatctgccacatggaaacgtacttttcccctgtgttttacagctatacctaagaaacactgcattgctacctcagtttattttagaaggtccatttaagcagagtatctatatgtaaatcaagcctacctctttccttttacttttaactttttaatggaaatccacataagtttataggagagtagagagaggaagcaatgctgctatcatagaaaaacaagaaactaccatgtgtaacctacttggtcttttggatttgaataggtcttaccgcatatttgtccttttcacttcattatggagtgtagcttcgtatactgagatttaagccttgatggatccaatactaactgatcatggagaatatttaagggttcaagattgaacgttttcatgaatcttctgaattgggttgtactaaatacatggtaactaattgcatcaaattttggctccagaatccagtgatgctatcaaacatttttcctgtttcctggaattgtgtttggaggaaatgtctttatatcacaaagactattgtactccatcacagaaatgtcaatatctagaatatctatggagattagttctgtattctagtatttatgcctcttactaaaggtaaggtactaaaagtaaaggta

SEQ ID NO: 116232 - DNA, 510 bp, Homo sapiens
gagggctactatctataagccaggaaggcaaccctggcaggagccaaaatcagctggcaccttgatcctggacttccagtctccaggactgtgagaaataagtatgttggtgaagccacccagtctatggtattttgttatggcagcccaagcagactaatacagttaggctgagcagtgttttacttattttaatgtggtttccttttattttcaaagaaccagcttttctagttgagcaacactactttcttctatttgttttaaattcactaattctgctcttagtttgttccttcagctctgtaaggggcagtgtaagcaccactccaatcctcttatcccatcctcagtccagttctacagaggttagtcagctttgtgaagctgcaagctaccagaaccttcacaaggacctacatcacctatgcctggttcctgccctggggcttctctggtgtcctatgtgggacacctgtggacacctgctgggccctgaagtgcagaggc

SEQ ID NO: 116233 - DNA, 236 bp, Homo sapiens
ccagaagctcattgagataggagtgatcacagtcactgcatcagcaggcatgctgctgggctgggggtgtggtgatgagcagtccctccagagtctcacagggaggctgacaggcagttggctccaggtgatcgtggtggcaagcagacccgcagtgggcaccttctaaactctgcctgagctgggggctgaggtggggaaggatcaggaaagccttcagcaagctggactcattt

SEQ ID NO: 116234 - DNA, 583 bp, Homo sapiens
  misc_feature (424)..(424): n is a, c, g, or t
  misc_feature (434)..(434): n is a, c, g, or t
  misc_feature (440)..(440): n is a, c, g, or t
  misc_feature (449)..(449): n is a, c, g, or t
  misc_feature (456)..(456): n is a, c, g, or t
ggaggaaacctggacgaggccctgcgctacaatacggctcattgcggcttgagctcatgaatccgcctccacctgcgaaaagcggcggaggacgcagcggtagttggcgcccagggttgagccgctgttgggttacgggtgtatagctggactgcggtagtgaagcacaaagcccccaagtgggacccagagctaggggaacgttccaataatatcctagtcacctgaatcatgcaaagaaattccgctttccaggagcacgggactaggagggcgcctacttcctccctggtgcataatgggcccttaaaattaaatatacaaaggatacaaaccgccgcagagctccttaaagtcttttcattaaattgtttgtgttttaaagccaaaaaaaaaaaaaaaaaaaagaaagaaaaaaacagtntggtggggcncgcccngcgcccttnaaaaaanggggccccggcgaagaaaagcttttcgcaaaaaccaactgcgcgtgggggcgcgcgcggcgggcccccggggagaggttacgggtgcaaccggggtcccaagggcgcggtgttccagagggggaacc

SEQ ID NO: 116235 - DNA, 559 bp, Homo sapiens
tcctagattgtctatctaattatcaataaataacagttgtatttaagggatgccaggtacagtgataacaaaacatacattagtagttacagagcgtgtcagaatacttgcattctcagataatgaggtgattgcaaaagtccaaaaataaagagttcattgaattttggtttatacaatcaatgtaaccatttaaaaaaatgatgataatgatagtttttcaacaagctaggtaaatggttagaatagaatgcaaagttaagagcaaaatcccaggatatgaagttgttgatgtgctctgattgaacctgtacagaaacacacagaggctatgatctggcagtagtaccctgacattgctaacagtggttgtattagactggctgagttagaagcaattgttttttttttccctcctattttcctaaatatatttaatttgattttaatgactaacattttttcaaattaaataaaagaatctggactcagattattaatcatatctgaattgccttccctcccaggcaccaaaatgtaacttaaagttctgagaaac

SEQ ID NO: 116236 - DNA, 420 bp, Homo sapiens
gagcttttggagagatggaagactagagcaaaggccttcaggcagaggtgcgttatagcactgagcccactacagccaggcagtgtgagagggcaagaggaggagggggtcagagatgatgggcagccgctgtgcaggctgtgtagggtgttagaaagactatggcctttactgggagcgaaatgaatcactccttgctaggttggcagaggcatcacatgatctgacttccattttaaaactgtaactgcatattaaaaacagaatatggggggtaagggtggaagcaggaagacttatcagaaagtattgtcagctcagtgctcttgtgcaactgtagtcctatctgcttgggaggctgaggcaggaagatggcttgagcccgggaggttgaggccaggcattcatgctggtccagac

SEQ ID NO: 116237 - DNA, 82 bp, Homo sapiens
cgcatattttattatttataaattatattgtataatcctttatcagtaagatatatagtaaatttatgcatgtataggtata

SEQ ID NO: 116238 - DNA, 361 bp, Homo sapiens
acagacatcctgttattctattatgttatctattatgctgagaataatagctccatccacatttctgcaaaagacatgatcttgttctttttcatggctacataatattccatggtgtatatgtaccacatttcctttatccagtctactgttgatgggcatttaggttgattccatgtctttgctgtgtgaatagtgctgcaatgaacatatgcatgcatgtgtcttcatgcagaatgatgcattgtggtgatttctcaaacagggaacatacttgctgagcatctgttgtgtgcccatcatcagaagcacatcctctgtaaagggagcaagatgaattaatttatgaataaagctcctt

SEQ ID NO: 116239 - DNA, 514 bp, Homo sapiens
agcggggccatcagaaggaagcctggacaggtcccttgtttctaagaattcagaggcttgctgactctaactgtgcttgaagcaagatgactgcaggttgcagagtgaaccattgggaaagtttgcctttttggggatgaactgattttccaaccctgatgctggcggaaattgagtgatggaactaaggtcatctggtgctctccttgagctgcttaataaacagtaaagctattcctttctatttaaatgacataaaaaggaattgatttttagtcacctttccaggaagtgcttcctgaacctgaaaacctgcatggagaaattgaagaaattgttcttaaagggtaaaccaaggaaattgtgtccaagatccctgtttctcacaaaaaataagaaaaggaaccaggtaattagatggattgttcgttcaaggcattatgtacacttcttttggttctgaggttaataaagacaaagaagagaaaaaggaaaaaaaaaagaattaagggca

SEQ ID NO: 116240 - DNA, 595 bp, Homo sapiens
cctgccccattgcagaattatcagaaggtcacctcagaaaagcagaaccaacaagaaccttgggagggatttcagcttcagagaatgcccggtggcaacccaagtcagtagcactagctttgtggaggtctgtgttccagggaggagatgaacgtgggaggaggatacgtgggagtaaggatgccgggcggagcgaagtaacgtgcaaccatggtacaaagaacctcgttgtgtacaacaaatgcagcctcctttcccatgcccgtgggcataaggagaaaggggtggtaagtgcaatgctcccacttaattttaaagccagtcccagcagatcaaatgatagttgctcggtcaggcaatagttccacttcaacttccactcttcagagcccgtgtgggagctgtcacagacactgtcgacaaaaattcagtctggcataactgggacagtcatatcggctccttcaagcactcgcatcaccccagccatgcccctagatgaagacccctccaaactgtgtagacgtagtctaaaatgttgggagtgtaatgaagtcttccaggacgagacatcacgtggtacacatttccagca

SEQ ID NO: 116241 - DNA, 641 bp, Homo sapiens
tgtcatatactgtctaaaattttgttcttgctgttctcttccacctcttcatctttctgcacttatcgtgccaaactcctgcttcaagatttctagagtcacctcctcttttctcctgaatgagtcactgtgtgactcatcatctaaccgctgccattgaatgccttctagagcaattacattttgctaggtcttaacctttgaggtgctttgagagagaaacttctaagctttgagagagaaacttctattttactgtatcctttacagcactttctacaaattaggaacccaagtatctcatggatcttcaagttattccctttctataaagttaaatatataatggcttattaggaaatccatactctgtatcaactaacagtcatgaatagaagtaggtagagctcacttaagatataagacagtacatagttacttgcagcaatctctttagggaaaaggaagctatttaaaacaaaagaattatttgcattttttgtgtatgcaaaccctgtatatccttatctaaaagtttaactaaaaattgaccaggcacagtggctcacaactgcaatcccacctactcaagatgctgaggaggaatgatttgaggccaggaggttcaaggccaacctagg

SEQ ID NO: 116242 - DNA, 192 bp, Homo sapiens
agttgacctctgtgtccttcctggattctgcaccctaatctggtctctaccctgaggggctctgtccttgttggatcagctgctgatgcaattggccccacctggactttgagccagtgaatctgttgctgacctaccattgcctttggacttgaggttcccccttttctccccatgccagggcttcctcag

SEQ ID NO: 116243 - DNA, 343 bp, Homo sapiens
tgggaggaatgggtggaacagggcaaaggtgaacttgtgcttcaagaaatcattgtggccaggcacagtggctcacgcctgtaatcccagcactctgggaggcccaggcaagcagatcacctgaggtcaggagtttgagaccagcctggccaacatggtgaaaccccgtctctactaaaaatacaaaaattagccaggtgtggtggtgcatgcctgtaatcccagctactcgggaggctgaggcaggagaatcacttgaactcaggagatggaggttgcactgagctgagatcgtgccactgtactccagcctgggagacagtgagactctgtttcaaaaaaa

SEQ ID NO: 116244 - DNA, 586 bp, Homo sapiens
tatgataggtacttagctgcatgtggcccaaagattgaaattaatgaaaataaattaaatttaaaattcagttctcccatcttactagccacatttccagtcctcagtggcacgtgtgtctagtagccactgcattggagggtgccgtatagaacaattccactctggcagaaaattccactgaatcagaatgctgttctagagacagtgcctttaggttcattagcgggagcccatagccctgccccccacctgctctccagcaaggtaggcagctgacctgctcctcagggggcagcctgggactctcaaggggcaggtgcctgggaggtggatttaaggctagaacatcagatggagggctctgtggtctggcttgggcttctcctggccctatggagagggcctctgagcagtttctttgggcaattaacaaaatgatttaaaagtcaggatagcttgacccttacacactaatctttgggccatagtcattttcactgtactgcagactttgcatttccttctgagcctggttgcttacatctcagtgttcttttcagaccatggaaggaaatgtagccct

SEQ ID NO: 116245 - DNA, 543 bp, Homo sapiens
cggatgacagtgagatgctccaaggggctcctgagaaggcggtgggagagaagagccacccgggagctcctccaggcctcggaagagggaggctgccggggatgggtccagtggcaccgggctccggtttatgtgagccgaggctggctagggaccccagagatgcaggcaaaagcctgtgccgtaagccacattcctcacttaggcccccttccaggggaagcgaagtcaagccctggtaaatgcttctcatctctgggtccagctgggagaacagtggcatgatgacatgctacccatgtagccaagctccccctcttcctcccttgcacctatcgtttccatcctgttcatttgccagttattacaggagcaccacgggcaggccacacagctagtgctgtggagatgacacgtcttagtgaaggaacggagggaccggcatggggatggatgagggaaacgcctgaccataaacctaaacatctaaagatctggaggagccacggggaagtgggactgtgtgatgatgtcagacatttc

SEQ ID NO: 116246 - DNA, 349 bp, Homo sapiens
gctttgaggacagctcatctggcacaactccactgtgggtggtacaagactcataccaggttgcaccggccccttgctgccttcgcagttggaagtggtgatctcagacctggctgagaacacagtaaaggcagcaagcctgggcctgccctcctccattcatgcctcagaggttgggacccttctgtagcctcctctgcactgtctctctttggattaataggaggcccgtgcaggagtcagagaacacggctctgagctgtgaccatccccaaagcactgccctgagttgccaaaggtcatatccccacatggaccttactttataccagcaagatggaacctccgg

SEQ ID NO: 116247 - DNA, 434 bp, Homo sapiens
cgtatggaaaacatgttcaagcacactcgtaatcagagaagtgcagattaaaacaatactgagataccatttctcacccatgagactggcaaaaatttaaaaatcctaccacaacccctggcctggctgtgagcaaacagcgctcgacacggggcacagctctcaggagggaggaatgtggcaacatccggctggctaatgacctctgtgcaaccccaattctgggagtcaaccctgcagagatgaaaaggtccacatgtggtgttcacagcagcacaggtggagatggcaaaaccctggaaacagcccagtgcccgcacagagcaaggtcgctgagtaaacgcgggtgtctacacggtggggcacgtgccggaaggaggaaggtctgtaaggcctgccacgagatgacttccaggacattaagtgagaaggca

SEQ ID NO: 116248 - DNA, 1062 bp, Homo sapiens
  misc_feature (1061)..(1061): n is a, c, g, or t
attactgttattaaatagttttaggaggagtgaaggtggccaaaaaaaattttttggagttatacattgaaatgtttgtaaaagaaatgactgacgtctgaaatttgcttcagagtaatctgggatgagggaaggggaagagggcgtggatggaataaggttggctgagacttgactgctgaagccaggcttattgtaccacacgctccgttcctatgtgtgcttgaagcttttcacaataaaaagaaaaaaacaaaacacacaaaaaaacaccaacaaaaagacaaaacaaaaaaacaaaaaaaaaaaaaacaacagtggagggcaaccaacacaaaaaaaagagaaacaaaaaacagagtgacggagacccgacgcccaccagagagcacaggaaaagggagcagaccgcagaacaacaagaaaatacagcaggggcagaaaaaagaggaggcgacacccagacaaaagaaaaaacaaaagaacacagaggagaaaacagagggaaggaaaagaaaagcaagacacgacaaagagaagaaccacgaagaagaaaaaaaacacgaagcaaaacacaaaaaagaaggcagcgacacagcacgaggcacaacgaacaaacaaacatagaacaaaccacgaagcagagcgagagcacagcacgaacaaggacacaagccacgaacacgaagaagaagaaggaaggagaaaaagacaagcagaagatgagacagcaacgagagaggaaaagggagagggaagcacaggagcgaaagaaagaggaggcgaagagagagcagcggcgcaaggcagagagagggaagaacgaaagagggagcgagaaaaaaagaacagagaagagagacgaaaagacacaacagggcagagaagacacagaaaaaaactagaagaacagcgaaagaaacagaagaacagacaacgaaagaaggagagaaagacgaagcacagaccagaaaaagagaaccaaagaagaacaccagaggagaaacaaaagagcaaggcagaaaaaaacagagaaggcaacacacgacagaaggaaaaana

SEQ ID NO: 116249 - DNA, 773 bp, Homo sapiens
gttttcttggcttctccatccactgataatctctcccacaatattgtgacttgattctgttccaggtgaaccttttcctagtatttcttgtattctttattatctgtcatgttagggcagctgtggagcttcatttttacaactgctgaatctaaatttaactgctgattttctaccatccattttcaaccttctttaaaaagcctggtgagtaactttatctgtcatggcccatttcaatgccctcaatagtaaaaccggcgaatgtggagacccatccttaatgaagagaccagtttggtcattcttactattttccatggattttcaacatgattaagaaaaaataatttgaggctgagaattgtagttacccaactgaatggaaggcaaaggaagaaactagacgctcccaggtaactgcccagtttttgtatttgtttttcctttccaccaatgacaaggtatgctcaataactttactcccgaaggaggatatcccattctgaaaaacacaccactgtatgcgataaaggcagggggaggaaacattacactgtgggagagggaacaaacgtttgatcagcgtgtaacagaaaacagttctggcaactattatttcttcttctccctcaaatccaggaaaggtccataggccattttctgtaatatttcaccaaccaaaatgatctcttggacttgaaaataaacgcccccatttccaaccctccatcactctaaaattattagtgatcttcaggtacttgaaaaag

SEQ ID NO: 116250 - DNA, 484 bp, Homo sapiens
gctaatttttgtattttttgtagagatggggtcttgccatgttgcccaggctggtctcaaactcctgggatcagctgatccatcccccttagcctcccaaagtgctgggattacaggcatgagccaccacacctggccactctaggagctttttaaagtcctgatgtccatgccatcctagaccagtttaatagtaatctccaggtgggggcccaagactcagcattcttttaaaactgtccaggtaattctaaagtacaacccagtgggacacagtggttctcaaccctgctgcctattacacatcagctggagatctgttaaaaaataccagtgtctgggccccacccctagagattccaattaattggtgtaaggtgaaacctctggtagctttgtttttttaactcctcaagtgattccgctacgcatctggtgttaaggaaagagctgttgttctcaaacttggtggtgggatcagaat

SEQ ID NO: 116251 - DNA, 251 bp, Homo sapiens
gctgattagtctgcaatctttatatgatatgggggaagtcaaagcaaggaatctgggtacaaggtagaaagaaagtgctgttcacatagagtaggccgggcgaggtggctcatacttgtaatcccaacactttgggaggccgaggcaggcagatcacctgaggtcaggagttcgagaccagcctggccaacatggtgaaaccccgtctccacaattagccaagcgtggtggtgcacacctgtaatccaagc

SEQ ID NO: 116252 - DNA, 566 bp, Homo sapiens
ggctggagaggatttgtgaacagggcctgggggtggaggggaggttgggacctgtcagaggcagcagggctgaagaaggtttgtgaacagggccctggggtggaggggagctggggatctgtcaggaaggagggctcatccctgccttcaccaagcccacccaccagcaggcagcctttctaggagctggttctttctaaggataccaggctccttcctggaagaaaggaaagttgttctactttaaaggataacataggccgggcacgtccgtctctccagtctttgattgtcctgcaacaagtgcattgatgacaaaatggaatgcagtgctcagccctcctggcctcctgcctgattctcttcggagtgcaccacatgggtggaagagctgcccccaccacatacagccctcacccacagtgtgatgggtagaaccaggaccagatctaccgggagccctcctcccacacaccgtggcttctatgaaaggactaaatttaggacctgaaaccagctgaaatggggacagcagagcctgctgcgccgcagctgcccatccaggt

SEQ ID NO: 116253 - DNA, 369 bp, Homo sapiens
gatctggccaagcttctctctgtgcaaaagaactgctgagtttgtagttgtgccccctcatttgttctggtggaggtgctaagtccagacaactcccagtggcagaagtgaggtcaggcctggcccaccaccagccatagtgatgtttgtggattgactgctagtgacaaaatgctcttccactcagcctgcccagggacaccagcacacacgttctccagcttcccttgtcccagctaagtgagcagagtgtgcagaagtgcgttgcagaagcacctgcagggactggctttggacacattctttgggcatctccattagcacatgggagtgtggacaccagccacagctggccactgcacggctgaa

SEQ ID NO: 116254 - DNA, 388 bp, Homo sapiens
tgtcatccaatccatcggcaaatcttattagcttacttccaaatatattcccaaactctactcttctttctatctagcaccactgccctcgtcctagtccaagcctccatcatctcttgcctggaggtgtgtcgtggacactctcacactgaatcaagttagcctctgctcaaaaaacctctaatgggccaggcgtggtggctcacacctgtaatccctgcacttcgggaggttgaggcaggtggatcacctgaggtcaggagttttgagaccagcctggacaacatgataaaaaccctgtctctactaaaaataaaaaaaattagctgggcatggtggcacacgcctgtaatcccagctactcaggaggctgaggcaggagaatcgc

SEQ ID NO: 116255 - DNA, 742 bp, Homo sapiens
ggttttctttgaatttgtgtttttattttctccttttcatttactgttactatccagatttgattatgaacatctattacttttgatgttagcttaaaaacatttttaaataaaaagagaatcccattttccatgccagtataaggatactcagaaaagtaaatcacagtttgagaattgccagccttaaaatgatcaaaagtacaacattgatgacatggaggcaggagagtcacttgaacccaggaggtggaggttgcagtgaaccgagattgtgccactgcactccagcctgggtgacagagcgagaccctctctcaaaaaacaaaataaaacaaaaccaaatccaaaaaacagaactctttctcttcaacgttgtgttgagaaaactggatagccatgtgaaaaataatgaagttgaacccttactctatattatctacaaaaattaactcaaaacagatcaaagactctaaatttgagaaccaaaactgtaaaactcttagaagaaaacataggggaaaatcttcgtgacctttgatttgacactggattcttcaatatgacaccaaaggcacaggtaacaatacaaaaataaaagataaattggatttgattaaaattgaaaatttttgtgcatcaaagcatactatctatgagaaagaaagacgacccacagaatgagagaaaatatttgcaaatcacatgtcttttaagggtctatacacagaatatataaaga

SEQ ID NO: 116256 - DNA, 626 bp, Homo sapiens
gagacagtctccctcttgtcacccaggctggagtgcagtggcatgatctgggctcactgcaacctccacctcccaggttcatgcaattctcttgcctcagcctcctgagtagctgggattacacgtgcccgccaccatgcccggctaatttttgtagttttagtagagatggggtttcaccatgttggtcaggctggtctgaaactcctgacctcaagtgatccgcccgcctcggcctcccaaagtgctgggattacaggcatgagccactgcgccaagctgaacatctttattaaatgctcctgccaggttctgggcagacaagctttgatttactttccctttcaagagccaagggaataaagctaccaagtacgagttgatgatttgaactaattctgaagatttgtgaaaatgctcaaaatccaagtggggagtgaagagcagccgcctgacaactaaaactgggaaatgggtgttatttgtctcacagtccccgcttgcccctgcctgcgctgctccatctcttcccctcctccctgccacttcaggagcccatgccctctccccttattgaaaccaaaacaaacactgctgttctaaaagaaaggatgtgaataatagaa

SEQ ID NO: 116257 - DNA, 273 bp, Homo sapiens
ctccagcaatccggggatagtttcagcaagatcaacactgagtatccctgacaggattcagccaagggccagtggcagcttcccagcctctttgggtaagagccccttctttttttgctcctcagtccttccagtagtttttaaccaatttcctgtgttccatcctactctgcttgagatatatagagaggtttctacttttgtgtttgagcactgaatgatacatagttccttccatatcagtccatagtgagcttcctcattctctagtca

SEQ ID NO: 116258 - DNA, 309 bp, Homo sapiens
cgtggatgctactcatggagagttcctctcttacatgtgataatctgcccacttctagcacccaaacaaacaaccaactccaattggcagaggggaaatgactctgtgtttcatcctgaggaactctgaagggccacagaccttgccaaggcacttcacctctaataccccagagatagtgtgcatctctggtttttccatacaatggacagagctccagaactctctgtacctttaggcaagtcttctgaaggctcagaggccactgtcctgcctgccaacctccaagtaccagccaaccccccaagc

SEQ ID NO: 116259 - DNA, 537 bp, Homo sapiens
gcagggatttgtgggatgcccattcctctttatctttcactctttataacaatagctatcaattatcgcacactctaggggccaggcaccatgctaagcactttatgtgcctcatacaatcctcacaacaatgctatcatacaatcctcacaacaaccctttatgtgcctcatacaatcctcacaacaaccctcatacaatccttacaacaatccttacaacaatcctcacaacaaccctactgatgctgttatcacatccagctcactgagccttagagtggtcaagtgaggggtggatccagacttgaacctgggtctctccgactcgagcccttgtgcatgaccttgcccctccatggaggtgcccgggagatccttttctcccctgcagtgcttcaaaagctcctctgtcacctgctctgtatgtgtggctttctgtttgaaaaaaacagaagaaagaatggtgttcttggaaaaacaagtttggtaaccccgggctagaccccggcccctctggatttctgatgtattacct

SEQ ID NO: 116260 - DNA, 455 bp, Homo sapiens
gaaaatgtatttgcattaaattacatgtccacctgtgggtctttttcacccaaggcagcattgaatatgatcactttgtaatctttgctattttggtaggcagaaacaatcttattattttaatttgcatttctttggttactagataaattgaacttagatttaccagccatgtgaggttattttttttttttgtactgcattgtctcttctggtcctttgccagattacctactggggtcttagtgttgaatccgaagtgaattttttggttttcaactttacttcccttttattcttccttttaaaagatgaaaaaagaaaaaggccaagtgcagtggctcacacctttaatcccatcactttgggaggccgaggagggaggatcacttgagcccaggaattcaagaccagcttgggcaacatggggagaccctgtatctatttaaaaaaaa

SEQ ID NO: 116261 - DNA, 147 bp, Homo sapiens
tctcgcccaggctggagtgcagtggtgtagtcaggtctcattgcaaccttgaccctcccaggctcagcccccggagcagctgggactgcaggcgcatgccgccattcccgacagttttttgttttttgttttttgtttttctttttt

SEQ ID NO: 116262 - DNA, 603 bp, Homo sapiens
tcagatggggactgcagattcaaaccatgacttgctgtcctgagcctcgcccagatttctaaatccaccattccatcagggagtaagaaacaaaatttagccccatccttcttggggtttctacccacttcacagttttttggggtaacaactcctggatctcctgttgcccaagcccaaggctgcagcttgaagattttgtttcctggtcttgacacacaggctgccctgagctatccatcattcctggattgcagagtctcttcacatctgcagttgtctgcagcccaagcacagggccctggcctcatctccaaggctggctcttcagacaacgactccatccagggtcctgatggtgctcctgcaggaagcaggccaagatcctgctgcttctttctaattcaaggccttcgtcttaaagcgccgtgccctcaaattgccttctttaaaatgcttttagaactcaaataggaaagatgtgcaaatggtttctccttttctttcatgctctatatgttcattaagcaactactatgcccagtcactgttccaggcagtgggggaggaacagcgactgagagacacaacatctcttcatgg

SEQ ID NO: 116263 - DNA, 400 bp, Homo sapiens
tctaaagcgctatatcgttcctaaatcttgagaaacagaagtttgaggtccctcctaacccccgttgggaattggtccccatatccaaaaataagctgccggtgtcgctgcagatttacccactttaggcaccatctgacaacttcccacgtggaagtagaggttccagctctttccatcccctcccacgtgcccgtcccctgcctgccgtgctccgctggcatctgaccctgggtttgttagggggccgagtcgggtgcagcccctggcctcagagcacgctgtgatcgctcttcccacagtaagcggctgtgttccttgccgcagttgaccatgtgttgccgcagactctccgcagactgttgtctctggaggcagtcgggcaccaggagcctgcgac

SEQ ID NO: 116264 - DNA, 356 bp, Homo sapiens
gttgggttgagtagtaggagtaatggagaaggttaaataaaaagctttagaatcgtgttaactctaagtcagtaagattatagccagagcatttttataattacaatttcttgattaacacctgttttacagaacatctatattttaatagctattttaattgcaggacacacaaagacaatattcttaacctagaaaagttcatgatctagagaagacacacagctaagcaagataataaaactgtaacagaaaagacgtagctttttaggagcacagaataagctctaagattagttctgcctgggaaataagtcattaaagaagtgatattattgttggatccaatgaagcaa

SEQ ID NO: 116265 - DNA, 965 bp, Homo sapiens
cctggctctgagttctgtgttgaatttgagctctcttttctttcctgtagtctagggcttcttgaaaagtttcaagaaggaaattcacaagccaacaaccaaagactgtaactgagtggcaatcattatagatattataacaatcactaatcatttggtcaagtgcaagtggtcactattatcttaagaattcagaacaccagctgaattctaagaaaatttgttttctgtcccaatttgcacccaggacccttgtggactggagtcatagtgacaagaccctttacaagtcaatttgtagaaactctggcagaaaaatggcattgcttgccttgtggaaaactgaaaatatttcttcaattggctaagaatcagagatgagacagccacttttgctagaaataagaccacagcccaccatacatgaagtttctgtgaattaactataaggtccttcgctacgtgaaaagagtctggcttttttagcaccacggagagactgccagctagaaaaacgccccgatcctgccctgccatgtgaactgcttcctgcacaggagctgggtctgctgagagaggagacatgtggctggactcttctgagaatattaagttactatgaaattaaattaaaagcatgctgtgaattccagaggcagcgaacttggtagagaaagaacaccattctcccctcacaggtcaggtttttttggctggcatcgtggcattgggagagcctaggaacagtattttccagatgtttcttgtttctctcttcatttgctcacttgcattttctgattttcttacagtgaccatgtattgcttttatgagaagaaaaggaatgaaacattcttattttaaagcaaaaaggagatatatgctcaggaattatcaatttataagaagttaaataggaggaggttggtggtggaacaaaaagaggctctgcagaaacaccgct

SEQ ID NO: 116266 - DNA, 304 bp, Homo sapiens
ggcccatagcactagactgtctcaaaaaaagaaaaaaaacgcttggagccagaccgtctgggtttgaatctgatgtcatactgcttagctggtgacttttggtgagttgccaaacctctccatgccttagtttgcccctctctcaaataggggtattgttaatagtacctaccacagagtttgttttgaagattacataaatctgtgtaaggcatttaaaagctttgcatgtaaatgctctaatgttacctgctatgaagttgaaaaggtcattttcttagtggtggctgctgtgtaacagtga

SEQ ID NO: 116267 - DNA, 548 bp, Homo sapiens
  misc_feature (488)..(488): n is a, c, g, or t
cggtcgattcttgatgatcccaatgcagcggactcggcagggtgagacattcagaggaaacgacgacaggaaatggtgacagatagggaacgaggatgaagggaagggagagccagtgatgactggcagtggagtggggagcaccgccacctctcctcctccacttgcccctcctgtggcactggacaagcgagtgggcttttcgttgtccatgggcttttttggtggggatgtgaccagctttgaacccttccccttaaacatgctcctcctgcacggaagagacaggggcaggggagagactctctccccaccacccagctcaggccccagcacagcccggcctctggcctcactggcgtctgtgcccagtgacgcaggcaggtgagctcctggcaaattagcattgcaggctgtgctctctcctcctgctctgctgcagccgggagtgtgcagagactggaggggatgacaatcacctcccaggntgtcttcacacgtgccctccagcccctccctgcccctctttctgccgattccgctgcatt

SEQ ID NO: 116268 - DNA, 365 bp, Homo sapiens
agcaccgccacctctcctcctccacttgcccctcctgtggcactggacaagcgagtgggcttttcgttgtccatgggcttttttggtggggatgtgaccagctttgaacccttccccttaaacatgctcctcctgcacggaagagacaggggcaggggagagactctctccccaccacccagctcaggccccagcacagcccggcctctggcctcactggcgtctgtgcccagtgacgcaggcaggtgagctcctggcaaattagcattgcaggctgtgctctctcctcctgctctgctgcagccgggagtgtgcagagactggaggggatgacaatcacccctctgttttctgtggtggctctg

SEQ ID NO: 116269 - DNA, 747 bp, Homo sapiens
tgagtttcctcttctgtgaattgattgttcatatcttttgccttaaaaaacaactggctacctcttttaatatacgagagtactttatattctgagtactaaccttctgattggtattatatgttgcgaatctcctctccaaagctatgacctgtttttttattatggagtcttttgtataaagaactttcatgtgctccaatatgtctatttttcttaatagcatgtagttctatgtcttgtttaagaagtgttttcttatcctgatgtgaattctctggtaatttattctaaaacttttataatttttcttttcatatttaaatatttgatctatcaacaatttatttttgtatatgatgtgagattaaaatgcagttttattttttccacaggaataaccagttgccctagtaccatttgctaaatagttcatcttttcctcattgatttgtaatgtcaccttattgctggccttttgtttttccatgttaattttaagattagtttctcaagttctgtgaaaaaaaactttggagaatttgattggaattgcaacatacagatgaatttgaaatcatttgccatctttattaatcgagtcttactgtccataaaaatagtatattggttttttatttaagtcttaccttatgccctttaatataggttttcaattttcattttatctataaagctcttgcatgcctttttttaaagatctgtatggcttttattacattacaa

SEQ ID NO: 116270 - DNA, 781 bp, Homo sapiens
ggccgcttcgggagagcgggcagttctaggaggccgacctggagagcctcccggttccccttccccttttcccggaccccgcggggacaccccctcgccgccacccgggcctccccgagggcccaactgcgggtcaggcggcccgggccagccgaaagggaagtggggctaccccacagccaggcagcggggctggggtcagacccgggagccggaggttggagacgtgcgacagtcacctgcgggcagattccagaggggagacccagggctgcaggggacgccccttcgtggcagctacccagcctcggcccactgccagtgttacgtggctgcatgaccatacacttctgggtagagcccagtggaagacaaagaagactcaaggaatagcccttgagatcctgaaccaactttgaaggcagagaagtgggctagaagaagtggggttggagcctccaccaaggacaagaaggccttagccccctgcttccagctcaagctgaagtggctgtgagctgagctaagaagaccccacttcgccaggaggagtgcctcacgcctgtaatcccagcactttgaagggcccgaggcaggtggatcacgtgaggtcaggagtctaagaccagcctggccaacatgatggagtctagctctgtcgcccaggctggagtacagtggcgtgatctcgcgtcactccaacctccggccccccgggtccaagcgattctcctgcctcagcctcctggggtaagctgggactacaggcatgttccacccg

SEQ ID NO: 116271 - DNA, 161 bp, Homo sapiens
ccaccctccccacttttctgaacaattacttaactgggtaattctgccccccaacctggataatgtgatcttagataattcagtctggtggattactcaaaccaccagattctcatttcaaagtttttgtacctgaatcttattcgagtcccatcccaccc

SEQ ID NO: 116272 - DNA, 356 bp, Homo sapiens
taaagacagcaggaaacaaaccaacttctaacaaaacacttccctgctcatgagccttgaatggccaattaacataaatggttcattccagcattcaagcccttctgcagcacagccccattctaattgtttcactggtcacctactctcccatctgtcctctagccaagggtttctgaccttagcactattgacattttgagccagacaattctttattgcagctgctgtcttctgtattacagcatgttgagcagcatccctggcctctacctacttgatgctagtggcacacagccccactcaagttgggacaagcacacatgcctccagacaatgccaaatgtgccccgggg

SEQ ID NO: 116273 - DNA, 600 bp, Homo sapiens
gtctttttgaatgttcatttttctccaggttctacttccatcatgaggaagatccatccatgtggttagaggaaccccagctcttagagtcttctcttcccttgtacccaagaacctttgccataggaaccatttgtcaattaataatttactgccctgtaaggaagcaggagatttggtcaaaaacagccatttctagttacttatttttcagttgttggaaatcttacacattggggtgggtttacagggtttttgtttgtttgtttggagtgtttttttgtttttgttttctactgttaaagacttcctattcagttttcagaactttggaagtggctgtaatttttgtgcaccaaagggggcagtcttgtaatgttttatttagttttttggcctcttttcattctcagtcccctatgcctattttaccagacaagaacactaactgtgtgttactgtattcagagtgaagatccagcaacatttagcatatttgggatgttatattaatcagacatgctctaggaaattttttaacctctatttcatgttatattgttaaaatctggctagatgctgtggctcacacctgtaatc

SEQ ID NO: 116274 - DNA, 345 bp, Homo sapiens
gatgatataaaacatgcacagtagccgagtgtggtgatgtgtgcgtgtagtcttagctactcaacagtccgagacatgagctcaggagtttgtgaccagcatgggcaatatagtgagactctgtctcaaaaaaaggaaaaaaaaaagtgcatagtttatggtatcccaactggaggagctaaagacagaatagcttaacatcatttagaaaaaaaattataattgaaaagtgcaaatacacattttgcagtgtttttggcatttacaaaatatgtaaacacttttagtttcttagggaaaagatgacgataggctgattgaaaaatatcatttttacttgtcaca

SEQ ID NO: 116275 - DNA, 277 bp, Homo sapiens
cctgccttggcctcccaaagtgctgggattacaggcatgagccactgcgcctggccagatgagtctttttaaagtaagattctaatcaggttcctttgttgtccctcaggcaccagcagagttaattaatagtctgaataaatggcctggcattcactacaccctggccccagcctgccttcccatcatatttgtcactctgcttcatcgctttgctccagccaagctggactgctttccaggccgctaacatcccgctcctttctttttttttttt

SEQ ID NO: 116276 - DNA, 1281 bp, Homo sapiens
atggccacagcaggaaatccctggggctggttcctggggtacctcatccttggtgtcgcaggatctctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgca

SEQ ID NO: 116277 - DNA, 1745 bp, Homo sapiens
atggccacagcaggaaatccctggggctggttcctggggtacctcatccttggtgtcgcaggatctctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaggttctgtttgtagtgtcctccttgcttccccttccattcaagagattccagcaaatggctttccctccatgggtcgcatttccctatctgggaaatgcgagctttgaccaggagggccacagagtttcagagggaggggccattccctggatagttaagagaaaccagtgccatggatgttgtccagtttctgaaaagtcaggtcagcaaatggtaaccgtagagattttcttgcttagtttaactattcagctttagttgatctatattcatttttgtcttcttaactgcatttcaagaatttttaatttgcatgtgtctcagaagttggctgctgcagctagagtctagtggggagaattgtggcgagggctactgtgagtgacagcaacagagaccaaggagtagaaagagggaagtttgaggggcacaatggggcaactgaggggcaaggagatgggag

SEQ ID NO: 116278 - DNA, 1828 bp, Homo sapiens
atggccacagcaggaaatccctggggctggttcctggggtacctcatccttggtgtcgcaggatctctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggtgagctcacgggtgtgtgtctgccctcttcaaggaggtcctctgcccagtcgcgggggctgacccagagctctgcgtcccaggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaggttctgtttgtagtgtcctccttgcttccccttccattcaagagattccagcaaatggctttccctccatgggtcgcatttccctatctgggaaatgcgagctttgaccaggagggccacagagtttcagagggaggggccattccctggatagttaagagaaaccagtgccatggatgttgtccagtttctgaaaagtcaggtcagcaaatggtaaccgtagagattttcttgcttagtttaactattcagctttagttgatctatattcatttttgtcttcttaactgcatttcaagaatttttaatttgcatgtgtctcagaagttggctgctgcagctagagtctagtggggagaattgtggcgagggctactgtgagtgacagcaacagagaccaaggagtagaaagagggaagtttgaggggcacaatggggcaactgaggggcaaggagatgggag

SEQ ID NO: 116279 - DNA, 1644 bp, Homo sapiens
ggaatgagcctggatccggggagcccagagggaagggctgggaggcgggaatcttgcttcggaaggactcagagagccctgacttgaaatctcagcccagtgctgagtctctagtgaactaagctcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaggttctgtttgtagtgtcctccttgcttccccttccattcaagagattccagcaaatggctttccctccatgggtcgcatttccctatctgggaaatgcgagctttgaccaggagggccacagagtttcagagggaggggccattccctggatagttaagagaaaccagtgccatggatgttgtccagtttctgaaaagtcaggtcagcaaatggtaaccgtagagattttcttgcttagtttaactattcagctttagttgatctatattcatttttgtcttcttaactgcatttcaagaatttttaatttgcatgtgtctcagaagttggctgctgcagctagagtctagtggggagaattgtggcgagggctactgtgagtgacagcaacagagaccaaggagtagaaagagggaagtttgaggggcacaatggggcaactgaggggcaaggagatgggag

SEQ ID NO: 116280 - DNA, 1608 bp, Homo sapiens
atggccacagcaggaaatccctggggctggttcctggggtacctcatccttggtgtcgcaggatctctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacgggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaggttctgtttgtagtgtcctccttgcttccccttccattcaagagattccagcaaatggctttccctccatgggtcgcatttccctatctgggaaatgcgagctttgaccaggagggccacagagtttcagagggaggggccattccctggatagttaagagaaaccagtgccatggatgttgtccagtttctgaaaagtcaggtcagcaaatggtaaccgtagagattttcttgcttagtttaactattcagctttagttgatctatattcatttttgtcttcttaactgcatttcaagaatttttaatttgcatgtgtctcagaagttggctgctgcagctagagtctagtggggagaattgtggcgagggctactgtgagtgacagcaacagagaccaaggagtagaaagagggaagtttgaggggcacaatggggcaactgaggggcaaggagatgggag

SEQ ID NO: 116281 - DNA, 827 bp, Homo sapiens
atggccacagcaggaaatccctggggctggttcctggggtacctcatccttggtgtcgcaggatctctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcaagaccagaaggactcctgcaacggtgactctggggggcccctgatctgcaacgggtacttgcagggccttgtgtctttcggaaaacccctcctccctcagacccagcggtccaatgccacctagactctccctgtacacagtgcccccttgtggcacgttgacccaaccttaccagttggtttttcattttttgtccctttcccctagatccagaaataaagtctaagagaagcgca

SEQ ID NO: 116282 - DNA, 1195 bp, Homo sapiens
gccgactactactactactactactaaattcgcggccggtcgaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaagcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaagtctaagagaagcgcaggttctgtttgtagtgtcctccttgcttccccttccattcaagagattccagcaaatggctttccctccatgggtcgcatttccctatctgggaaatgcgagctttgaccaggagggccacagagtttcagagggaggggccattccctggatagttaagagaaaccagtgccatggatgttgtccagtttctgaaaagtcaggtcagcaaatggtaaccgtagagattttcttgcttagtttaactattcagctttagttgatctatattcatttttgtcttcttaactgcatttcaagaatttttaatttgcatgtgtctcagaagttggctgctgcagctagagtctagtggggagaattgtggcgagggctactgtgagtgacagcaacagagaccaaggagtagaaagagggaagtttgaggggcacaatggggcaactgaggggcaaggagatgggag

SEQ ID NO: 116283 - DNA, 240 bp, Homo sapiens
aggggagaggaaaatggactcctgaactacagaggagggccccagggcctctgccctcagagaatgatgtacaaggtgggattagagcagctaagtttgtcatctaatcatggagctcaggactcagaacaaactgcaggcatccctactacaggccagggattgtacacggccatcctccttcagccaacaaggttactcacagcatcccgaattcagacaggtaagcggcgtggccag

SEQ ID NO: 116284 - DNA, 417 bp, Homo sapiens
atccttgcattgctggtctgctgaaaggagggcatcaatcatcccaaggagctcctcagtctcctgacatatcataagcaaaaagaggatagcttttattcatgatgtgaccagttacattcatatcaataatacatgctcatgttagtgagaggggcagcaatcttggactgttatgacactttaaacatgctccaaacaaggccgggtgcagcagctcaagcctgtaatcccagtactttgggaggccatggtgggcggatcacttgaggctaggagttcgagaccagcctggtcaacatggtgaaacccctgtccctactaaaaatacaaaaattagccaggcgtggtggcacgcgcctgtaatctcagctacttgggaggctgaagcaggagaatcgcctgaacctaggaggt

SEQ ID NO: 116285 - DNA, 714 bp, Homo sapiens
agaggtgcatccacctcagctccctgtgccttggcaggggctgactggacactggccaaggctcaggcaggcaaagatggtgctgagctcaggggctgatacccaagagccctagactcaggatctggtttctgtgtccccctgccttgggctgacagttcagggtgaggccaaaagtcctggccaggccgggccatgagaggccctggtgctccctggggccccatgaggccctcgtgtgcattccttttatgaacttagtggccaggacatctgggaaaagcataaagggccatgttatctccccagggacccaagagcttttctctccagccatggggagggtgaagaggagactcagagatgggtcctctctctcaaacaggctggtctaacccccagtgtacagatgggggaaactgaggccaagtgaggagtcaggagcagagctgaggtcagaacccaatccaggggtaaggctggctctggggagagagtccttggtcctgccctatggcaccaccacttccctgtacagcccttggggactctagaggcgactcccctccagccagctccgtgccttgggcactacccagccttccatggagcccctccctgctctgactttgaagagccctggcagaagtggttgtgctgagcccaccgtggagttccttatccacaagggcccccgggaatggtggggcccag

SEQ ID NO: 116286 - DNA, 379 bp, Homo sapiens
gaaatacatgtttctgtagcatgattgcagcctactgcagtccagtatacttgggggtgagtcttttcagtgataaacacacctccagtagcagagcagcatattgtacttccaggtggaagaagacctgcctgtgctgcgcaactgagggcaggatactcccagagagggactctgtagcctctctgcctgccattgaggcttgttgccttggcaactaaaacacagccatccatcctttccccaggcagggagctccagtcatccttgactttgccatgaccttttctcctcccctttacaatctgtttagggttctgccatgcatctcccaggcagctttgaattttctctcccttggaaatctccaggccacctc

SEQ ID NO: 116287 - DNA, 566 bp, Homo sapiens
ggccgactgagtactctgtttctaagcaacaaaactcttcagaaacttggttataagtttttatactgtaatttcttgccagtttgtaggtgaggtttttatattataccttagttatctctgtcttctttccctagtatttatgtgtaatgtctttattccttagactatggtctccgtggaagattactgatactcccactagtattaataacaatgttaggtaacatttactgaatgtttactgagtgccaggtaatgttctaattgctttacatgtattaggctatgtattcctcacatgaaccatatgaaagagatactcttattgttgtcattttagaagtgaagaaactgaggcacagaaaacttaagtaattagtccaattcatacaggtagtatatggtagaactgaagcagttgggccccaggtctttttttttctttctttttcttctgccgccgactcctccaccaggtctatgcctttaaccatcatactatactgctctttcctttgtgagtgctatttccatgtgcattttattatagggcatccatacag

SEQ ID NO: 116288 - DNA, 614 bp, Homo sapiens
ttggccaaggtttctccaggtaattagtgggatatctaagttttgaatgccagtcttcagaattcagggtctgtattttttaattttttgagtgcttactatgtgccaagcactttactaggagcagggtaatacactggtatgtaaaaaaggccatggcctcatagttcttaggatctagtctttctatttaatataaaaaaaaattatgggtttagctcgttgtcttcaaattgggattcatggacttattctggtatttttaggaatccgcaagtctacacaagaatctttaaattgtgtgttttcattttgataacatagttcaagaaataataatataagctgagcacagtggttcatgcctgtaaccccaagactttgggaagccacggtgggtggatcacttgaggccaggagttcaaaatcaacctggccaacatggcgaaaccccatctgtactaaaaatacaaaaattagtcaggtgtagtggcgcacatctgtagtcccagctactctcgaaaaaacagaaacaaaaactctgacatgtagagtatgtagatgtagagaaaaaagtcaactgattgttgcaaaaaatgtctatttttaatctt

SEQ ID NO: 116289 - DNA, 618 bp, Homo sapiens
ttggccaaggtttctccaggtaattagtgggatatctaagttttgaatgccagtcttcagaattcagggtctgtattttttaattttttgagtgcttactatgtgccaagcactttactaggagcagggtaatacactggtatgtaaaaaaggccatggcctcatagttcttaggatctagtctttctatttaatataaaaaaaaattatgggtttagctcgttgtcttcaaattgggattcatggacttattctggtatttttaggaatccgcaagtctacacaagaatctttaaattgtgtgttttcattttgataacatagttcaagaaataataatataagctgagcacagtggttcatgcctgtaaccccaagactttgggaagccacggtgggtggatcacttgaggccaggagttcaaaatcaacctggccaacatggcgaaaccccatctgtactaaaaatacaaaaattagtcaggtgtagtggcgcacatctgtagtcccagctactcgggaggctgaggcacgagaatcacttgaacccaggggaggcagagattgcagatcactccactgcactccagcctgggtgactgagtgagaccctgtctg

SEQ ID NO: 116290 - DNA, 841 bp, Homo sapiens
atcctaatcacacaagaccttaaaagctgagaacttcctcctgctggggacaggacagatgaggcagaaggggaggttagggaggtttgaagagtgagaagaacttctgcagtggctgacttggaagatgaaggaggttatgaaccagggaatgggggcagcctctagaggctgagaacctgctgacacctacccacaaccgctaaggaaatgaagactttaattccacaactgcatgcaactaaactcagccaacaacctgaataagtcggaaaaagtcttctccagagcctccagataagaggccaggctggcgacaccttgattttgaccttgtgagacctagagcagagaaactagccaagatcactcagacttctgatctacagaactgtgagaccgtaaatttatgttgtattaagccactaattgcgtgggaatttgttacaggagcaatagaaaatgaatacaccttctgatgtagtttaatcagttgacattaggggtgacaccaagatgtgctacactgaacccaacttctgcatgtttaagacaagacgcaaggtcaaaaatttacatcaggtatctgaatgtgtagcatatacaactgagtgttgaaagaagacaaaatcgttttcatcacgaagaatatgtgctcagtaagaatcagaatgttcaattgtgtgaaggtgggagatgggaagattggtattatggcctggatccagaaatcagtcttccactataggaaatgggaatttaaagatgatcagaagacagttgggagcagagtgagaataagaaccctcaactgctgtctcacctttcagatcacgaagaa

SEQ ID NO: 116291 - DNA, 533 bp, Homo sapiens
atcctaatcacacaagaccttaaaagctgagaacttcctcctgctggggacaggacagatgaggcagaaggggaggttagggaggtttgaagagtgagaagaacttctgcagtggctgacttggaagatgaaggaggttatgaaccagggaatgggggcagcctctagaggctgagaacctgctgacacctacccacaaccgctaaggaaatgaagactttaattccacaactgcatgcaactaaactcagccaacaacctgaataagtcggaaaaagtcttctccagagcctccagataagaggccaggctggcgacaccttgattttgaccttgtgagacctagagcagagaaactagccaagatcactcagacttctgatctacagaactgtgagaccgtaaatttatgttgtattaagccactaattgcgtgggaatttgttacaggagcaatagaaaatgaatacaccttctgatgtagtttaatcagttgacattagactcctcccgtttgtaatatggagatttat

SEQ ID NO: 116292 - DNA, 555 bp, Homo sapiens
tgcctgggaacctgggggctgtacaaagagataaagaattgaagaacctaagatctctaaaggaggtttaagtgtgtcttgggattggacctttagggaggcttttaaagagaactgctttttctagactgacattcttagatagcacagctcctgtgttgatcatctttgcacagccaggctgtagcctagtgtctaagatgtaggaggcagcctataaatggttgttgatgaaataagtgaaagaaagaaaacttttccctctggcaaggaaagactcagataaaattccccatgacttctaaaggtgctcctgggcattacttttcattgtttttcctggggatgctgattcctcagaatgtcgttgtattatagtacattccttaagggatatggttttcattttcctgaatgttgctcctttctctcattttaccagcaacttgttactccctttcactttcagactcttttctctctttcccttctccttcagcaacttctctccccattgaagttagaagtaaaatgtaacaattaatcaaccatttt

SEQ ID NO: 116293 - DNA, 2348 bp, Homo sapiens
  misc_feature (78)..(78): n is a, c, g, or t
  misc_feature (418)..(418): n is a, c, g, or t
  misc_feature (2343)..(2343): n is a, c, g, or t
gacgtccccggcacgctgatggagcccgggcgcggcgcggggcccgcgggcatggcggagcctcgggcgaaggcggcncggccggggccccagcgctttctgcggcgcagcgtggtagagtcggaccaggaggagcgccgggcttggaggcagccgaggcgccgggcccgcagcccccgcagcccctgcagcgccgggtgcttctgtctgaagacgcgccgcctctcgcggagcgcgcccgcggacgcccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcnaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagccncgctg

SEQ ID NO: 116294 - DNA, 437 bp, Homo sapiens
actcctgaccttaggtgatccacccgccccagcctcccaaagtgctggcattacaggcgtgagccactgcgcctggccgaagctattgtttttatctgagtatttggtgacttacacaagcagtccccaacctttttgggggtggtttcggagatgaaactgttccacctcagatgatcaggcattagttagattcccataaggagtgcagcaacctagatctctcacatgcacagttcacaatagagtttgtgctcctatgagaatctaatgccaccgctgatctgacaggaggcagagctcaggtagtaatgctcacttgcccaccgctcacctcctgctgtgcagcccagttcccaacaggtcaggtccaagttccaggggttagggatccctgacttacacaaatgggtggaaatacaatgtttagttttgta

SEQ ID NO: 116295 - DNA, 206 bp, Homo sapiens
cccacattagggaagtggtggccgtgagagctgggcagcgaatttacagggggttgctggggagttgcaccttacatttctcggcaacgtccacattctgcaatagggcaagcttggcatcagggagactaagtgaaaagctactgtggtaaggcatggaagtggcttgggctaacgcagttagcagtagagacggtgacaaatgg

SEQ ID NO: 116296 - DNA, 287 bp, Homo sapiens
gacaatcaaaagctagtcctgtgaggtaagacacaggagatggacataggcaggaaggttctcaagatcagtccatcagaattgatgccctaatctctatgccctcatggggtcagggagacctgctgagttatttactgcctcaagtcagataagtctgggcatcaaggtgggctggtcctaactaggaggagtggaggaggaagctagactgtgctgacctggagtccagaacactgaggttattgggggaggagtctccacttgcacttcccagagatccctcc

SEQ ID NO: 116297 - DNA, 660 bp, Homo sapiens
gctctgccagtagcagaaattaagagtatttctagaaacattaatattggtgtatgtatagtaggtttagatttaaagacctttattcctaacatgactacaggctacttcagacaactatgacagggacttgaaaatggacagtagacttcctatagagaggatctggagggcacttaggtccacggaaatttctaaagtatgactactaacataccatgattagcccctgatatttaccctatcttacttgctccactgctttgttgctgaatgaaaacatagacaacaggaagtgggaaataggttttgaacagtttagttcaaaataaagtgtgggtgaacatggttaagtcatgggaatattcttaaatatgctcaatttgacattggtgtctttaggtagttaaatgttgcaaattttattgactcaagacaaaaattccatccaaatgttaaacaagaagttttaatctgctccatgatcaagctttaagaagcatgtggactctctgaagttttgtgcaatacagcatatatagaaactatgtgcatttttctagggagaggatctatagctttcagaagaatctcagtaggattcttttggggtgagggggaagcaagcaaaaggttggatttgctccatttcctagggtc

SEQ ID NO: 116298 - DNA, 427 bp, Homo sapiens
ctcccattcgttgttcttaagaatccagggcatgaatgcaggaatgagacccagggaagcagagctacagatggccctcaaaatcaggatgggatgtgggctggtttcacttatatcccacacccctttagggatctgaagggactgagttttctcatccccagagatcttggaaccaaaaatctcatgcaagcaaactcatcactggcatttctgagatccagaacacatgtgagtccctcctggctgggctgctcccacatgtccagcaccctgtcggcctgtaacatcaatcagagctgaaggtcagaggtttttcaggttctcgtgaacctcacaagaacatgctgggcctccgatctcaccaacttgtttatcagttccttgtttcgatctgtttatttatttatttttttgttattattat

SEQ ID NO: 116299 - DNA, 500 bp, Homo sapiens
aggggtgtcattgtcagcttcgtgttatgcatgtggtaactgacgctcagcagccggctcatttgcccaggctagggtgcagtttgccctggggtttggagcggaccgtgtgctccagccacaaagccagggccagcatagccaggccaggtctcaggcctgccccctttccatgccacctcgatgcagccaggacatgcggcactgaatgatgcctcccatgcctgcatctgtccagcccctcggcctggctctgtgtcttacctgagagggcggggctgttccccagcagtgccgattgggtgggaggtccttgcagccgcgccctccccaggctggcagcagggggcagtgcagctgtgtctgggctgcagctgctggggtggatggagatgcttcgccccgctgcctctccagccagcacacctgctgaccttggtctccccacctcctccaggccaaggtgtctggcaggggacttggggtccatttgtctctga

SEQ ID NO: 116300 - DNA, 390 bp, Homo sapiens
ccctgttctgctcactcaggttaggtcagtaagatagatacgatccatattttcatggagcttttcacaacccgccatgcatttgaaaattaaagcatttgtcttctattccatcagtggttctcaactaggggtgattttcgccccagcagacatttaagtgtcacaagcagggaatgctgctagtgtccatatgttgaggccagggcaccttacacttggacagcgatacacacacacacacactctctctctctctctcacacacacacacacactcacatggccaaaatgtcaatagtactgaggttaagaaacttattctagatggatataaaggtgcctttattttagagtgtgtatatgtgtgaatgtgcacggggagtgtat

SEQ ID NO: 116301 - DNA, 602 bp, Homo sapiens
atataacctgagtagatagagtggatagatagatagatagatatagatagatgaggtagatgatagatagatagatagaggatggatggatagatagagtgggtggatgaattaatacattgatcggtagatacatagatatgatagactgagataggtagatagatagatacgtacatacatacatacatacatacatagatgggtacatggatatacatagatagatagatagatacttgttcagtagtagacataaggaaaacagccttgaactgagtctgactcgttcttgccaatcttcaaaaccagccccagcttctgttttgtttgttttgttttactgcatctactgacagtaaataaagacatgcagtccaatagccaagcagcctggtgccaagtgtgtctcattttaaatcaatagtgctactgctgccaactggctctgggatccaggaggccagagactgacaacagagaagtatgcatcacgtgtttgcagtaccatctgttctccctaccctatcagagctgtgccaggcctcagtccctggctccagattgtgtggttctgtctaatatctgcctttccctctagg

SEQ ID NO: 116302 - DNA, 127 bp, Homo sapiens
cgtcacccatcacacggaacatcccatcacccgtcacacggaacatcccgtcacccatcacacggaacatcccgtcacccgcagctgcccctgcccctttgtggccagctccccgcctggttcgtct

SEQ ID NO: 116303 - DNA, 519 bp, Homo sapiens
ccttgaacacagtggctccccgcaaacctcagttccctgctcccagtgctggatgaacccagcttcagagcagccccactggcagatacgcaatcagcctgagcagagaaaggggctggggaacatctgaggatgtacaactaaggatggctgaagagcccggaagtacaaagcacatgtttgctgagtgctaactctgtgagtcctgcactgagcaagcactctttgccatcatctgatggaaccccatgagacaggactgatccccattttacagatgaggacactgaggctcagggaggccgggtaactttcaaaggtcacaaatcaggtgagcggctgaactccaaagctcaccctcttgaccttcacactctctagagccaggtggcctgagtttgatcttggctgtgccacttaccagctgtgtgaccttccccaatctacttaatccctgtgtgttcccctccccctggagatagtaacaatggccctttctcatggagttgttgggaagat

SEQ ID NO: 116304 - DNA, 300 bp, Homo sapiens
agctgttttctgctccaccatggaagtctcacatgcatcacatctattcatatccatttgccacaactagacaaaaagtcctttttaaaatctgcctagagatcaggaagtattatctctggatgcctaggcaggagaggtgaatcagatattggtgggcactagtgtgttctatgatacatagcttaataaaaataagtttcagataaatctaaatatacattagaatactgtaaccacagtagaaaaaaatattggctcctttttgtgataaactaatgatggtaaatgcaccctatt

SEQ ID NO: 116305 - DNA, 185 bp, Homo sapiens
ggcgttggtgttgcgtgtgggtgtggctcacttgtggcatgtgaagagcgtgtggagcaccccaaggctttaggagtcactgcctctggaaggcccttcccacctccctccatggggagacagccttagtttctgttcatcctcctctgttcctcctgcacagccaggcaggcacctgtgcattt

SEQ ID NO: 116306 - DNA, 390 bp, Homo sapiens
tgacactggattttgcaatgactttttggggaaaatgtaacagaaaaaaacagataaactggactacataaaaatttaaaacttctgtgaatcacagggcaaaaaagggttaaaaggcaatccacagaatgggagaaaatatctgcaaatcatatctgataaggggttcatacacttaccaatataaagaactcctaccataaactgtaataataaacacacaacgccactaagaaataaaaaaaggatctgaacagacacttctctaaagaagatagacaaatggccaataagcacacaaaaaaacgttcagtgtcattaatcactatggaaatgcaaatagaaaccacaatgagataccacctcacacccagcaggatagctactatt

SEQ ID NO: 116307 - DNA, 251 bp, Homo sapiens
ccacttcagagattaacgctgtgatccagatgagatgttatgaaggccctaatgaggacagtggccatggggtagggcagaggaacagagcaacaagtgtctagagcaggggtgtccaatcttttggcttccctgggccacatcagaagaagaattgtcttgggccacagcagccaagggaccaccattggcagcagcaccaataaaacaggagctgggccaggtgcagtggctcacacctgtaatcccag

SEQ ID NO: 116308 - DNA, 719 bp, Homo sapiens
gggtgggtgtaaagtaagcccatgcgtggcaggcagtgctggggcgtggggtatatgtgatctgcactgtcagggctgctgggccataggtagggagcctccctctacccagataagcctctgttgtggagtaactattgcagtgacctctgggatgagagtttctatggtcagaggtgagtcaaggtgagtctaaaaacatatacaaaggccactgtctgggtcatgccagggcagctagcagccagggtctctgagttgggaggggttctattatgtggtcagcatatggggagggccctgttttctgagacgcctcaggaagaatacccctatggataaggagttgataagtgatggagttgacatcccactctgggcatccagggacagtgggagtcttcctggcggtgggccaccaggcagggggaccctctggatcagagcaacctcatagtcatgagacgatgagctggtcctcatctttccacctgccagcccctttctgcttcctccagcacgtttttatccgtgggaaaacaggtgaggccccagcttgttagaaagctgactgcatcgagacaccgtggattctcaaaggtcttgtggatatatgaggcgagtggctagaagttttgctgagaatccactcatttatctgtttatttgagacggggtctcactctgttacccaggctggagtgcggtggcaccatcac

SEQ ID NO: 116309 - DNA, 670 bp, Homo sapiens
tgggagctgctatcggagagtcttgcattctgggcccagccacatccctgctcttggtaaagatgcagaaactgaggcccgggaccacacacctgacaccaagtggactaggattcaggccgttgaccatattctttcaacttcaggagcaacagcacctggaggacccaaatttgctgtcatcctccacgaggcctcagcagtctccaacatggaagggcactgagccagcctgggggtttccagggaccttcctgactgaacactggaaagaccctttcattccatcctgtcccccaggtgggaccccacgccctgaggtggaacagaggtgaagaggaaggggagcggctcctgtgcattttaatagaaatgaattcaagttctctcctgaaggactcagttccttgggcccaaacttctccagtctctcatgaaaggagatgaactgcttcagataaagtgctaatcttcagcctcaaagtcctcagaagggccttctccacgctgctgggctgtgaaaggctgaaggaggtggagctggggaggaagatgaagatctagaggtctgagagagcttcaactgagtagagagcagcctgggttccaaagtcctggccccagctctgtgtagccatgtgactttagttcaggcccttgacttctctaa

SEQ ID NO: 116310 - DNA, 128 bp, Homo sapiens
catgggaggcccagaggatgcatcatattctatggccatggggaatgcactggcgtgaggggcactagcatcactaagaagttcagagaaggctctcctctggagggaagggctgacggtaggagagg

SEQ ID NO: 116311 - DNA, 223 bp, Homo sapiens
aaatacctttaggtcatataattcctaaggatataatgcaaatgccaacataatgtttatagtatggatacattagaagtatcttaattaattcaagatacatatttggggttttttgtggctaatcataagaagttgttctggttttgtttttctcagtcctcccaccagataattattttagatcagttttagatcaagtgaaaacctttcttagaaggct

SEQ ID NO: 116312 - DNA, 226 bp, Homo sapiens
tcagggatacagttgccagaacttcccagttcaggtggaggtttcctctgggtggtacaaacttgcttgatttacttctgtaaatggtgtcaggatccaatgtcaatgtcaggcactcctgatccgaatgggtcactaaggaaatgagctctgaattaagagagactggcttcaatgcacttattttcattattattaaatagtccatgggatttctcctaataca

SEQ ID NO: 116313 - DNA, 529 bp, Homo sapiens
cttctctgtaagtgtctataggtaagtggttcattctttcctggagtctaccgagagtgttctaaaactctcagagcttatcagaatcctctatggcaagcttgtccaacccacagcccgcaagccatatgcgacccaggatggatgcgaatgaggctcaacggaaattcgtaaactttcttaaaacatcgtaagatttgtgtgtgtgtgtgatttttattttttgtccatctgacagttgctgttgttttcattgttaggatatgagttccagttccagtatttctgtggcagagccttttgttctttagcatgtagggatttatttaggtctattacttgttttcactttctctttgccttttcttaaatttcaactttaataatagcctttaatagaataacagtgcattagctttcattgactacatgtatgctgaagaattcatgctaaagaaataataaggaatgtgtgccaagatgtggctatgaggatgttcattactagattgtttataatagcaagaca

SEQ ID NO: 116314 - DNA, 241 bp, Homo sapiens
ctgtcagtcgctctgggggatcagagtcacggcatcattccatatctctaatgcctatcctttaagaagcatggatacacacttatggaatgagtgaatgcaatggtcataatatatcatctcatatcatcttacatcagttttatcaggacaggaccatgcacaaacatggacaataattttcctttaggaaaaagaaatcttacataatttatcttttctgccaagagcgactgccatg

SEQ ID NO: 116315 - DNA, 793 bp, Homo sapiens
tgccatgcctttaagtgcactaatcttttcttgtacaatatttaatctgctcttactcccatccagtgttgttgctgtttttttgagacattgtagttttcatctttaaaatttcactttaggtcttctttatatcttttatatctctccctaactttttgaaaatatagtgataataactgctttaattactttctctgccaattctaacatctgtgtcagttctaggcctgttttgattgattgactttcttctcattattgatcatgttttccttcctctttgtatgcctggtaaactttgattgactgccaaacatcgcaaattttaccttgttgtttcctgaatatctttgtattcctatgaatcttgagctttgttctgggatacagttaaattttttgggaacaactttcttctaagtctttcatgattttttaggtgggtttggagcagtgctcagtgtagaactagtaattagtgtagagctaattattcctcacactgaggcaagacattcctgagtactctacccaatgccctgtaaattataagtttttccagtatggctggaggcaaacaatttacattttcttatgaaaatgaagtctgcaaacaagattactttattaaatcaccaccttctcagctgttctcctctgtgacctcttggaaaaagcggtttttcatcctgtcaaaggctggggaaaagagctttagtctttcctattataaagaccatcatcaccgaggttccattgaaattgatcagtgtgtatccaagcaggaaaa

SEQ ID NO: 116316 - DNA, 261 bp, Homo sapiens
ctgaggtgggagaatcacttgaacccaggaggcagaggttgcagtgagctgagactgcaccactgcactccagcctggcgacagggtgagactccatcttaaaaaaaaaaaaaaatagaaaacgaaaaaaaaagaaaattcaatgtgttgagattatcagggagggcttcttggatgtggtgcctgatatgggcctgaaggaaagacaatatttctatagcagggttggtaagggctgtagcaggtagaaggaactccagg

SEQ ID NO: 116317 - DNA, 341 bp, Homo sapiens
ataaactgactataggaagaagagagcttaggaggcagcccatgggcaggtcctggcaatgaatgaaaaaaaaaaaaaaacaaaaaaaaaaagaggcagctgctgaatatggttaggggtgatgtggctgtggctgaagctcaccctctgcaaagcacatctgcaaacaaggggtgcagcagggcaaggagcaaacgcagaggggctggagtccagcaacctcgggttgaaatctctgggtcacttaagagacatgtgactttgggaagatccctaaacatctgtgaacttctgtgtcctcctctctgaagtgggcatcataatcatccttccctcgaagg

SEQ ID NO: 116318 - DNA, 217 bp, Homo sapiens
tgaagaggccttactggggctagccaggacctgtggagaatgtggcttgaatgtcccagcccaaatctagccagctgtgtggctgggggtttgccgctcccagctcagggaagcccaggcacttggcttgtcccctacccttctctccacgacccgtgcagggtccccggctttttgctctgatgttccagtgaggctgcaaggcacttgctgtcct

SEQ ID NO: 116319 - DNA, 455 bp, Homo sapiens
tgatgatgcttatgttgatctcttggctaaggtgatgtgcatcaggtcccacccctaaatagttactatttttgtgtttgtatcttgcagagatatactctttgtaaatattctgtttctcattgaatttctcccccattggttttagcatgcaatgaaatttctgtttgcaacaattaaaacttggtggtcatcaaatggtgactttctatttccttcctttctcctacatttattagctgacactccactataagaaagcactttcccttctcccccacttatttctctattcatccatttctttcttttaatacaaacatatgcatttttcttaagaatcatcacctatttaataaataatcacctgttactataattagtagtttgaggctcaaattgtcccagtgctcatcacacaagccccatcactctttggccacttgttttttcct

SEQ ID NO: 116320 - DNA, 204 bp, Homo sapiens
gtgcacgtggcttgctgctgtgggaacatcctgtgccactgcttcaacaaatacaggaagaatgaagccaagcgcagagaggtaataatgaatggccttaatagtctctttttggttgtgagcataaatgatacaatcttagggggtgagaatttgagagttctaccaatgttaatgcaaacaccctttgacccagcaattcca

SEQ ID NO: 116321 - DNA, 365 bp, Homo sapiens
ctgtttgggaggatcacttcctccacaacaaagtattattctggaatagactgttcttttgtcttttttccatttatcattccattttgatcccgtcatattatccgcctctaaaaaagtgctctaaacgtccctttgcttccactgcttctaaggtgaggacatgaattgacttgattttctgagttcatacctgtgaaagccagatgtttacctttccccttcattttctgtgtgttccaaatcacaagatagtccttttaaaagttactcctgtagcagtcatcttcacccattattataagctctatcactttttaaaaaggtacaagaacactgtgtaaacggtagattaaaaattttaa

SEQ ID NO: 116322 - DNA, 462 bp, Homo sapiens
accaaggaggcagcgtccgcaggaggtggaggcgttggcgggggggcgtgcgggtgcggtaggggtgggcaggcggggtgggcggggcctccgcggcggcgggcggggcgtgggtgggtcttccctactggagtcacccacgtccgcgcccggccgccgcggaggcctcagcgaacaccgctgcgcaccctccttagccgctaccgccgcaactgcgacccggcagcgaacacagcgagtccaatgcaccggctggactgcggaaccgcactgcccaaaccgacggacacgtccgacgccaaagcgccagactctcagcgcaaagaaccaacagtacacacacagcgcaagaagggcagcgaagcgctagcgaaaagcggaaggggacaacccgccgcaaacaacccaacgcacacaacacaccccgcaccaaagcatcaaagagacagacccaaccaaacg

SEQ ID NO: 116323 - DNA, 262 bp, Homo sapiens
tttattcttattctatcactgcatatacaattttcatatgaatgcatacttttatccatttgttatttatttaatgaatatctcatttaatcttcacaaacagcttgagaagaaggttttaatcttcccaattttgcaaccaggaagttaaggcttaaggtgggtgagtaatttacacaatgttctatgatttacacttcagcaattctcattctttagtgagtaggtttgcagtgtagactccagtgtagactttaggaga

SEQ ID NO: 116324 - DNA, 2148 bp, Homo sapiens
ggttcatgggtcaggtgtccacaaagcagacccggatgctgtgtgagccacagtcctctgcccacaaggtgcccggccttgaatgtccagcggtgactttgacctctgatgagccagcctggaagaggacagacctgtggagaagaggctcagggccccaagagcaggcctggcggggtgctgagggcaaggtggctatggcaggcttcatggaggggaggcggccaggagcctggtttggctgagcttgggcatggagtgggtaggcctctggtgcctgcagagcctcatgtaactggcatcaggactacccagttgccgccatgctcctggccccctacctgccttctccctgtgggtctctctctgtactacacacaccccgcctcttgaaggctgtctgcttccatctgacatgcattagaccccacatgcctgcaaacccacaccagggcacactggcttgggagcagatagggttactggttcctgaagctagggagccctcctcatctcagcctctctagttagtaactgtttgaccttgaacagatcgcttgatatcattaggtctcagcttcctcatctgtaaaatgggttcatgtttagtgtgtaggctggtgagagtcaagtgaaatctctgaatatgtaaagggactttttaaaccagtgattcttggccgggcgcagtggctcacgcctgtaatctcagcatttttggaggccgaggcaggcagatcacctgaggtcgggagttcgagatagcctgaccaacatggagaaaccttgtctctactaaaaatacaaaattagctgggcgcagtggtacatgcctgtaatcccagctactcaggaggctgaggcaggagaatcgcttgaacccaggaggttgcagtgagccaagatcacgccattgtactccagcccggggaacaagaacaaaactccgtctcaaaaaataaaataaataaaccagtgattctcagcgctggttgtgcacagcatccctgggacctttaacatctacagattgctggtccaccccaacagagaccaacttcaggagtccagacagcagtccagggggtgagatagtgtcgcctcgtctctctctgctcttctctgctacatacagctaaacggacctgcaaatgatacggcagacggttggtcacaggacaactctaaaggtgggaacagcaaagtggcctggcgaggcagcctcgggacctcaagggacagcagccctgcctgcccactcccacccccacccagcagcaggaggtggcccaggccagcagactcccagcctcccatgcagtggcaggaggtggcccagacctgcagactcccagcctcccatgtggtggcaaaaggtgacgaggcaggtgttttcctcctgcagccacactagcagatgggcaggtggccagcaggcaccccgcagtcctgggagtgaacccaggggcatggtctccacccgtggcaggcatctcccacccccacccagcgacacaggacaccccaagaagggcattttatccccacaggcagcaccggcagggacccaggtgggcagaccggcagctccaggtgaatttagcagaccagaatagcacttcagcaagcattctgaaaagcaaattgtcattggaaccgtagcctccaaaagaacaggctgtacacgcgaaacctaaacagggtgacagcctgctcaaatagaggatttaacacttaacaagatcagtcttctaacataatatccaaaatgcccaggatactgcagaaaaattacccgtcacaccaagaacaccgaagatcaatgatttgaatgaaaaaagacagcagaaggcccggcgcagtggctcacacctgtaatcccagcactttgggaggccgaggaggacggatcagatcacctgagatcaggagttgaagacgagcccgatcaacatggagaaaccccgtctctactaaaaatacaaaatcagccgggcatggtggcacattcctgtaatcccagctactagggagggtgaggcaggagagtcacttgaacccgggaggcggaggttgtggtgagccgagatggtgccattgcactccagcctgggcaacaagagtgaaactccatctcaaaaaaaaaag

SEQ ID NO: 116325 - DNA, 302 bp, Homo sapiens
agatgccagtgaccttagcaagttcaagggtcgagtggagatggcagggggcagaccagcaattcaaacacactgcgggagaggaggtgctagccacagcagaggcacagcagggacccaaaccgcctgagagcagggcttgggaaggacagtctctgtggtgtccgagatgagtctcaaaggagatgggaaatgaccagagaggagatggcagagtctgtgtggggggcacaggctgccaggctgttctgcacaaagaccaaaggagagaacagcgcccacgagaccctgggacgccttgg

SEQ ID NO: 116326 - DNA, 143 bp, Homo sapiens
ggctttactccaagagactcaaagagggttagccatttgtctctgactgctagctgtgctgacagaagagagggagcagacagctgaggctccatgtagcataccttgccatagcaggccccatgcactgtgttttgcaaatt

SEQ ID NO: 116327 - DNA, 237 bp, Homo sapiens
aaagaaatggtccacaaacctcatcttcagtgcatactggtcacccaaattatagaggtactcatagcgcgtgggttccttacaggcctgatgggacaaaagttgggattcaagaattgtcaaggggaagggtcctaataaacatcccagtctttcagatgggagccttgaaaggctatatactggtaataaagctagtctggtaatagactagcactaacaaagactgaaacccag

SEQ ID NO: 116328 - DNA, 478 bp, Homo sapiens
gtgtggcccaagacaattcttccaatgtggcccagggaagccaaaagattggcacccctgctctatgtactgtatgattttatttatacgtcattctggaaaaagctaagttacagagacagaaaacatcagaagttgtcagggactggggttgggaagggagctggttgcatgagggaatttttgggggtgttgaaaatggtctatatcttaattgtagtgatggttacatgaaagtatgtgtttctcaaaactgtacaacagagtgaattttaacttatgcaaacccgcccatcttggttgctaagagtctctatggcacaggggtaaactggtggaacgccactccacgcggtgactgggggaacctggggatgcatgtagagtgtgacggtgactggggaacctggggatgcatgtagagtgtgacggtgactgggggaacctggggatgcatgtagagtgtgacggtgactgg

SEQ ID NO: 116329 - DNA, 776 bp, Homo sapiens
tgaaatgacagataaagccataccatataacaacttattgaagatatattaaaactggcaggttaacccacatctagagccagaaagcataaatatttttgacattgattgtcacaaagaaataatgtgaaagtatagggtattttggcatacaaattttgtgtaaatgtcaagaattcaaaggcttttatatctttgtttttggtgaggaattactaatactaaacaactttgtattatcagatattaagactccttttcattctcactaatgttcatcttaatgttttccaaactacactttaaaaccagagctgcaatttctaccacactaatgggaaaatttctggcaataacttttttgcttttataagataaaatattggtgaatgatcaatatgtgatcaacagtcttctgcatgctatttagtataaaactgcctgtttggtttttaaactggaaccactatttacaaaggatgactttaattggctaattcagaaaaatgcagaattacaaaataatcaacaaatatctgtcaagtaccacctcgttgtgtcatttgccatgggatatataaaatcaagtgttaagatatggtccttgctctcacaaaacttaccaaggaactacctaagcaacaaaataattacttcatgaactaaattgcagcaattaaagccaggtgctgtggtacatgccactgcttaggaagctgaggctcaggagtttgaggccagcctggacaacgtaacaagacttcatgtcaaaaaaa

SEQ ID NO: 116330 - DNA, 585 bp, Homo sapiens
caaaggtccccatctctcagccaggaatcatcagacaacagaggagactgaaaagtcacacctggtactttacaacccggttctacaacatacattgtcttgcctcgtgctcaacagttaaccacaacaatgttaaatgctattatcagtgcctgtgtttcagatgaggaaaccgaggaacagaaagttacacttgcacacactgtgtttacccagtgtgatgaatagcacaggcgctttcttccacaccatcccatccagttctcctaacaaccctggaaggggagcacccgcctgcgggaggaggcaggctctggggcagaggatattgcccaagtcacatgactacttcacaaagcacaccagacaggcctagattttcccactcctctgcacacacccaagcttcactgtaagctccacagtaaaacagacatttaagctccgtacagccctaaggctccctggaggctagaaacttgggctagaaatctgacactaaagaatctcttttctcttgttctcacttgtaaaacagggataagaacacttagcccaaagggttgttggaggacaaaatgagat

SEQ ID NO: 116331 - DNA, 948 bp, Homo sapiens
agcggacagtgaccgccaccgttgcccggggatgggtccctgagacttggcgaagtaggagccctttgtgattgtgcgtcagagtcggggctgagaccagtcctggccaggcagttaccaggacggtctccggaggccgggattcgcggagggtccgccaggaggaagaaacctcagacagatcgccggggacgcagcacgggatcccagcctcaggcgtgcacggacggtgtgcggaatcctccatctcaggaaggccccagtattgccaggctgggagaaacccaagccatgaggatagaccatgaataggagttctggttgacaatcccagttcactcccagcttcaaatacacaaggccaagtgccagatacgggcataaaaagcaattttggaagtggacactccagtcccagctgtcctagccctcagctatttgagttgcatccagacatgtaaatcttcccagctgaggcctcatcattgaggtgcagaaaaggggcatgcccattgtgcctgtttctaaattcctgacccacagaacctctaatcagcaatacaactgggatttgatatcagattcatgcgattccgaagaccctgaccaccaaatgcaaaagtgaaatggtctcatcctacctgcaactgagggtgaaaaatacagcattttccgtatggtccaaaggaggaccatactgttatcatctcaccagtctctgtcaagacacagttcttgaagtcttcaggcaatcatgagtatctgtcccttagcttactcatctttaagaagggagccaaaaaaccttccgacacggtgtgcttactggcccaattcattacccgtctaacgttcctttacttggagttcttccagctggtgaccacaactgggtgtagcatcacttgaactccttgggatattttccaggaacctgagggcacaccc

SEQ ID NO: 116332 - DNA, 382 bp, Homo sapiens
tctccaactatgtccagttttcagcgggtgtatgtgtcccacaccccagaaacacctataaagtcagagacctcagtgagatcctcgccagtctctctcacgtcttctccaccagcccttatgaaccctcctgtctgtgccagctactctccaaccatgcccacatttcagccccagtcagttccaggatcccagggatcaccaccaagctccccactttcactgtgttactccccagactctaccacgtgtttatatccaaacctctggaaatctcctgtctgtcccagctactttccaacctcgcctacatttcagcaggagtccgttgcaggcactgagaaatcaccaccaaactcaccaatttcactgcgttactccc

SEQ ID NO: 116333 - DNA, 206 bp, Homo sapiens
cacacagctctggtcccagttactcaggagactgaggcaggaggattgcttgagcccaggagattgaggctgcagtgagctgtgttcgtgccacaccctgggtgtgtttgcactccaccctgggtgacaaagggagaccctttctcttgggggaaaaaaatggattaagagacctagaaagtaagtccagaagccataagattttt

SEQ ID NO: 116334 - DNA, 431 bp, Homo sapiens
gatcgttaacgagctcagggtgttactgtcactgctgctgtcttgtggatttgaaagtaatgccgtgatgggatgtggtataggtacgggggagtctggttaaaagggaacagggctggagaactctctttgtcagactgtgattccccctgctctgctctttgatttgtggctgccattggtgtttacacagcctttccccgctcacactttccttggttagttgaaaagaaacagcctgttttcctgttactgaatgctggaccgtgggcttacttgttttttactctttttcattcatttgttcattcatttaaatacttactgagcatttgactgcttcccaggctttgtgctaaatgttggctctacagaaatgaaagacctagaccctgcctttcagaggctcataatctagtatttacatctcc

SEQ ID NO: 116335 - DNA, 141 bp, Homo sapiens
tgatttgccttttgtattctgcaggactcctttggcaaatgatgatgtgctttgtggtctttcattcctttctgaagccttaggtttagtatctaccatatgagtgcttctcagcaccacagttgacagccctttgaagat

SEQ ID NO: 116336 - DNA, 706 bp, Homo sapiens
gcgcccaacaactttgaactggcctggggatttctgtgcagaaccaaggactcagtgcttacagctttaagtgctttgtctgacttaatcctaatgctggaggaaaggtctcttaatgtccccaactcatagaggaggaaatgtgtgttaaatgcgtaattattgtgagctgttctatacatgctgggggaggggcagacctcacaggctcaccccaggggttcccctgcagtgaggagacttggggtaggagaaagagggcccatctgtgcagtcactggcatttggtgggtgggggtggtggtcagggaagtggtcactagggctgttttgagaaccacctctcaattcacgatttgccatgacttactgcaaacatggcctgggcagaggctcgcccaggtgccccacctctctggctgcttccttatagttcgggcttcggaagccacattcaaccctggcacacagtggtttttcctcgtgctggggccaccagttctgtgttgggatgcacctactccagccccttcagggagcagtcagcctctaaggcatccctccaggaagctgccctggctgcaacaaagggcctttgtgtgtctgtcccaccagcactctctctcatgccctcaagctgtccctggtcttggcatgggcaatgaacacctgctcacatagggctgatttgcagggttcccccagc

SEQ ID NO: 116337 - DNA, 155 bp, Homo sapiens
aaggcctgtggaatggattatctatgagttgagggaaggcctgtggaacggattatctatgaattgagcggaaggactgtggaacagattatctatgagttgagggaaggcctgtggaacggattatctacgaactgagcagaagtcctgtggaa

SEQ ID NO: 116338 - DNA, 206 bp, Homo sapiens
gactttttatctgtagaagcagaagagatcattttatccatgggcaaccccattatacctgaaaagacatttaactactggctcggcctaaagtgtaaactgtaaaccagattggatatttaatcaaggggctcagaaaaaaatgacaggagtacacgtgtacacgcacacacacacacaccatgtgtttgtgtatatacacacac

SEQ ID NO: 116339 - DNA, 419 bp, Homo sapiens
tcctggctctcctttcagacctgggtgctcaggcccatcttccccgctatgtctcagccccagtaactagaataactgtctctcttggtagaacttaggcaaatgggcactgagaagggtgaccatgtccccacccacctgctgccatcccctgacttcaccagtgggtcagcaacaaggcagggtgctgtatggcagctctggggctcagctccccacctttcactgagcaaaatgccattcagattgagcgtgcgaagccccatggcagtggccatgtacatcagagtcacgtgggatgctgttaaaagtccagatacccacattccagcaccactcccattgagggcacgagctggtgggcttggcacaggactgatggcaagtaccctccacagccccagcaattttgaaacaga

SEQ ID NO: 116340 - DNA, 370 bp, Homo sapiens
tggccctcaccaaacactgaatctgggggtaccttgatcttggacttctgttctccagaactgtgagaaataaattgctgttgcttataagctgtgcaatttatagtggtttattatagcagcccgaatgcagggagatttcttcactcaaaccccccgagaagcagtggaacaacttggtagtaaaagtaggtaagaatgggagcagccagttcatgtttactcaaacgcactgcaccctctctctcacctcacacctgtgtttcattctttcaagtcttcccatctacactctgcctttcttgagatcagatgctgtcccctgtacttgagcactcttccctcacttcttttacctagtgagctctta

SEQ ID NO: 116341 - DNA, 496 bp, Homo sapiens
gcgccaatcaacagtgatgaatagctaaagggacaagtaggtctctaaatttacttcatatctgacagcccttcagcagatatggataatggatccctatgactcacaaatacaactccctcctactacaagcaagccctttcttttccctacaagaaagggcaagaattcctaatgacccctgttcttcctttccccttttcaacaatccaagaaaagtatgttaaacgcctgtagcatcaggttctttgcagctgctgggccagatataaaatgctagtgaaaacacacatccctttttatctcttaagctattactgtgagtcttatgactacatttgaatcagtgttaccaatcaaacgaagttgaaaaaatcaatttgtgtagatgtgtacatctcactactgtaccttgctgacctccagatattcacgtgcctactgcatattaatctgcatcctggaccatttgcaacaagtagatccccacacattt

SEQ ID NO: 116342 - DNA, 402 bp, Homo sapiens
acccagaaggtctggctttatagaggcagccaaatggttcagagtgtaaggcacagagtgaagaactgccaggaacttgacacttgatcagccagcccttcaacaaatctgtgttcatcattatcacattcaagggtgcaaggaaaaacaaacaacacaaataaagctaatgtgaatccaggcctggaaactcactatcctagcagagaaggaagaagatcttattgataagaccttatggagcaacttcaaatacaatctctcatatgatatctcttcacaatgtccctgaattgctattcccagttcatagagaaagaaacagagaccaaatatgccgagcaagttattcaagattacaaaagtattcagtggcattccccacatatgaacaggtgttaa

SEQ ID NO: 116343 - DNA, 134 bp, Homo sapiens
ggggacacaaaaggaagagaaaacacagtccctgccctctgagcttatactgctgtgtgtctgcagaccactgcacaagatataattgcaagctgggtgccgtgactcacacctataatcctagcactttggga

SEQ ID NO: 116344 - DNA, 989 bp, Homo sapiens
gaaatctcttttagagagtgatcaatcatccacttatgcagagtcagctctttcctctgctttcccatgcccaggctgcttctggaatatggaggggctgggtagtgcaataactagaaacacccaactttgggatctgacagtcccaggtttaaatcttgattctatcaattactgtacttcctttgtgaacctgagaaattactcattccctaattttgcagactacagctcatggaggctcataactactttactgcgatagttataaatgttaaatgaagtagtctatgtaaagttgtagccaaataataaatggtccttcattctgcaagtgtgattgacccacaccactttcttgtgtatgatctttaaaaaattatacttagatcttttgtttatagcatggtccctttaaaactataatctagtgtgtgctgttgtcaactgtgtaaacttttagagagacagaattaatcaatgttcattgagtacgcaaagcatgttttgctgtaaaacagaatacagagtgcaaaagccagattttggctgtaaggacaaggactatattccctttgttctttgcatttaggggttgattcacaaatactaaaaactcatttactaactactcagtcatctgcttttacaaacactttttttcataaaaaattcaaacagtacagaaatatttaaagtaaaagtttctcctttccagtcccatttctttactttgccactattaacaatttgatttctagctgaattactttaaaaatgattttaagtggtaacgataatataaatgcataataaattctcaaaggaaatctgctaaatattaagttattactgaatgaaggataatattatttattatttattcatgttttttctccattgttctataatgagctaatactcttaataaagagacaaaggaataaatgcaatgaaaataaattatttcagctgctctgaaactcact

SEQ ID NO: 116345 - DNA, 339 bp, Homo sapiens
aaggggatagattgcatagaggctgagtagtttttacatgtgtggccgagtggttggttggttttcagtgtaagtaggtgttgtcatccacacacctgccaccacctctggcttcattctgtgggtctttgtgcccacccacctggcattgttacctaatttcatctgtaattttgcatcctgcatttctgatgtaacatcacattctcttaccttcacaaagtctagaaatctatggaatgggctgcaaactatggcctgcaggccagtcagtttttttggcacacagtgaggctcatttgtttcaggattatttgtggctgctttcattttatgatg

SEQ ID NO: 116346 - DNA, 815 bp, Homo sapiens
tgataggctcaaatgtgatgggtttagtttagttctgcttgtatttggatgacttttttctttctttctttttatggaatgtaaggcaagcagatatatcagagtttgtcctatataggagccgtgaagcaagtattttggaaaatactgtatttgaagctctaattcagataaagttctaaagatttagggaaaaaaagagactctttatactgagtacttcagcagactgttatgctaaaactataggcctcacgaaagaacctatggttccattacttaagtaagcattctgagaaggacagactggttaatgtaacaaccaaaaggaataagagacccacacaaaactaaggttgtcagattcatcttgataaaatgaccgtgtggaaagctgtggaaaagataattttgtagtctcaaaatattagctcactaattattaattatgtagggcaaaggtacctttacaatagagaaatccagcagatagcagcttaatcagttgatcagatatcaccaccaataatgcggaaaatcgttattatgtgccttcatatgtgatcctgtgatcctgtgggaagtacagcacctcttacagtattcttgccaaaaaatgtttaatctgaatttaatcacaaggaagcaatcagacaaatcaagattatggatgtcccacaagacaactgatacagattcttcaaaattgtcattgtgatgaaacacaagagcaaaaattaaaggagaatgacaattaaatgcattgcatgatcccttgttgcatcttggattgaaagaaatctgttaagaacatg

SEQ ID NO: 116347 - DNA, 658 bp, Homo sapiens
cccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtaagtgatcatacttga

SEQ ID NO: 116348 - DNA, 203 bp, Homo sapiens
agctggccagttttcttaaaaatgtgtcaaattgtctgaatgatttgaccagaaaccccgagagtcaacgtgaggaggaaagaaagaggaagggaacggggaaaaaaagggaaggaaaaagacaaataccacctaattgagactaaaggaatgatcactggggctaccatggcttttgtttggttttggcaaggctttatttt

SEQ ID NO: 116349 - DNA, 296 bp, Homo sapiens
tggatgtggtgaggcacaataaaaaatgacaaggaagttcagccttcttctgtatcttcagatattggcaagtggagctgcactgtttattaactgaggtattttcaatagaagggagatatgaaaagtgatgcaacagcaaaaataatctgtaattaccaaatatttggaggtaaatcctatacatacagacttcaatttccacaaatgactacacctcacagtttaaatagtgtagtcaggaatcaaatcaagacttgttctggtaaacaagggaaaataaactatttttttaa

SEQ ID NO: 116350 - DNA, 515 bp, Homo sapiens
ctctctgccgttagaggggacaagactaccagctgcaggggaactaccctctccagggcctcctctgagctgttttaacactcagtaaagctcctcttggtcttgttcaccccactgactgcgaacctcattcttcctggatgcaggacaagaactcaggcaaaggtgccaccaaccacagaggtttctgtcaggaaaagtgacactgcaaagctcccgtaacagaagtagtaaaagtactccagtttcttcccacatcctgaagatgtgtatttcaggtgggtgggcatgtgtcagcgatctcagtcaagatgttccatttaagcagacctcttccatagctgtagctggagcggtaattggagctgttcttgcccttttcatcattgctatctttgtgactgtgctgctgactcctcgaaaaaaaagaccatcctatcttgacaaagtgattgaccttccacccacacataaaccacctcctctgtatgaagaacgatccccacctttggctc

SEQ ID NO: 116351 - DNA, 413 bp, Homo sapiens
attcatttacttgtaataagtgcatttagtttcatacagtttacatacaaccggtttgactgtatctgcagagatttaggatagtttttcttaatggtaagccctagggtggagctacaatgcactttccgttgtgaaccctgaaaacttgagagaggtctcagttaatttagaaagtttacgtaaccaaggttcaggacgcatacccgtgacagcctcaggaggttctgaggacatgtgcctaaggtaaacagagaacattatcgttttatacattctagggagacatgagacatcaatcaaagtatgcaagatgaacattggttcggtctgcaaaggcgggacaaattagcaaacgcgggaagactgaaagtgaggaggggacttcctggtcaaaggtagttaagagacaa

SEQ ID NO: 116352 - DNA, 397 bp, Homo sapiens
agcaaacgattacggtccagctcgcattgtaggaacaggaagcctttggttcattgaactccacaaacaatccccacacattgtagccactgtaactttctccattgctaactctttaacatatgattttccctctgagagttgctggtcttgctagttgctatggtctgaatgtttgtgtcccttccaaattcatatgttgaaatcctgacccccagggtgatggtattaagaggtggggcctttggggaggttgattaggtcatgagggaagtgctcttatgaatgagattagagcccttacaaaagaagcacagggaagctcctggccctttccaccgtgtgaggacacagtgagaaggtggccatctgcaggcagacaccagaacccaaccat

SEQ ID NO: 116353 - DNA, 288 bp, Homo sapiens
agctgccaggacttaccagtggagcttactggggagcttggacgggtcaggttgtttgggcctttctagactgatggcgattaccatcagttaatattttcagagttttgcaacggtctgtggtgccgcagatttgagctcttcctttacacaaggaccaggtggcttatccagataaaagggaaattttacttagcgtctatattttaaaagctctatctgtaaatctgtctccaaatacacttggtgaggtccaaggttgggtatctctcctctgtgccactttgc

SEQ ID NO: 116354 - DNA, 360 bp, Homo sapiens
catcctgcttccccctcagtttagcaggtagacattactgacaccattccacaccaggtctgggctgagccggcgggtacaggggcagggtgtactcagatgaatgaggcacagtctgtgcctctcacagccagatggcagaggctaggacactggcgaggctaggacactggcgaggctaggacactggcgaggctaggacactggcgaggctaggacactggcgagggtagagacactggcgagggtaggacactggcgaggctaggacactggcgaggctagagacactggcgagggctagagacactggcgaggctagagacactggcgaggctaggacactggcgaggctagaga

SEQ ID NO: 116355 - DNA, 389 bp, Homo sapiens
cctaacatggcaccttttaggaatgtaatcatccccactctcagttggtgagagattactgtaacaaattctgaaacactcacatagattcttatgaatcatgtttttttcccccctgtcttatggtgctgaatgaatcatgtttaactgagaattagctaaggggagagtagagcagtaaggacatagatttatctctatttgtgttttcatttactacttttatcaagaataataacattttacctcttttttaaataccactctctagaaagtaaattcaggagtaagaaactccttacctattcagcataatccaatttattgttaattccattgtctattaacatagtaaatagtgtgttggcttgtaacacttccctcataga

SEQ ID NO: 116356 - DNA, 306 bp, Homo sapiens
cctctcagaaccctaaggcaatttggagcccagaaggaaagtgaggcccccaggtggatgtatggaaggaaggtggtgcacctttgggcccttgtgatccaggtgagtgacagagtgactcacctaaaaagagagggaggtctctgcagttggaagctgcaaatgatgatggtagaattttgcacaacccagggatcacaagcccagttttaggggaaagggctctaagagtagagacatccatataggcgcagatagtcctcctttatttaaatacaccagcagctgcaaggagtaaagggtctt

SEQ ID NO: 116357 - DNA, 373 bp, Homo sapiens
aaaatgtctgtatcattttaattaaagtaagtaattggcaaaagtaagctaccaaaaacgtaaaacttgcaagcgttcacttttgcttttacatataaagtctttgtactcttgaagccgggcacagtggctcacacctgtcatcccagcatgtgcttgagcccaggagtttgaaaccagcctgagcaacatggcaaaactccatctctacaaaaaagacaaaaattagctaggtgtggtaatgcacgcgtgtagtcccagctacttgaaaggctgaggtgggaggatcacctgagcctgggaggcggagactgcagccagctgtgttgcaccaccgcactccagcctgcatgacagaatgagatcctgtctc

SEQ ID NO: 116358 - DNA, 197 bp, Homo sapiens
tctgtttctttggggaactctgactgatatactcactcagtgtggtctgcttcctagactggagtctgatacaacgttgaaatagattcctctgctgtggaattggtctgtctgcgacctggagcataagtcaggtaggggcctggtctcaggccaaacagcctaagttcagagccaggcctaagttcagagccagg

SEQ ID NO: 116359 - DNA, 731 bp, Homo sapiens
attgtaactttttaaatgtctgtagcactgaagttattttcaggttttgtattttctttcattgtggaatattttaattaatatagcatggcacctcattttcttttgcctgctgttaaagatggaagctgttgtcaaataacaactttaaaaagggaagtataaataaaaagcctgattattttaggccagtttgccaatcactgtgtaattcttctggtagtattctacctactttaagtctaattttactagatagagtaatggaaaatgaaaatctaaccctttattccgataatctcatgaagcaaacctaactatttaacatcagctggaaagaagggaacatttatattgcccgtctcctgtgtcttcaaaggtgtgagagttgaggaatatgtgttcctacgggaactatgtttgaatatgtgcagttttcaacattttggcaaatgaaagcctgacaagtttttaaaagggcagaagctttattttttgaacagaaaaatctattttttaaattcacatgtttgtatgagtacttctgggaagcaagggatgaactgctaggtattattaagaatgaatgatttttgcatttaagttgtttgaaggcatgtattttgaaaaatatctgttacaaatttataatttcaagacatactaaatcttataatacttttggaatttcattaataaggctaaaatctgaggaatgtaactaattttca

SEQ ID NO: 116360 - DNA, 876 bp, Homo sapiens
cgcccagagatggagctgggtgaggggctgctgtctgcagtgtcagcctctgcaccccacccacagcctcccacggcatcccctccccatctcccctttgtcttcctctgtcttcctttttacttccttttcgctgtttaatgagaacgacttccatttgctatttgttgactgagtccggcactgcattaagctctgtctacattttgtcttagtgcttgcaggcactttataaggtagacgcaagtattgtgccacttttacacatcagggaacgtatgaacacatcaggttgctcagcaatgaagtggaagagcattgatagccctttgggcacagatctgtgtgcctccaaaacccatgctctgagcgctggtaacctctactcctcctcttcctcaccttgtcagcatcagcactccaccttccctttcctcctccgcttcgaatctcagagccaacttcagctagtgcctctcccttcggaaacacctccgggaaatacctcctcccagatcacccctgccagaaccagcaacgactatgagtacagcacgtgggtctgcagattggcaaggaccaaaagaactgattactatacaaggagtggctatggtggtgagatttgtcctctgcaaaccatgacggtggtagctggcaaaggtttggtgaaataggctttggcatacattgttgatgggaatggtgcatgcagtgttaaagggaatttatctgtcaaatttttttaatgcacttcaattttgacccagcaattctgcttctaggaaattatccaacagataaatgtgcaagtgcaaaatggcatatacacaaatatttactgcagcattatctcagcaaaaggctagagataac

SEQ ID NO: 116361 - DNA, 428 bp, Homo sapiens
aatcaggcctggcgcagtggctcacacctgtaatgccagcactttgggaggccaaggtgggaggatcacttgaggtcatgagtttgagaccagtctggccaacatggtgaaactgtctctactaaaaatataaaaattagcgagacttggtggtgcacgcctgtaatctcaattactagggagcctgaggcaggagaatcgcttgaacctgggaggcagaggttgcagtgagccaagatcgcaccactgcactccagcctgggcaagagagtgagacactgcctcccagaaaaaaataaataaataaataaataaataaaagagagagaatgaaaatcaataagatatataaactgtaaaaagtatattagctctcataagagcattaccagaacccaaatatcatttccatcacacttgccctgagc

SEQ ID NO: 116362 - DNA, 276 bp, Homo sapiens
atattataaggaatgtattcactatgaaaattcatcaagctatacattttgctgtatgtgtctctatgttaataacaataaacctgcccatgtacagaacactttgcaagatcttttaaaagtcactaatttatttgatctttgtgggaaaaaacttttgtgagacacgtaagacaggttcaaaaaaaattaaaaataactcactatgataacataatgaaggattcgatttcagattttctccaaatccagggctcttttcttttcttttttttt

SEQ ID NO: 116363 - DNA, 405 bp, Homo sapiens
tttatatttttgtttgaaattaaagcagctttttgagacaagaattaagattgttgccctgatgctagtcatagtgaatttctaacccttctaacccttcttaaaaggagatggtcgtatttgtttcctttggatgccgtatcaaattaccacaagctgagtggttcaaaagaacagaaatgtactctctcacagtacttgatgccagaagtttgaagtcaaggtgtgtctgaaggtcatattctttctgaaggctccagggaagaagccttccttgcctcttcctaacatctagtggttcctagcaatccttgacctgtgttggcgtgtagccgcctcactccggtctctgcctctgtcatcacatggctttttgccctctgtctcccctgtatctctaactcc

SEQ ID NO: 116364 - DNA, 417 bp, Homo sapiens
gataccacatttcattgtgctccacggatactgcagtgttttacaaactgaaggtttgtgacaaccctgcatcaagctagtctatcagcaccatttttccaacagtgcttactacatatctctgtcaaattttggtaattctcgtaatatttcaaactttttcattactattatgtctgttgtggtgatccgtgatcagtgatctttgatgtcactattgcaattactaatgtcactaaataatgtttagtaacaatatataatggcaaacttaattgatagccattgtgcgtgttctgaatgctccaccttccagctgtaccctgtctcttaccctcttctcgggcctccctattccttaagaaacaagaatactgaaattaggctaattagtaatcccacaatggtctcttaagt

SEQ ID NO: 116365 - DNA, 338 bp, Homo sapiens
tgtgctgcatcatggacacagtagccccaagccttcctctctctagcatcaccctgcagcatttcctgagatgactcagggcaaggctgcaggagtagctcagtccccagggtgggaaccaccttggtacaggccccagggtacctgccgtcctgatgggcttaccctgggccctgagtgagtggatgaatgaatcaagtgtgctggcctgaggtgccgccgcctcctggctccagcctaagccgccggcatgcctgtgggatttgtgggggctgtggtctggccagtgtcaccatatggatcccataaattaaagcattcccggaaacaaacggtaa

SEQ ID NO: 116366 - DNA, 375 bp, Homo sapiens
aactgtcaattttttgcccatattcattcttctcacatttcttccactcttgcaatagcaaagagaaaattaaaaacaggttgggcaactgataatattctttttgcatcaccaattagaattctgagactctaagtcataaggtaggaacagcttcagatgtgttttgaaaaacagaaacaaacccacatagcactctgcctggggagaaaatcatttctcccatgaatactgattcagttcaaaggcacacctaactgtaatccataatagaataagatgaaaagtttattcgaagagaatctaaacacagaattgagagggggaaggaaaatagtcacacatagaaaatttattctgggccaggtgtggtag

SEQ ID NO: 116367 - DNA, 681 bp, Homo sapiens
ggtcacgatgaggagtgggtcttggaatcctcttcgctaggggaaggggagatgtcaggaccatggaaatggggtgaacaggatttgctacccattgcttgctcaggagggaaggtgggatcgggacaatagtgacgtctgcttgttgaggggccttgaggtaggggtgagggtctgacctgcaaaacctctcctctgagccttgttggaggcctccattgtctgttgggaaagattgcagccccaggcctcaccttccagggcttcttcagatcctggggcaagatctctatcaacccaaccctcttttggccatcacctgggctgggtggccgcattccaggcaaatgataatttcttgcaggaaagtccaggagggtctcatgagctcgttcccactcactctttgggcagtgttttcagaggctcagaaccacggggtttattcttgccatgaccttctgtgggttttgttttgtttgaaacttaacaggaccctcacccaaccaactggagtaaagtgtaagttctttccttcttgcagaatgtgcatctccatctcctcacaggacacaggatatctttggaaagtgataatttggagggcaagttctttagcataatatgggctacctgggtactgataaccacagggtgcatctccacactgctaaggcccca

SEQ ID NO: 116368 - DNA, 286 bp, Homo sapiens
ggtctcaaaaaaaaaaaaaaaataccaggtgtgatcactgagaactcagctgctctcctgtttgtgattccaggaaagggcaggaggacctcagaattgctgtgagccatttgtttacctggcattggccttctcctgcctgccttttctgagaccctgtggaggggaggccaagggagggcacagagggagcagccacagatagagtcgcgtcccctccgccatccagggcctccacgtagcttcctgccaccccttccatgcccatccatgaccaaagaggggg

SEQ ID NO: 116369 - DNA, 920 bp, Homo sapiens
taagagaataaatttttcttttaagaatacctaagccttatgaacatctgatgttcaaatacccagcaatggctggtcatcttttgcttgcctaaactccatctgaacaacggcaaagctctgctgaaccaaccaacataaggaattgcacatccccacatttctttccatctttttcttttctgtcagactttcactcttttgctgatagtaagtacccttaatctattaaaagaaatacaaaaatcacttctgacttgcctattctctttcattatatgcatatttacatcaccactgtatgacaaattatttcacctcatagaccctgttttctgatctgtaaaagtggttaatggtacttacctaaaaggttgtaaaatgtttttaaataaagtatgtaaagctttcagtgcaatgccttgtatttggcaagtgcattgtaaatgggagtattatctacatcaacatcttcatcaagattacaatactgctctgactcattcctgattaaggtcatgcattacttaacaaggatatagtctgaaaaattcatcatgaggtgattccatcgttgtgcaaacatcatacagtgcacttacacaaacatagatggtatagtctacaacacatctaggctatatatggcattgtctattgttcctaggctgcaaacctggcagcctattattgtactgaatactgtaagcagttgtaacataatggtcaatatttgtgtacctaaatgtagaaaaggtacagtaaaagtaaactatagaagatataaagtggtacacttaggccaggcacagtggctcatgcctgtaatcccagcaatttgggaggcagaggcaggaggatctcttgagcccaggagttcaagaccagcctgggcaacatgatgaaaccctgtctgtacc

SEQ ID NO: 116370 - DNA, 526 bp, Homo sapiens
  misc_feature (1)..(2): n is a, c, g, or t
  misc_feature (4)..(4): n is a, c, g, or t
  misc_feature (6)..(8): n is a, c, g, or t
nncncnnngctcttttgccacgggatattgcagcatgaaagctctcaccagatataagcaccgtgcttttggaattctcagcccccaaaatgtgctataataaaaccatggtgctgatttatgatgaacgtggagatgtaccacctagatttctcttcaaggaaggacttgtttcctctgctgatggaattcctgtcaacagagacctttcaggtgccagtgacttggagaaggcctgagctgtagagcaacatcacctaaggtcacgccctacgtgagtcagcagaatccactgactgatggagattataaagacttagccattttgtctcaatgaggtgtacctacaatgggtcatatgagctccacagctccctgtggagtcagctcagactgttgttgacttacattgtacctcaacttctctctctgccaaatctagctccctttacctcacaatcataggcgttcatcccaaagacatcccttaatataaataatgcacaatatactctatatgttaatc

SEQ ID NO: 116371 - DNA, 433 bp, Homo sapiens
taaaaaggtttttttaaaagccattcttgtagaggaggtctactggctacacattcccttggctttcctttaagaatgtctctatattttacctttatccctaaaggctattttcactggatatggacttctgaattgacggtttttgtttagcactttaatatgttataccacttccttctggcatccatcatttctggtgagaaatccacagtcccccaaatctttattcccctataggtgatgtattattgtcctctggctgctttccagatttttctttgcctttagtttcagcagttagatgaggtgtgcacatctttgtgtttctactgtttgggatttgttcagcttcttggatctgtaagtttatgtctttcatcaaattgggaagttatcaatcattgtttcctaaaatatggttttttgtttt

SEQ ID NO: 116372 - DNA, 322 bp, Homo sapiens
cagttaccaaccctgtggctaggacatattctctaacaactcagtgtttgtttcctcacccataaatgggatgatagcagaccctacctgcaatatagagcgattatgaggattcaattgtcagacatacattgcttataacagtgccctgtacacagtaaagtatagatatgtggtagtgaggcagatagcctatgtaaccacgtgttagtttccaattctgcagttaactaccaccatgaccaagtttgaatttatgttacttcacattaatgtcattagattacttgttgttatacattaataaacagttgttttgcat

SEQ ID NO: 116373 - DNA, 150 bp, Homo sapiens
ctacacataaaaactaaaactataaatcttttagaagaaaacgtgatctggtagttggcaaagattttacacaggacacaagaaatccatacagcaagtcctcagataatgttgtttcattcaacatcactttgttataacattgatgag

SEQ ID NO: 116374 - DNA, 652 bp, Homo sapiens
gctctgtgctcttttgtccaatcttttatatccagggagatcccctcaagataaatgtaacttttgaaatgtttggcttgcaattatatactgaaatgttacttcagacactattttaggtggtaccaaaggatgtcttttgcagagcaaaagtttttaattttgctgaagtccaagttaacagtatcttttctttatggaatatcctctagttttcatgtctcggaactctttacctagctctaggtcccaaagattttctcctgtgttttttttctaacagttttatagtttcttattttgaatccatgatccattttcagttaatttttgtacaagatgtgcaacttaggtccgtgttttgtttttgtttgtttttgttttcctatcagtatccaattgtttcaataccatttgttgaaaaaaaagaaaacaacaacaaagaaaaaaaacagctattctttctgaattgaattacttctgcacatttgttaaaagtcagttgggtctatttgagtgggtctatttctaggttccctgttctgtttcattaatctatgtgtctctccttcagccaataccacactgtcttgttcattgtagtgtcttaaaattgggcagtgttttctcccataccatttttcaaaattgt

SEQ ID NO: 116375 - DNA, 254 bp, Homo sapiens
ctacatattcttgaggaaaaaatgcatattctatagttgctggtgatatattctccacatgtccactgagtcaagtttgttaattgtattattaaatttttccgtatatttacagatttttgtctgattattctatcagttgccaacagggatatgataaatctccccacaattaggaatctatttctccttgaaattctgtcaatttttgttttgttttgttttgttttgtttttttgagacagagtctcgct

SEQ ID NO: 116376 - DNA, 682 bp, Homo sapiens
aactcatctaccaaattgttcaatggaacagctgccagataaagtgcagaacaactaattaaatgtgaatctcaaacaaacattgaaatttttagtgtaagtatgttgactatagcatgggacatagtatactaaaattatttactatttatgtgaaattaaaatttaatggggtgtcttgtagttgtttgtatgtagttgctttaattctggcaaccctattcaatggagaaatcatatctctgaggtccagacattctttttgtgtatgcatttgattttccttaagtgtccttgtttatttgcttggttctttgttgtttttaaaatcttcagttcactggccaggtgttttgtttgtttgggttggtctttctctgtttggatgctgagtttcccttactatgttatgttaaaaacagtcagagatctgcttgtcatgggaccccaagtagaggctgacctctgactggtagaagataaaggaatttttcccatagcgggaagggggagggtatatggtagaaggtggacagcagtcccatgctgagggcctaagaagagcccctctgtgccaaagtgtctttgtgctcttctagcttcacagatgcaaaagattaagtttacctgttcggtgtctttgtggcctctaagagccatggatcccacacatactcagata

SEQ ID NO: 116377 - DNA, 361 bp, Homo sapiens
tggtgtctgaggggtttttgtctgtggcttgtcctgctacaatttgacctagcaattctattactgggtatatagccaaaaaagaaaataaattgttcagccgggcgcaatggctcatgcctgtaatcccagcactttgggaagctgaggcaggcagattgcccgaggtcaggagtttgagaccagcctggccaacatggtaaaaccctgtctctactaaaaatacaaaaattagctgggcatggtggtgggtgcctgtaatcccagctactcgggaggctgaggcaggagaattgcttgaacctgggaggcagaggttgcagtgagttgagatcatacctctgtactccagcctgggcga

SEQ ID NO: 116378 - DNA, 282 bp, Homo sapiens
atctaaggatcccccctgtcgtcgctcttggtctggcagtctgctctggggcattaccaccctaggcctacagagggtggttgctggaatgcagagatagagatatggagactgtcacctcatagatgagggatgaaggcagcctgtgctgtgcaccatggaagacagagatttaattaatagcccagccatccgtggagcccatgctggtgctcctcactggccaaacccaagtggaagacagaaggcaaggaagcccgcaaatctaagccaggtcatcct

SEQ ID NO: 116379 - DNA, 608 bp, Homo sapiens
ttgaacctaatttattattcctttttctttttaattcagtctttgatctgaaggtaaaagtctttcgctattcaagtcaacgttgtaaacattaaggcacaataggacatttgtaaaagtatttttaatttctatagatgaataaaaatattttatggtaacttatttctccccctcttcccaccccctaaaaggatagcacagcagaaacaatcgcttgtttgtgcttttgctataggttagagaaagtgaggacatgtcatttccctcttaatcaaatataagccctcatactgttctccactagccttgtgctttgaggcttggtgtcaccctgttaaaatttgctagaatgaggaacagaggagactctccctccccaagtctgtgccttcagtctctgctacttacatccacccagtgttggcaaaatcaccagcagctccccgagcttctgttttttttttttgaaaaaattataaaatatgaaactgtgtgtaaaaaaatgcgcatgtacataaatttttttttttaccatttcccaaaagattgaaaattaaaggatttaattcaggaagtgagcaaggaaacaaattgtaaaaaaaaaa

SEQ ID NO: 116380 - DNA, 884 bp, Homo sapiens
cacttttcagatgtctctctctctctctctctctaagagctgctctcctctctcctttcttctatctattaaattttccactccctaacccacccacatgtgattgtgtcctgaattcttggtgtgtgacgatgaaccccagggtgtataccccagacagcacagccacttcaccagcagggacagcagctgtcacatgaactggagatgaactggaggtgagtctgatgtctcggaattttgaggaaagtgggtagaaagttgccaagcaagctgaagagacaagcaaaagggatcatattccagaagaattcttagcaagaccacagtcagaacttcaatcaaggtgattgattggtctgaaagggggaatagaatgtaacataaaatacaaccatgagaaaccacatgtatgttgttgaaccttatctagacactaagtgtgaaaaagccagcttggattattgatgaaggacattcagaaaaccacaattttgccatgcttatttcagagaacagagacagtggtattatcagcctatagctcaattgtacaaaatgggatgactagatgtcccgagactattctgttcctcggccctctcgacatcactaagaagcttccaaatttaccaagttctcagtcattgtaaggatgctgcatgtcaataaggatgattatggaagatgatgggcatggttctacattagagaaccagaaaggtcacaataataagcttttataagttatatttggaattatatagagtccataagtctaaataacatggggaatattgaacaatttgatatacaggaacttaacaaggaggtagacgtaacaagtggatttatctatgtagtagaaatcttacatgtgaagt

SEQ ID NO: 116381 - DNA, 580 bp, Homo sapiens
ggctttgcttggcgcgtctccgtttctcttctgaggggctgagagtcgcggagtttcctggttggaggctgtggcggacgcgatttgcttcctcatatagggttccggaggcggcggaaagtccagcgggtctccgaagccggtagacggagccatgaagaagacctcgggcttcaggagggggaagggcgagctgccctggggctcggtcagcagccccgggaaggtgggcgcgggcgccgggagtgagagtgaggaccacgcctcctcccagcccaggcgccacgacccggacaaggggttcgacaggctccgcagagctgccggccgacaccggacagagacgatgcggcggatcctttctctgccgaagagtggcgtggatgacagagacgagaagaacaggctgtcctgtggacagagttctggtgactcatggctttcagtagatgacgaaccctttgattctgataccaagattctcttgagcaatatcatcacttgaagcctaaggttgaaatcaaagagtgtgtttcgaaccaggcggtcggaatgaaagatgtacaagcatgcacatcag

SEQ ID NO: 116382 - DNA, 425 bp, Homo sapiens
tacccatagtacttgacatttactttgaaactgaatgcaaactcagttttactcattttcaaaatctaacttaaaaaagaaactaacacttttcatgttagttgctgagaaacaattctacaaatactttagacgtatttgaagtctagatttgagattcaaaacatcttcctaaaattttagcagttgagtgtttaagaaagatattttaaattcttcacatttttggatgcttttataatttattcattcttggttatgaaaattgatagtaaatatcatgtagaaaagtatttgctaagatcctaaaaagaacagcttagtttctctataggatttagttcattttatcacctattatctttaaaaaggcaatgagccatgtaatatttcttttttttcctgttttttgagacagaatctct

SEQ ID NO: 116383 - DNA, 126 bp, Homo sapiens
  misc_feature (1)..(2): n is a, c, g, or t
nnagcccctttgaaccagctgatgcgctgtcttcggaaataccaatcccggactcccagtcccctcctacattctgtccccagtgaaatagtgtttgattttgagcctggcccagtgttcagaggt

SEQ ID NO: 116384 - DNA, 340 bp, Homo sapiens
agatcgcgccactgcactccagcctgggtgacagagcaagactccatctcaaaaaaataaaaaaaataaaaaaaagaaatattatgctcaaaatatatagcaataagttggaaacttttacttgaataatttttacaaaactgaccaaagaacaaaaacgtgaagaggccaagttccaagactcatgttatgtaaattgttctaaaacaacattagcacttaacaaagttgaaaagttaacaaagccaagtactgtactaggcttccaacactaactaagtataaaattccacagagctggttttcttatctttaaagaaatttgttggcaagtggtact

SEQ ID NO: 116385 - DNA, 375 bp, Homo sapiens
agcaaatgcaaagagatggagtcataaaaggcgcaggtagtactgtgaggagtgtgaacaatgaagcttaggaagtgagatggtctgtagcaattagtaagagatgaagctaccgtggtggctagagaccaaattgtgagaggacgtaagagtccctttgaaggagttcagcttttatcttgtagttgggtcagtgttaatgctgagtatttaatagggacattttgataaatgtcttaaatctggtgatttactagtttagaaggtagaatatatattttattaactctacaagtggtatttaccaacaagtataacttgaatctttaaattgtgtaacatggcaacctattttacccctccctgctaatctta

SEQ ID NO: 116386 - DNA, 580 bp, Homo sapiens
tgtagctccccaagtggcgaaactgcttcacacctcctgtcctctcattctctttgctttgatatatacttctttgcaatgttctcctacttggcactaactcatctttcacaatccagcccaagggccagctcctctacaaactctcccctggccaatccagtgccatcccagcgccagtggaactggcactgctctccttggtttacctacatttttcatgcacacacctgccacatctactgtgacacgctccttcacagcttgctgccatgtttgtctcctccttctagactcaaagcatcggtgacaacagggactacatggtatgaaatgatcactcatgcttgttgactgaataaaccattacaaactactcatagaaaccaatctgcgagccggatgcagtggctcacacctgtaattctgacactttgggaggccgaggcaggtggatcccctgaggttcggagttctaaaccagcctggccaacatagtgaaactccgtctctactaaaaatacaaaattggccaggcacagtggattgcgactgagagacggggatactctagaatctg

SEQ ID NO: 116387 - DNA, 1323 bp, Homo sapiens
  misc_feature (4)..(4): n is a, c, g, or t
  misc_feature (6)..(6): n is a, c, g, or t
  misc_feature (1150)..(1150): n is a, c, g, or t
ggcncnagggtttaaaaacagtaaaaccatttctgtcattttttagttcttctatcgtagcatctgtactgacataatccgcactttagggtgatgaatgtcaattactacttctatctagcctcctgccaaaattgatgctcagaatcgcagaatcggggaggtccctcctgagcatctctaagctccccactcagaaaaggaggcggcttcgggctttcgttggctgccgccccatccctaagaaggaaggggagcgtgtctgcttcctgaaggttcggaaatcaatcgaaaataatccatgcaaccgtcccacgacgtgagccccacccctgcgccccaggcctcgcggagccagttggtcgcagttgttgcgagcccgacgcccagccccgaagggggcccagaagagcgtcccaggcgtccgtggggtggccggctgtggtcctggcgcccagaagtggccaggcccgctggatttcctgggatgcggtcaagtccacaaatactgtccgtgcatcctgatgctggagggcgggaccttgggccgagcgagtgtggctccgccagaagggccctcggacacaaccggtgctggaggaactacaaagtggaaggattaggaaacgcacaggaacatgtacgaaagaaggcgaaatgtgaggtgtaacttacatttctaggataactcaagaaaaattcgcgtttaaagagaacctctctggcgaagcatcaggaaaggcttcctggtggtggtgcattcgagggttgtcatcatagtgttagtttttatttttccctcagggattgttacattactcccccaaatggttttcctactcgtgatctctaacaaaatccatcccataagcaacccccggatttatgatctaaaaagcccagtggctctttagtttggcacttgatgacctccgtatgattagtctttctaacctcatctcacagttctccctaattcagtactttaatcttccgttgagcttgggcattgccaccagctgtggactgaactatttccctcctcccccaatccatatgttaaagccctaccccaccccaatatgttggtatttggagatggagcctttgggaggtaattcaatttagatgaggtcaccttggtgggtcncccatggcgagattagtgcccttatgagaaaaaacaacgaagagcttgttctcctctgtgtgccatgtgaggacagagcaagaaggggctttcacctggaacccaaactgccccatctttatctgggacttagcctccagaattgagagaagtaaatgtctgttgttatagcc

SEQ ID NO: 116388 - DNA, 470 bp, Homo sapiens
cttactcgggtgcctgttagttatcagctgcaaattatgaatttttgttgctccaaaacaacagctggtattgtgcagcctgcaaggagcgctgtggggctaacctcaagtccagagaggcacaaacgccatgctggagtctcagtagccagtgtcagtagccagtgtccctagtcctgtctccttaagcccaccctactcatggtaccaaaggcgcaccagcccaccactctgagcccccgtgactccttctgcaatagctatggctgagtggggtacagacccagccgtccctgggtgtcccagcgagggtgtcacagccctttagctcagagaaattgcccacagctctctgtgtcgcctaagacagggtttcccaaacttgccacattacaacagtcaactccttaaagacacagatgccagggcagctaacagtcagagacttagtccccaccccgaccctggcc

SEQ ID NO: 116389 - DNA, 666 bp, Homo sapiens
ggtccttggggtcctgatgtggcactgcatctgtgggaagcctcagggtgtcacaatctctttgtattctctgcagtcaagagtcagcccttgggtcctccctctctgttgctaggaatttttccatgacatcccattgcccactgaataaaatttaggttcttcagttctctgcagaaccatggacatgtgattttagtaaagttactctttgccacttagataggaacccatggaaggctgggctgggcttcaaatccaagagacagatatggcgacagactcatcattctgaccaccttggctttgtcactgatccagcacattgtgcctgatgctgtcccagcaagttcccatatctcttgggcaaatggaccctggtgacctacctccagctctctagcccaaacatgtctgcattccagtggtgagcatggaccgatctagaatggaccttctgttgtaatgggaagcaggattatgaatttcttttatttcaataacttttagggtacaagtggtttttggttacataaatgaattgtttagcggtcaagtcagattttggtgcacccttcacccaagcagtttacattgtacccaatatacagttttttattcctcacccccaacttccccctaagtctccgtagtccattatatcac

SEQ ID NO: 116390 - DNA, 416 bp, Homo sapiens
atactaaccaccctggaagacactgcatagccttccagacccagctcaggtgtcttataccctgggaaaccttcccgattcttgcagccagatgcttcctcctctgcctccatgacctgtcacagccccacacctctggactgtgaatgtccaggtccctgggtgcttctgccatttgcttccagctggggcttggcacccacggggcttcaggagactggctgaataaatgaattagtatgtaatacaaaaacaacaaataaatagaaaaaattaaccaggcatggtggtgcacacctgtagtcccagctactcaggaggctgaggtaggaggatcaactgagactgggaggcagaggttgcagtgagccgagattgtgccaccgcactccagcctgggtgaaagagcgagaccc

SEQ ID NO: 116391 - DNA, 530 bp, Homo sapiens
atactaaccaccctggaagacactgcatagccttccagacccagctcaggtgtcttataccctgggaaaccttcccgattcttgcagccagatgcttcctcctctgcctccatgacctgtcacagccccacacctctggactgtgaatgtccaggtccctgggtgcttctgccatttgcttccagctggggcttggcacccacggggcttcaggagactggctgaataaatgaattagtatgtaatacaaaaacaacaaataaatagaaaaaattaaccaggcatggtggtgcacacctgtagtcccagctactcaggaggctgaggtaggaggatcaactgagactgggaggcagaggttggtggggggggaacttaagaagcagtaatgaggatggttttatagctattccatagccttcctctttcttatcctcgtatgtgttctcactgtttttggtcaaattttactttgccctttttgttgttcctctgcaggtcattgttgaaaataaattatctgaattata

SEQ ID NO: 116392 - DNA, 219 bp, Homo sapiens
gcacacaggaagcgcttagtcaagggcagccttcttccaccagtatgtcagcactgcagagcaggtggggtgacatgcatcgccagcaccctgaacggcatctgactcacacgtgctcagcaggaatgagctaggtaccattttcagtcagttctgctcctgggccacttccacctgctcagcttttctttttttttttttttttttttgttcgttctg

SEQ ID NO: 116393 - DNA, 499 bp, Homo sapiens
atagcctttggaattatgatttgtagttgctagatagaatttaatctcatgattggggtatcatttatttttggggatttggattgcctctggtttttaccatgttaggtaatactaattttatctggaaaccattttagctttttggattgacagctttagttattgtttcagtcagttcttgctgcgtaacaaactgcccccaaaggtactggtttaaaacaaaggacatttattctttctctcaattctgcaggttcactgggtgattcctttgtcctgggccagtttggctggggctggatggcctcattcacatggctggggcctcagctgggggcacttggagctttgtcctcatgtgttctctcactgcccagtgagctagcccaggcaaggaaggacatgccccatatacaaacacttcttaggactctgtttgcatcacatttgctagtgtccctttggcaaagtgagcccatggctaagcccagaatga

SEQ ID NO: 116394 - DNA, 873 bp, Homo sapiens
ctgctgtatcttttataaaggaactatgtatagaattaagaaactggaccttacatttgtatcttacacagctatcattttcaaattctgaaaatttgaaaatggtcttattattttttggtcttattattccttttcactcctaaaaattattgtgtgtcctgaagtgtctttgcttatacaagttttatctattagcatttatcagactcaacagtaaaaccaaggactgtttaaatatttattttttcatgtaagataacaataggacaccaatcacttaataaaataatcagtgtaattttaatgaaaaattggcacattttccaaaggaaaattagcaggaagagtggaactgttttatacttttgcaaatcactttaatcataagcttactagaaggcagctccattcacctatctctttctccattcaattcctttgctatatacatgtcatcacaatatctgggaaaatctactgtatatttctgagaacaaggcagtgatggcttccgatctttatggaaataattttgatcttgcagaacccctgaataagaacccctattttagtgtatttgtttttacaagtagaaatgattgataaaactattttctaaagctttttatacatttttgtccttatatctgttagtaatatgtgaattctatgaatagatgttctaatgttgagtgatccttgaaatcccagaataaataaaccctacttggtcatgtcgtgttattttcttaatgtgatattggattttgtttgtatgttgatttagaattttgacatgcatattcaaaggtgaaattggcgtgtactaggcttcttattgatttctataataaaaacctgactataaag

SEQ ID NO: 116395 - DNA, 486 bp, Homo sapiens
  misc_feature (446)..(446): n is a, c, g, or t
cctcgcgccccttctcagtgactcacctgttgtcctcccacagacacctacccaccaggaaaccgcttttctgattcacatcaccacaaattagtgctgtctgttttagatcctcataaaaatgaagtcatactgtgtatattcttttgggcttgactcctcttgctaaacgtgcctgtgagagtcattcatatgattgcgtgtattaagttcgttcctctttattgctgccaagtattctgttgaatggatataccacagtttgtttactcatccttttgttttaaaataataataatccacttcccgggctgaagccatcttcccacctcagcctcctgagtagctgggattacaggcacacacccccatgcctggctagtttttgtatttttagtagagacagggtttcaccaggttggccaggctggtcttgaactcctganctcaagtgatctgcccaccttggcctcctgagtagctggg

SEQ ID NO: 116396 - DNA, 671 bp, Homo sapiens
ggagctccccatgttggctgtgtcattcctgccctggaaatactagcatcctggcagagcagacactggattccttcctgatgtagaattaatgttgcaattgcttaaggttagtgacctttaacttctgacgttacaatgtcagtttattcattcactcaacaaatacttattatgtaccaactaaggctatgctagatactgtggatacagtaatgaaccagacagacaggatcattgcgctcatggaacatatattctgatgagacaggctaataaacaagtaattaatgaaatgaaataacttattatgataaatgcccactgacttcagggataaaaagtaattcatgttttggatatacctctgggtcatgtttgtttatatgaagagttttcagcagttgaacttggcttagcctttctcagactggcctgggttcagagtggatttccactgaaaagtcattgttcctcttctgcagtctaaggtagtagttatctaaactgtctcagatatgaaagagaagggaggaataaatgaaatgataaagtcaaaaggatggggtgttttgttcatattttagggggttaatctcatgattaagcttatcagcttttggtgctggggtcagcttggtgtaaaatgaatgctgtcctggggtgtggtg

SEQ ID NO: 116397 - DNA, 586 bp, Homo sapiens
agacagggtcttgctgtgttggccaggctggtcttgaactcctgggctcaagcagtcctcctgcctcggcctcccacagtgctgggattacaggcttgggccactgcactcggcttagtctcatgacttttttactcaaaacgttaatgttttccacattatcattagcgacttacaaccttctctgtctggtcatcacaactgtttgcgggctgcttttcctgcatcttgcttagcagctttggaggcagcgtctgtgtctcccgagaggcaggaagacctgtgcccctctccccctcctggccccacacgctcctcaggagggttgcttcccgcagggggtgggggtgagtgctgtctgcatttcccgtacctgctgagggaaccccccaccccgagactcctgggggagctgtagctctcaggcccctccctgggagtccctgcaggttgctctgtgtttcaaagcaacgttccatcagacttttgtgttccgttcgcatgggaatccctgatctatttcctcagagcccagacggctaaacaggccgtggacacagatgacatcattcccggtggtcactca

SEQ ID NO: 116398 - DNA, 314 bp, Homo sapiens
tctctgtctgccttctacactggggaccccacccagcatcacttgggaaagatgtgatgtgatgcttcttcagttccgtagttctgagtatactggagccaccctgggtgtatgttgttatgcaaaaaaaggggtgaacatgccctgctgtgtatactaggtaggtactcagtaaatgaagctgaatgagtgtgctatacctcactcccctgaggccaacaaggttttctctttcttcctctgaaacactttaaaactcctctttccctgtgctgggctgggcaacaaagccgagtcccagataaaatgcagtg

SEQ ID NO: 116399 - DNA, 707 bp, Homo sapiens
ttcaaaagggttaatgagctcacatacaagagatggtggatcttgtggcccagaagtaccacttctttgtgtgtgagacaagcagggtgcctttcaatttgccagattaataagcaatctgtacataaagattgcagggtaaggagatgggcagagagaagtaatagctcgctataactttttaaatgactgttaaatcctctcaattttaatgtaatttgcttggggtatatttgtgtggttaaaataggtggcaatctaggaataaagattgcaagacacttaggacaaaatataatcttagtgccagtacatacaagataatagttggggaggtaaagaatgtcttataattgttgcagattgcataggtatttaaaagcaaaagagtgattaacattttaacttgatattttttggtgggggaggtacagttaaatagagggtggaaaggttgggaaatgtggaatttaggagtataattttaaaagccatttagtgcaattgaatgctagctttctaaaagatttgtgtcgttaaaaggaatttttttcttccctgcttcaatatggcgactttccttgtccttttgtcttccaagcggcgttgcaggttgtgtcttgacccattttttttcctgtcctcccacctcaaccctatttgttgagaggggtccaagtccttcctccccctttccctctataggg

SEQ ID NO: 116400 - DNA, 1477 bp, Homo sapiens
tcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatctgcggagctggcacttggaagagtgagcgggtcatcacgtcccgtcaggggccgcacatccgcgtggacggcgtctccggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctgctgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtga

SEQ ID NO: 116401 - DNA, 522 bp, Homo sapiens
tcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagtgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctgctgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtga

SEQ ID NO: 116402 - DNA, 1555 bp, Homo sapiens
tcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatctgcggagctggcacttggaagagtgagcgggtcatcacgtcccgtcaggggccgcacatccgcgtggacggcgtctccggagggcctggcactgtcatctttccaggcctgcccttgccccacctgagctgctgtatccatctcctctccttcacctcaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctgctgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtga

SEQ ID NO: 116403 - DNA, 1346 bp, Homo sapiens
tcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatctgcggagctggcacttggaagagtgagcgggtcatcacgtcccgtcaggggccgcacatccgcgtggacggcgtctccggagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctgctgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtga

SEQ ID NO: 116404 - DNA, 1351 bp, Homo sapiens
tcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatctgcggagctggcacttggaagagtgagcgggtcatcacgtcccgtcaggggccgcacatccgcgtggacggcgtctccggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcactgggctgggacgtgacctgtgctgagggctgtgagaatgtgaaacaacagtgtgaaaattggctgtga

SEQ ID NO: 116405 - DNA, 816 bp, Homo sapiens
tcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatctgcggagctggcacttggaagagtgagcgggtcatcacgtcccgtcaggggccgcacatccgcgtggacggcgtctccggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacgggtgggaccatgtggcacctgaggcctggggtggggcttctgagggt

SEQ ID NO: 116406 - DNA, 1662 bp, Homo sapiens
tcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatctgcggagctggcacttggaagagtgagcgggtcatcacgtcccgtcaggggccgcacatccgcgtggacggcgtctccggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgagagcagggcgctggtccagcccggcactgagacacgggggccccagagagaagcacagaacaccttgcctctctacccagaggagcgccctggctggcagtacagttttttgatttgctggagtcccggtcaagggagaagccagggtggttaaatgatggctctacgctcactgcctccctccaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctgctgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtga

SEQ ID NO: 116407 - DNA, 1089 bp, Homo sapiens
tcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatctgcggagctggcacttggaagagtgagcgggtcatcacgtcccgtcaggggccgcacatccgcgtggacggcgtctccggaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccaggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctgctgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtga

SEQ ID NO: 116408 - DNA, 978 bp, Homo sapiens
  misc_feature (208)..(208): n is a, c, g, or t
ggtcagcctcccgagtagctgggactgcaggcgcccgccaccatgcctggctaatttctcgtatgtctagtagagacggggtttcaccgtgttagccaggatggtctctatctcctgacctcgtgatctgccctgcctcggcctccccgaagtgccggaattacaagcgtgagccaccattcccggcccaaagaggagaagaagtatnaagtgcttgcttggacctttctactgtgcttattattctgtcttctcctcatggcaaggatggggtcatgctttgttgtccaggctggtctcgtactcctggaatcaaggaacccttccacctcagcctctgaaagttctgggattacaggcataattcatcctgcctggccaagaatctttaatgctctgctcaggcaactcttcctctgaggatccttccagtgacaattcaagaattagcgactcaattcccagggtcccttagaccttcgacctgcttgtgggcaatttggaaacacaggattgtgcctgaatcacctttgcattcctagcatcgtttttcctggataataatttgttcaatatatgttcaataattgttcaattattcaataacaaatgttcaataaatgtgtgttaaatgaatgaccacagctcctatagcaggtagctgactttgtgtctcctcaaccaatctctgagctctttgaaacaaagcctattttgtttgaatgtaaatttatcatcccagtttctggtacagggtagggaactaatgcatatgtggtgaaacaatcaatgccttagtgcttatgaagaatatcactgtgttacacagaagcatggaatgactaatgttaagctaaactcaagttacttagggaatattaacttgcatttattatactctgggggaaaaacacatatatgtgtatatatgtataacatatgtatgtatacacatatcagaatttgtatatgagaatg

SEQ ID NO: 116409 - DNA, 735 bp, Homo sapiens
aaatatttgttgaacgaatagaagaattaaaaaattgtatcaccaactgttaattatctgggaattaattaactgatttgcagattaactgtcttaaaaatatgacttctttttgagagaaaataaaactaatgaaaatttcaaaagcctctacatatcagaaatgttttttataactacatataactttatagttcttctttctcttcatcagtcagaagtgtaatctaaaataatttttaaaaagcctgtcattcctcagtgttctttgtagtgctgtcaaaagtttgcaggtttaagaatagtaactctaatgatgaaagcattatgatctgagtgcatgttatataaataaagcttaacatttagcaaaaagttgaaattgtacatttgggtaaaaaggggtggataatgttaaataagtttcattacaatatggaataggagaataaatttttttgtggtttgataaagagaaacttgtttttaaaaaatgtcctcattgagttatcaagcaaactggaaaaatgaaaaaattatgaagaatctgtggctaataagacaatgttgatttggttcagttagctagcaatgggctctgtgtttgattttgtttgagttaaatagacaacaattttcattgaagctcttccagtggaggttatgctgatttgttatctgattgattagattcacaccacagaaaaattagtagccatagagagaaattaaatg

SEQ ID NO: 116410 - DNA, 271 bp, Homo sapiens
attttaagagagaagcagtttgaatctacttcatattgtggtagacacagtgagttgagttctccttatcttcctgacttcctgattgtatttccagcctcttttgaagccaggttttcgtttccagccttctttgaagctaggcatagtcagtgagatgtaggggaaggtcctccaatgaaacctctgggtaaagctctctaaaaggaactgattgagtcagctaggaggcacatctttttgatcttaacagccctttctcctgctgtct

SEQ ID NO: 116411 - DNA, 374 bp, Homo sapiens
gccaacgcatgctgaggcttgccgaccccgccagaggctagaagaggcgaggaaggattcttccctagagcctgcagagggagcgtcgccctgctgacaccttgattttggacttctggcctccagaactgaaataataaatgtctgcggctttaagccatctgaggtccttggtaatggcagccctaggaaatgaatgcagtgcccaggccccaggttctagccttggcctagagagccaaaaacagtgaagatgaaatcctgcttctgcctcaccacccctgctctgatcagctatgctcagccttgtcctgccccaggacaatgacatttacacatgagccaccctcccaaggacagccaggcacagccca

SEQ ID NO: 116412 - DNA, 689 bp, Homo sapiens
agcggatgatcacaccactgcactccagcctgggtgtcagagcaagactctggtttgtttgtttgtttatttgtttgttaaagctattctgtagggcagagggcactattccagagtctgatgcaagagaagataaggaagacaagatctcaaccactttcagcaaagctttgcggagaatgcaacatccttcaagacaccatgaagctccacgcatctggtcatcttgtttcttcagggaataaatttattgttctctgcttcagggcaggcacacttggccagtaaagaaaatccccccagcagagaattgcagatactcacagcaagaagcctttcttgtgaatggaggatggatgtggagctggtccgagcagtctgcctactgcatctgctatgacacccagcaaactggaagggaaaagcagttacaaagtttccaaccagcacaaattccatagtcaggttttccacatgtggggaaatgacaggggtcagcacatccaacgtgcaatggacaagccttgcactgggtaaaccacgttcatggtcatggaatctcatttaccagaaagaccatctggaaaaaatctccagggccacacctccgatgtcttctttgcaataggcagcttgactgcagcgttgcattgcagaaagagattgaagatatttacatttattgtaaa

SEQ ID NO: 116413 - DNA, 745 bp, Homo sapiens
  misc_feature (13)..(13): n is a, c, g, or t
  misc_feature (22)..(22): n is a, c, g, or t
  misc_feature (35)..(35): n is a, c, g, or t
  misc_feature (40)..(40): n is a, c, g, or t
agcggataggccntgacgggtngacgtgctgtgcncgtgnatgaacgcagggcccgctaccatacaaggaacgtcactgaagtatacaagtaagtaaaatattatacaaggcatggcgtagaaaactaactacaagagaagtagaaacaagcaggatactcagaagagggagagagatagtacctgttaagagtcggggtgagggagatcatagttggaccaggcattgagggatgaggaagcccttacccgacagaggcaggggaaaaaacgtttgggaggagagaagcttaaccatctggctgcgtgtgaaaatggagaggcgggagaagaacgctgttctgggctcagtcggcggctgggtcgttgacatttgcggtggaaatttgttgtctagccgccatcttcttccagtgagagcacccccttttcttttaggaaaccacctctcccctcttctcagtctaaatggagctgaattttatccccagttccaaaggaccgcatgacccaggcccagtcagtcacaacattttcctcctctacccatggacactgttttagggattgtcacttgacccaagcccagacaatatgatatatccaaggctttctctgaaacaatcaggaaagaggcactcactctctctccatttaggctgcaaaattattagaatgtaaacctgcagccgctggtggccgtcttatcatcacctgtaacacatcaagcctgcttgagaatgaa

SEQ ID NO: 116414 - DNA, 375 bp, Homo sapiens
atgctcatatatggtagagagaagaaaaagaacatactagactctccttttatgccacattatcaccaacatctgccaaaattcacccatagaacttatttgcatttagataagaatgaaacaatgtataatttagagccttctaaaaattcctggacattaatccataagtggcatgaggagtaggctttgtagttagtcagtcagggttcaagcgccagctgtgccacttaacaagctgtgtgactttgggcaagtttcttctttccatgcgagaatatataggaataaacaaaactcagtttctcctatactctcattcagcaagcaacacagaagacttctgtgacctctggtcatcgagaagtagggatt

SEQ ID NO: 116415 - DNA, 781 bp, Homo sapiens
ggaggtgcttctttttattttagcatccagaaacagctagccaggaactggagataacagagcaggctttgagagccaatgaattagtaggtaaggagagcttgcccatgattgtcagcatgacttttcgaaagatcagcttcctctctggctgctcaaagattttaaaaatcagagataatcttgttagagcatgtttctcaaagcagtgaaaagacatctttggaaagaaataattttgtgatcagatacatttgtaaaacacaaataaattttagaaagaatcctattatattcctttgagataaagctgtttgatcgaatatttcctaaatgtatttgactatggtaactttgagtttggggttttggtttggtttggtttcaatttccgtgagctttccacagacttagtgctctcaaaacatacttgaggagacctcgtgttagacagtgactagggtggtgagtcatgagaagtgatcctttgctcctacatcataaattggcccaacttcccataacgggaatgagcaataccactttaacctgcttttcattggtaagtagggaaagcttttagtggaaacctattgtaatccaccctgtaagatttccttcaggtacgagagtgcttctcagagcatgacttaacactgcagttactttgccccagaaagatccgaaatgccattgaaaatggaactagataccttagtaatggcataccactgaggcacccactagtaggttcaggaacactctgaaacatacatacccc

SEQ ID NO: 116416 - DNA, 765 bp, Homo sapiens
gagagagagggagagagagaggggaaagggctatcaatgtaatttgcctctacagctaaacacacaggccgtaatcatagccattttactaaatgcccataaaactaaaaaacaaataggaaacctccggattacagggccttctctgagcagggagtggcgcaatcaagtgctatctgcgctaagtcccagcttgcagtgagtgacccaggaggcgcgggtaaacagagagaggaccccgttccctgtcccccccatcaaacctccaaggctgaatgcctccgaggctgagcgccgggggaacggggggcttcctgggaacgcagtcccctccgtgtgggggtcctcagctcccctgtgtgagcctgtgccatgcggaacgggaccacagcctcagcctcacaacgtgcctgtgacccagcgggagtggaacccaggcctctggcaccggggaccctcagaaccctgcctgcaagggaaccccagactttgaggggaacagcctcgtgcagccctcatttctcccttacagctgtgggacttcacagacaagcaaaagaaagggagcattttagcaagagcagcctcaacgccaccccctagagagcagaaaaaaagggatgctaccccaggtcttactctagggtctcccctcggccacactccctgcctcaacagaatctcaagcgccagaatcaccaaaggacattctaagtgtcattccgccctgagtgtcagaaaatgcctgcagtggatcctcagtgg

SEQ ID NO: 116417 - DNA, 237 bp, Homo sapiens
ctcaggaatcgggctgtgtggggacagtctcctcacctttgggcatgaggtggggctgggcaaagaccacccagctccctaacccctactcatccacctcctgccccagttaaaatcaataaatatttactggcagctacaggtgtctggggaggcagaaaggaacaagtcatgggcccccacccaaggagggggcaggatgcagcgtaagaacctgcgcttggtcactgaggtgct

SEQ ID NO: 116418 - DNA, 709 bp, Homo sapiens
gtcacgggctccggtcccggcggcagaaatagggcagccgcggcggcggtggcacagcagcgggcagcggcggctcagggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagatcacaagaagagaaggggcttccagagcagcaaggagctgctgggctcctgacgggaagaagttctgcagccgagggagccggtgcgtgctcagcaggaagacagggagagcccgaatagcagtgccgtgggaggatgcaggcaccagctacgtgcatgtgtgcaggatatgatgggaggtatcatgacaacgcacatgtaagctccaccgtgctgcttgccctcctgggaacgaggatcaccgaccatccagaggaagggccggggccgtcaagtgacacggccacaggggcggtacgcccgttgagaatg

SEQ ID NO: 116419 - DNA, 250 bp, Homo sapiens
gtttgcagtgtcaatgagattgagggcttgggcttgaacccaaccttctccctccaaatagcctgctctttctgttatgtcatgtttcatatacaagtttgggagcctccagccctgactatcccaacatatacaacataatgtatatgttgtctttggaaatatcttctgtgaaggccaagcatttaatattacaggaaaccttgaagtggatatggaagcttggcagccagcttggatcttcctaaga

SEQ ID NO: 116420 - DNA, 361 bp, Homo sapiens
tttcccactacccatcaagggatctggttactcagctagttcccatcagctctggctgtggtctcggctgagtggccttggggttatgtaagaggtagtgggaggggaagagagctgagggctgcagcatatggtccacctgggcttggccctttgggaataggcagccctggctctctctgaatccttagaaattacacggctatttgatcctggaaagatcgtgcagagcacacctgagtgtcatacagcctggtctgaggtagtggggttggagatgaggtgggttggggcacagtggtgtttagctcaggtaccaggtggggaggtttagactttctgctttaaaaggaatgattag

SEQ ID NO: 116421 - DNA, 702 bp, Homo sapiens
catacacatacgtaattctatatgaaggtagtcatactgtatgtgcttagtattttcagtgtacactttacattttttgcttgcctctcccaccccgtcatatctccctatgtgtttttctccatgttcatttaatcatatacaaacacgtacacagttgtttcatggtctttgttttgctttgaatgcaatcacattgtacacacacccacgaaccttgcttttctcattcagcaatgacacttggagttggtttcctgaaagtcaactgccattgcccttactggttttttaatagtttataactgcatacgatttcacattgtgcttatacccatagcttattctgccatttcttgcttaatgggcattcacttgatcttcatgtcttgagacaaagttacattaactatctgtgtacttctgtccctacgtagtgagcttttgtctctgggatagtttcctaatactgggcttggtgattaaagagcatatggtttttaattttaatagatctcaccagatcttgatccaaagagaatggaccaactcatatttccattggctatgtcaagtgtacccacttcacattctcaaccatataggggctcttcatttctattgttgggcaatctaaagttgtgtcttattattttaactgctagtgaatttgagtatttttacccttatatttgatgcttc

SEQ ID NO: 116422 - DNA, 375 bp, Homo sapiens
caaatgtcctctttcttacaaccaggattcaggctctcacttcccacttggttttctccacttgaaaaagaaaagcacgagccgggcgcggtggctcacgcctgtaatcccgacaccttgggaggccgaggcgggtggatcacgaggtcaggagatccagaccatcctggctaacacggtgaaacccagtctctactaaaaatacaaaaaattagccaggcgtggaggcaagcgcctgtagtcccagctactcgggaggctgaggtaggagaatcgcttgaacctgggagggggaggttgcagtgagccgagattgcaccactgcactccagcctggtgacagagcgagacgccgtcaccaaaaaaaaaaaaaaa

SEQ ID NO: 116423 - DNA, 236 bp, Homo sapiens
agtagagacggggtttccccatgttggttggccaggatagtctcgatctcttgacctcgtgatccgcccacctcgacctcccatagtgttgggattacaggtgtgagccactccacccagcccagtgaaggcttttcatacttgcttgtcagcctcctgcatcctactccagcacctggcgctcacaacctgtgggctgctctcatccgtgatcatctctccccaggcctgctgtt

SEQ ID NO: 116424 - DNA, 748 bp, Homo sapiens
agtttgggttcaacagggaccatccctcagaacacctacaagtggcttctctagcatggagcctcagacttctgtatctcagggatcccaggaagatgattctatgagtgaaagttgtaagcccttcctatgagatagtttcagattctgttcttttgtgacattgcattaatcaacaagtcatcaagttcaactcaaactcaaagggagaggaattctattcccctcttagtgagacagtaccaggaattgtgccatcttaatctcagattcctgcattacatagatttctaagtcaaaatgttttgaccaaagccacatttgccagatattgggagataccactgctctcactcagaagcctgaatctcaaggggtccaagatgtcagtgctgctggaattttggacagcctattactacagaaatgtgttgaaacataatataaatcagaaaggaacaaatatagccagcatacaagaatgaggggagaagagagtgggagtcacctgcccaagagaacacaggagagtcctgaggttcccgtgctgaagaaattgatcaatctattcaggaaacagctatcagttggacattcctaagggaaaactgcaggagagtgggaccttctgctgatatggaaatactatatagagctctcgggctgctgctgaagaagaaagatttgctaaattttaatagttattctcaccttcttatgaagttaattgtagaaggaagattatgac

SEQ ID NO: 116425 - DNA, 371 bp, Homo sapiens
aaaaggctgggcacagtggctcacacctgtaattccagcactttgggaggccaaagagggcagatcatgaggtcaggagtttgagaccaacctggccaatatggtgaaaccccatctctactaaaaatacaaaaatcagcttggcatggtggtgcatgcctgtaatctcagccagttgggaggctgaagcaggagaatcgcttgaacctgggagacagaggttgcaatgagccgagattgtaccactgcactccagcagcctgggcaacagagcgagactccttctaaaagaaagaaagaaagtaagagagagagagaggagaaagagagagaaagagagaaggaaagaaagaaagaaagacggaaagaaa

SEQ ID NO: 116426 - DNA, 466 bp, Homo sapiens
ggaaaaacaaagatccccaaagtccatttcgctccgaggtcagtggacacagctctgtgactgtcctgtgctgtgtgggtctgtagaagggccagtcatgggccatcgagctactcacagccaactgcacccaagtccaagcctggctctgttcccatacacagagacaggatgggggctgctgatctggcctgaagccttgctctgggcactgaaaacgggggctatttccttacctgaagatctggaagcagcatgttgacaaaagcaccaactgctctgccatcacgtcccactgggtgtcagtgggaaggcctaaccaaggcctgcctccagtggctattcaggcagacgggccagcagttcccctccagggagcaagggacccttcttacccttttgatcacatttccctctcttaaaggggcactgctgtgggaaggggtcatgccttggatcctacagt

SEQ ID NO: 116427 - DNA, 375 bp, Homo sapiens
agaaaattaccttgagatttatagttgggatgactaggcctggagcattgccctttgctaagataagaaatataggtgttaaaattgatgttttctctttctttttagggagaacatgtaattggtttgggagggttgaatttaaggaaaaacatctgaaaccctcttacacagactgatagtgctgtgataggaagaaaatacccagagagaatgtacagtaagaagaaggaatctaaagacaaaccttggcgcatctctctataaccagcagtcagaaaggagggaaatcaaaagaaagtgtcagagaatgagtaggttaatacatagcaggtaaatgaggatggtgctttgccaaggcaaaagagaaaaaca

SEQ ID NO: 116428 - DNA, 140 bp, Homo sapiens
attatttagaggaaaaaacatccagtagaggatgaataggaaaggagtggcgtggggtggagtttcacacctttgaggaagggaaatgacacgaaataaaatcagaaatccaagcctcctgctcctgggtactttccttt

SEQ ID NO: 116429 - DNA, 210 bp, Homo sapiens
attttgaatcgatttgctccctctgaacttgtttctgcatccttatactggggataagattactattttctgtgtatggttgtttaaatgagatttggattcacaaatgtaggtgctgctggctatggtggtggcagctttctcttctcttctgaactcactgtaagctcctccggggaaaggcctgttctctactcctcctgtgtgtct

SEQ ID NO: 116430 - DNA, 174 bp, Homo sapiens
ggatattgctgatgcacaataaacaaagcagtgagtagactttaagatccaaaaaagggttttgcttgagcttataagaaataagttacataacaaatgtacagattatgtgtaatattcctaaaagtaaaatattaatacaacacaataggactacattatacgtatgcatct

SEQ ID NO: 116431 - DNA, 611 bp, Homo sapiens
aggacctttaaagtggcccagattcagaccatgaagggcagcttgggtgggcttccctcctttcttcagctcaagaaagaagtgaaagccactgaggcttgccaatgggaagggctggaaagttatcaactcaggcttcctcctgccgttaaatttgcaagtgctactccctagacggaaacctgaatactcactaagcctaggactttgaaccttaggaatccccaatgaaggtattataaacaagtgagagaaaaaaggtttgctccaaacacctcagtgcttacccctgccccacccatgatacaccttcttatggtctgagtcccacaccctgatcgggggtgacattttcaacaatctgcagtgcaatgagaaaaataaagggtaaatgtatgagtactttcctatgaccagataaattaccaatggttgattcttgggaaagactattttttattctgagatgatgttctttcactttttttcttttttcagaggtttgggtaatttaagcgtcccttctttaatggaatgatggcaatagtacgtggcagttgcctttcctaaaatgtcctcaattgaccagatcaccagtgggcaattcggtg

SEQ ID NO: 116432 - DNA, 882 bp, Homo sapiens
gtgtatacaaggttctgacttaacagaattaacataaagcgtttataaatgactgagatactttgatgactaagtctttagacaggttaattcagttatttaatgtgtatacatattcagtttttcttggtgcctgttctttaatttctataaaactcaaaggactctttagtgtaacttacactacatagattataagaagaccaaagttgttctctcttcaccaccacttacttcctgtctgatcttgtgcaagtaaccaaactttttttctttgtgcaacctctgtttccccctcctccccatgtcacgaaagaacgtaattgaaaccttcagattaaaagctctcacttttaactctccttgaacccaggaggcagaggttgcagtgagctgagattgtgccattaactctcactcattgttctcccctcttatttcaagttttgaattggatagtgtggaagacctaagtttgggaaaatattggtggtaagtcacaagtaggcctggactacttcttgaagcttcttgaaggatcatgccgagctgacagcctgttgatgcttatgacactatattataaagcaaggaatgccgggcgcggtggcttatgcctgaaatcccagcactttgggaggccgagacaggtggatcacctgaggtcaggagttctagaccagcctggccaacatggtgaaacctcgtctctactaaaaatacaaaaattagctgggtatggtggcaggcgcctataatcccagctactcagtgggtgctgaggcaggagaatcacttgaacccgagaggcagagtttgcagtgagccgagatcgcgccatcgcactccagcctgggggacaagagtgagacttcatctaaa

SEQ ID NO: 116433 - DNA, 237 bp, Homo sapiens
ctagagttggggtcagcacacatttttttaaagatccaaatagtaaatatttcaagttttgcaggccataaagtctgttgcaggtactcaactgctcttgtgacatgaaagcagccatatataatactaaataaacggtcctgttgtgttccaataaaactttatttataagacaggcagatggccaggctgtggtttgtctaccactgctttagagttttttccttcctcttcact

SEQ ID NO: 116434 - DNA, 341 bp, Homo sapiens
ttggatattttcaaagtaaatcacaagtatgtcatttcacacataagtcgtaggtatcataacagatatggaattttttacacataacccacaaggccattatttcacccgatgcaaacatgcttataccttaatatgtcctaagactcaatctgtgttcatatttccctaattgtcttaaaatgtcttttccacagtggatttatttgactgaggctcccaacgaggcccccacgtggcatttggttgctatatctcttaaatctcttatgtaacagttttccctccctcccttttttttcaagacattcatctgtcgaagaaaccatgttgtttgttgt

SEQ ID NO: 116435 - DNA, 560 bp, Homo sapiens
ctgtaggggaaagagatttaaaagacacatcagataaaaaagtggctcagactaaactgtcatgtttaaagatagagatattaaataatttgacctaaatgaaagtgtagagaagcacaagggagagaagatcctgtcaggacggtgatgactttgggggctgggagagggctgtggccatgagggtgctgtggagggggcctggagtggctggcaaagctcttggcttgcgtggtggtgacaaaaagtgtctgccctatcaaagtccatgaagcttggctgggcacggttgctcatgcctgtaataccaggctttgggaggccaaagtgggaggatcgcttgagcccaggagtttgagaccagcctgagcaacatagtgagacctcatctctacagaagatttaaaaatcagcagggcatggtgctgtgcacctgtaatctcagctactctggagactgagacaggaggatctcttgagcccaggaggtcaaggctgcagtgagctgtgattgttccactgcactccagcctgggcaatagagcaagacactgtcttaa

SEQ ID NO: 116436 - DNA, 385 bp, Homo sapiens
ctgaggccttgtggaaggagtgaatgtgatggtgatcctgcccaggggctatgattcatctggctgattgattccagctgagtctgtaaaaatctcagtcctgctgttggaaagcagaatgtcaagtcatggagtggggtgggggtgactgtcaggtcatctaacttgataggtttggaagggagtccacaaatatgcttcttgacaagggactcatataggtggcatgtgggccagactttgggatcctctgctctcccaaaaatggtattttgccttcagtctatctgcttctgctttgcatttctttgatgttaacaaaaaggcagtagagaaatcactatgagtgcaaaaacctaggtttgagtcttagctgagatatagg

SEQ ID NO: 116437 - DNA, 554 bp, Homo sapiens
ggggaaactgcccccgtgatccaatcacctcccaccaggtcctttcctcaacatatggggattaaggggattgcaattcaggatgagatttgggtggggacacagccaaaccatatcagcatacctaggttactagctcatatctggagccagcaatggggtttgtcccaccagaatcactcaagcgtagagtgatgtggttccccaaaggaaaactaaggtgtcgtttctagacaaagaggattcaatgctgggaaggcaaaagcagtgtatctattccatagtaggatgtgagtcatcagtacacaggagatagtaagaaggctaggagcagtggttgacacctgtaatcccagcattttgggaggccaaggcaggtggattgcttgagtacaggagttcaaggccagcctgggcaacatggcaaggccttgtctctacaaaaacaatacacaaatcagctgggcatggtggcatacacctgtagtcccagctactcaggaggctgaggtgggaggatcgcttgagccttgggaggtcaaggctgcagtgag

SEQ ID NO: 116438 - DNA, 304 bp, Homo sapiens
accttttactattatgctctttgataggtgcctgagggttgtgtaagtagcactgtctagtacctaggtagatagatcaggaaaccagtagagaggtctaagctggacatggagattcagaagtcagcagcacacagaggataactggagccatgggaatggagccaaaactcaggcagaaggtggaagtggcctcagaaaggggagaaccagagcagtctgttgcctgggggatgaggaagtggagatggagcgggtgtggaacattcgttcaagaagtttggctgtgaaaatggaaggaaaa

SEQ ID NO: 116439 - DNA, 452 bp, Homo sapiens
ggtcaaaactttattaattaattggcctccataaaccctcactctgaccagaagagcgtgctggcatttcaggtcccccagtattggtgtagtttagaactcaattgtaataggcctcaaaaagtttgggatttccctttccccagtgcagttatccatgcaaaacagtccttacatgctgtttcctctgcctgacacatttcattctccctgctttccttaggtattatctgatttccctgactaggtcagatcagccatatgttactaaatgatgtgcatctttttttcagtacttacaacagtagtagttttatattaattttctgtgtttatttaattaatgccagtctctatgtaagttccctgagagtagtgtcattacctgtttgtgcactgccctgtcccttggtgcctgtgtcacatattaggtgattaataactatttgagg

SEQ ID NO: 116440 - DNA, 385 bp, Homo sapiens
ttacttcacaattaaccaagaatgagaaagtagatacaccttgctggagagcccatgcaccaaatgtactgtatttttgtatatatacttagaaagtagagtcacataacatttgcatttgatttctgtaaattcatctacattaggcattaaacaacaaaaataataatgttaacatttcagaatatttcaaagagtatttactcaagagtgagcatgagaaacacgaatgtaatctactcttcccccagtggtctcagtttccacatgcttctccaagaggatgtatctcactgtgctgagtgtgagatgaggagggcttaaagagatgtatttggaacatacaagtttttccgtaaatacaaacccattacttcctctggtg

SEQ ID NO: 116441 - DNA, 324 bp, Homo sapiens
taacccctgcccctatgagaaagaaacttactaatgacaccacaatatttgcatataattctttttgtctttagccttataattttccaaagtatcttagacaagttattttcttccccaaccccttcagtgtattatccatttataatacaattaggtttgtgtgttattgtttatatacctttttgagttctccccacatcctggttgacctgcatgattcgtttgtttcggagatcatatgtctgtcatttttgtttttgtttttgttttaattaatagagacagagtcttactattttgcccaggcaagtctcaaattcc

SEQ ID NO: 116442 - DNA, 245 bp, Homo sapiens
ttccaggcacgacaggtgattggctctagtaaaaactgatgcagtgatgtcattcttagtgttttcaaaggagagaaggctgggatcggggaagtccggacgggctcagagcagaggatttgcggactctgggctgtcgacgtgaaccagtgcttgcattttgtaattgttaccaaagaattgataaaactgtgagagtgtgtttttccatggtcagcaggaaaatggaaaaggaaacaccattt

SEQ ID NO: 116443 - DNA, 377 bp, Homo sapiens
atataaagttcagtgctttgcatgggaacacagacaattaaacaaaaaaatcaggaaaacaatgaatgaacaaaatgagaatactcacagagagggaaactataaaaaagaattaagcagaagttctggagtgaaagaataccataactgaatagtaaaatttagtagtggaattcagcaacagccttgattaagtataggaaagaatcattaaactcaaagatatgtcatttgaaattacaaaatccaaggagtaaaaagaaaaacaaatggaggaaaagtgaagaaaacctaagggacttatgggacaccatcacatggaccaatatacacattaggggattttcaaaggataaaagtaagagaaggggacagag

SEQ ID NO: 116444 - DNA, 200 bp, Homo sapiens
cccgactagcccgacaggagggtcacaagcactgcccttactgacagggaaacaaggcactgggaagtgggggccacgcctggagctggagtcgcttcccagcagggccaggtgaggccaaggcaggagtgagaggtggaggagtcctagtgaggcctgtcatgttgctgtcgggctagtcgggggggtatggggctgtg

SEQ ID NO: 116445 - DNA, 417 bp, Homo sapiens
acaatctaagagagcagtcagggttatgcccagagatctgaaagaaaggaatagcctctcagctcttccgtatcgcccttgtaaaagaacaaccctcatttttatctcataaagtgttagggaggattagaagggtttacatatggagggcactgagaaaagaggctgacatttagaaggtgctccaaaagcagcggccatggtgatgggctaaggtactgcagggaaatgcaaaaagacaaaggagggtcaagttcaggagcaccacctccatttagcctgtgcctgagagagaagacatggggatggacacagagaattaagaggatgaaaatgacgcagagctccagtctcacaacaatgtgggagggcagagagtcaagtcacagtgtgggtcagtgtcctctgacgctgcag

SEQ ID NO: 116446 - DNA, 449 bp, Homo sapiens
acatgcaggtgatgttaatctacatgaaagatgctgaattccataacagaaaaaaaaattacatgtgtgtgtaatatgaaagaattaaataacttcagtaagtacattctatctgtacccttgtcttttataagggtaactgtatataagttaaactagaaattttatttttaaggggtcccatttcaaaccataagtgctttaaacagcaattatcagctaaattttcctgctggcagcattactagagatatgttgtttctgggcaaagttatccagaggaatcctgctccctcgtattttggaggagttgagtttcatagcatgtgataattacccatttttaccagttgagtccaagttgcaactcataaggctgctacagtgtatttctaagtattgtttaaattggaactttaaccttttatcctgggaaatgattggttttg

SEQ ID NO: 116447 - DNA, 304 bp, Homo sapiens
aaaacatcaagatacgctctgattggaccagcctgggtcccatgttcttccatgacccaatcctagtagcccaggagtgggatgtgccaattggcttggcctgaggagggcccccagagggtctgtaatccatgtgtaactggagttgctgtaaaatggggccatctggctgggtgcggtggctcacgcctgtaatcccaacactttgggaggccgaggcgggcggatcacgaggtcaggagatcaagaccatcctggctaacacggtgaaaccccgtctctactaaaaatacaaaaaattagc

SEQ ID NO: 116448 - DNA, 139 bp, Homo sapiens
tggtgacacactcctgtagtcctagctacgcaagccatattcactattatcactctctggaccaattattgatttgcaagttcctgtgaaatgttttatcacccagtgtgttttgtctgtgtacaggaagcactggata

SEQ ID NO: 116449 - DNA, 411 bp, Homo sapiens
catagcatagcttcagatattaattaaacttctggccaatggcaacctgttaactaaatcttcagaacagaagatagatttctacacctgcccttaactccaagattataggatggaaataagatttccttcagaagttaagaactgcttgtgattgtcttatttatttatttatttttaatcctaaaagcaatacatatccatttaaaaataattaaaagtagaggtagtatgctccacttgctgtgaaatcatttagaaaattgtttttgtgtacacatacaacacagctagaacaagtgtggctaaaaaaagcaatgcagttggtaaataaagatgaagtttgttaggttgttcatattcttttaactttctgtaagtttgaaaatttcaaaacaaaatggtggcgat

SEQ ID NO: 116450 - DNA, 363 bp, Homo sapiens
cacttctcagagggggcaccatcccccatcccttgtcccccttctccacctgctccagtctggcgtttgctctaacaaggtccacagtgacaacacctctgtgtccccaccttgcttggcttcctagcagcacagaatgcagtcgagtctcgatcttcttctggctcaaggacacccctttctgtggtctcctccaggtcaccttccagggcttccgaccctgctttgctggttaccctccttcagccaacccagctgtgggtttgctcctctctgagcaaatctcccgggggtgggggaagagggtctcatgcctcccgatatggtttggatctatgtccctgctcaaatctcatgtcaaat

SEQ ID NO: 116451 - DNA, 817 bp, Homo sapiens
gggtagctgtagataaactggttatcctaaaatcatgattatcagtgttgatctctgcaaccaacattgctttagggagttgctagtcattacccctgctacaatagatagtatttgtcagtctaagttacagacaaaaaattctaggttgactgattaagaaagccatgtgttttaatttccttcatgttttaaaaacaatggacgtaagtgcagagagacctttgaaaatattaagggaaatctatttaatcctataggtatgtgatgacttgtttttttggaaaaaggtatttggaacatcaatctgtaattatccattttccattcatgcattcactaattcaatatttgatatgtgtctgggagtgctgggaataacataaatacaaaaaaaaaccctaagataatcattcaccagaagctcatagatataatacagttatatagctaaatgcaaccagttgtttttccaaatgtactcatcatctgtaataaaagaaaaatgaagtaaaacatctgaaaccttaacttactcatgagttgctacttccttggaggcaactgtagaagcattaatatatggttctttgggttgggtcatactgccctctgctgactcagttactaactaaggacaacctgggtttgaggatcaggagaggatggtgtgggaacctgcctcaggaactacagttccctttctttgaaggattctatccagaagagaccatatcctactaacatactaataggagcaacatagcagatcaaatgataaggtggggtggaaattagaagggaatgggaataagct

SEQ ID NO: 116452 - DNA, 250 bp, Homo sapiens
acacaggtgtggagctcagacaagaagaacgagcaggggtacagccagggcagtacaggcatatggaggttattggggccccgggaggctgtggaggccctaaaggaaacaggctggagttcaaggcacatccaggacagagccctgaggacccccaaagaccccactgctggaagtttgagcagatcggaagatgctggaggtaaaagcacctgggaaggggctggcatgggactggcccaggtgggtc

SEQ ID NO: 116453 - DNA, 401 bp, Homo sapiens
atcctgtgcactgtgataactctagtcttggaggtgaatctgaggtccacgtctgaaacctgaaaggcatctccttttatctactaccgctttcaaggagatgctcttcaggtgccactgattctggcatgccaaaaagttgcatctgcaggatggttgtagccctgtttataaattcacaggctcaatttcaagaccttatgagaccctcaaatgtatcaagtggggccaggcgtcatggcacctgtaatctgaaatcccagcactttgggaggccgaggcagacggatcacctgaggtcaggagtttgagaccagcctggccaacatggtgaaaccctgtctctactaaaaatacagaaattagccaggcgtggtggcgcatgcctgtaatcccagcta

SEQ ID NO: 116454 - DNA, 437 bp, Homo sapiens
ccctatattagttcctggcatcacagccgtttaacaatgatgccaaccatcagcattcatcaatattttcaaaatacttgtattagcttgtaggcaaagtacccactaacccaggcagcacaattggcatgcaagccacaaccagagacatcctgcacacttcgcagagcataaaggtctgagctctgaagtatcacgaggagatagcattgctcatgcactgagccctagtgtgcactgagaggaaaggatcaggagctgtgcactcaaggggcgaagtctccactaggggcaggggtccctttgaaaacttagctggcaagggctctcctcatctgcaccttgtgctattctaggcaagtctgtctccctcttaccatctacctcagactatgataagctgacttctcaccaaaggcatctgtcttgctagcctc

SEQ ID NO: 116455 - DNA, 409 bp, Homo sapiens
acatgttctgctacttctgccagttctttattctcctttttcaggcgggcaatttcattgtccttttgttcaatttctttatgaagtttctcattttccttaagttcgagcggccgcccgggcaggtggcaaacatagatgtgttaaatggaatagctaaagaagtagaagcccaggcacctgaccttggtaagcataaaggaagaaaaaaaaatgaatgaaagaaaatagcctcagaggcctgtggagcaccgtcaacaatacacaaacaataggagtctcagagaaaaagagaaagagtctgaaagaatatttgaagaaatattgtcaggatactagaaatttggtgtaaaacattacacatccaagaagttcactgagctccaagtcggatgaactaaaaatatgt

SEQ ID NO: 116456 - DNA, 3159 bp, Homo sapiens
  misc_feature (2440)..(2440): n is a, c, g, or t
tttatttcccaactcacatttgaggtttacaagttttgcttagtgtgcttggtgctactcgatcaattgagacacagttcctctctggtgggggttcatgtctgtgtccagacatcttgttggctgtgctctaatcacagtgatcattttgagctgttgttaagaaaaaacatggcttccaacatagatgccttgttttctccaacaaatatttaagctatattgccacctccattttagttgtttccctttagatctggctgtcataatttatctgttttgcttcatccaagatgattgctgtaaacaggcatagggtgctgtcttcccttctaggcagcccagtaattccatctcagataatttctagttacctgttggatacttacgtgaaggtctgaataaattatgatcattacgaacatgatacatgagtaatgaattaaaagaaatatttaaaagttttatattttaagtctccagggagtaaggcattgagaaaatggggtaaatatttcttgtcgaagagaaatcaaatatgggtgaatcattgactactgggagtccttgggtttattctcagatctttcactttttggcagtattctggaagcaagttagtgacttgactgaagctcagtttgcacatctgtgaagaggacagtaatttctggtctcatagggctgttaagagcatggaatggaatccaattcggcttcatctatctttatttttcatgtaatctgtcaggcaccatgttagtggaatgtcttgtaaataatgaatcgtatagcctctggtctcaaggatctcataaacctactggacagatattatgtattttggtttcctacatgacatccaagttcatgaatcttttgaattctttccatacaacccaggatgcaagcttctggtaagacaaatggatatttattaagatcctgtaagaaacaaggcagaaaattaaagtcattaggagtatagaaataaaagatttcttgggctttcacctctgtaaacttgaggagtttggctaagtcagtagttggaagcgtagtaaggtcagaagtcaccgtcaacttccgttaaatcccaaagcttacaattatttaacagaggatcacctacgctaacagaatgttgggattttgtttgtttggggttttggtaaataattatatacattcaggggtcttagtactgggtagcttatataagtccaaaaatatgattgttagccttgccttttgattaataaaatgggggaaatatgttgttaaaaaaaaaaacgaaaaagggcaagaaactatttgaaaaccaggcattgggttgaattggaagtgaatacacttcaaaaggtctgaggagaaaatattagaaaccactgatttggataatgtctaatagctcttttaactcttagtcttttacctaaatatccttgatatttacagcatagtaaaatctggttttccaaggattctgatgaaagaaaagaaaaaaaatgaaaacagatggacaatctgagaagtaactagtgattgatggtaaatgtgaacaatgcttcagaaaggaaatgaaatgtctgcagcagatagaagtgtgtaaattttgccttcactttagagctagaatcactatgagtggtagcatttcagaatcagaagaatggaaagctcagttgattatcattacacataggagtaaaaggaaaggttcacatttttattgacagctcatatcgaaaagacagctcctcttagagagaagtgaattctcctccttcttgttgtttcttctgccacctttgccctcatacagcacgctctatctttatcttcttcccttttccctcctcctttcctgtcttttcttatcttcctccattctctccccatttcctttctgtgctccctctcctttctgcactcacctccttcacctttcatctgtaggtgacactaaaccgaggtttaagaagagccaccttggctgggtgcaatggcttacgcctgtaatcctagcattttgggaggctgaggcaagtggaacacaaggccaggagttcgagaccagcccagccaatgtggtgaaaccctgtctctactaaaaattcaaaaattagctgggcgtggtggcacgcgcctgtaatcccagctactcgggaggctgaggtaggagaattgcttgaaaccagaaggtggaggttgcagtgagccaagatcgcaccactgcactccagcctgggcagaagagtgaaactccgtctcaaaaaaaaaaaaaaaaaaaagccacctcacagagttgatggcagtgtgagtgctgctttttgtacattacctcattcagttctggacacaggaggggtctccaaatcatgctgcgtgggccagggagtctgatggaagaagtcatacttgagttatggctgtctcngggatgctgtgagttgactagcttgctgggaggctggagtctggctcacacattcagaacatttgcaggttactgagacaaccagtaccaaggacttgttctggagactaaccagatatggaaaacactgaggtaggcagaaatcagtttgtgatgggctattgatggtaaactaaggagctaaatggaaagctctggcaaacccttgaatgagagagaaatgatctaacagagaatcctctaacagaagtaggatgaacagattaaaggaaaaagtagggggagaccaggtgggaatctttcgcaccaagtcaggaaggaaatagagttgtcacaaaagctgagggaaggaagaggaggagaggcaaattcaagggactaaagaggttgactctttagaacttggcgatgatgtgaaaatgtgtaagaaagagtttaggaggccaggcgcagtggctcacacctgtaatcccagcactttgggaggccaaggagggcggatcatctgaggtcaggggttcgagaccagcgtgaccaacatggtgaaaccccgtctctactagaaagacaaaagattagctgggcgtggtggcacacgcctgtaatcccagctacttgggaggctgagacaggagaattgcctgggaggtggaggttgcagtgagccaagatagtgccattgcactccaacctgggcaacaagaacgaaactctgtttc

SEQ ID NO: 116457 - DNA, 247 bp, Homo sapiens
cccgaagaagcccatgtatttgctgtcaggtggagggcagccctgcctgctggggatggtgctgtgtcccccataccagcctggggaagccctaccttctgaggagcgggccacagcagtcccattttttaccggaggacaccactgaggccgagccagcatagaacccaggcctctctgatccacagcccacggggtctaggtaccccgctcccctgacccttttggagttggggccctgagagca

SEQ ID NO: 116458 - DNA, 87 bp, Homo sapiens
ttgaagacaaagtaagaatttcagtattgacgttagacaaagaattgaagtcaggaaatagtgcatgacaaaagataattttgtggt

SEQ ID NO: 116459 - DNA, 577 bp, Homo sapiens
atctttgagcacccagggagggcacttcctgttgccggctgccatggtttcagctgtccggtgcctgacctttctagaagatggtaatgatgagagttgtgactgcaaagcctctagccaacaactgagaagagctacactctgaggtctggaaggtctgtgcgtcttctgctccattttacacatgagacaataggggcagggaggggctgcatttgagggcactgcggaaccatggagggcttccgaaagatctctctagtgaaagctggaggaagaaagtataggcagaaggagcaaacagcaggccagactaagttccatgacagcagaaaccatgtttttgttttttgctgctgtatccgaagtacccagcatgtcaaaggcattgaattaaaacctactgaatggccgggcatggtggctcatgtctgtaatcccatcactttgggaggccaaggtggggggatcacctgaggtcaggagttcgagatcggcctggccaacatggcgaaaccccatctctactacaaatataaaaattagccaggtgtggtggtgggagcctgtaatccca

SEQ ID NO: 116460 - DNA, 187 bp, Homo sapiens
gaggtgattctgctcctgacttagccaggaagaggaagggagagctggtgctggacagcagccggtttctgctctgattcccccgctgattcctctctaggggtgagctttctgggcctgcggggaaaaggctgatggaaacagactgagtcacaaaagtgaggcagtgcaaagctgtgtcagaggc

SEQ ID NO: 116461 - DNA, 573 bp, Homo sapiens
tacttacttgtcttaggtaatcatcttaaatgcctggtccctacctcctgaatggcagtcccaagcctcgttttctcatgtaacctgggtattgctggtagatggcatcccagagtgatcttgcttagtgtgagaaaccaagcccaatctattcctcacacaccagtatgatatttgtaaaaagaagtcagtatatatttacctataaaaatacttatttatccataattcaacttatatgaacttttctggtaaaaaacaggtagataaagatatttattataatgttacttataatagcaaaatatggaaatcaatccagatgtccaattatgagaatatggttaagtgaattaggaatcatccttaatggaatatcacatagccatgaaaaatggtgatcaggcaaaagctacatagcaacatgcagacatgctgatgagatgatactaaaagggcaaagtagtgtgcaaaataaatccacactgaagattacagttgtgtaaaatacgtgtatagacaaaaaggcctggaaaacaatatataaaagtgataggagttgttaatgtgatg

SEQ ID NO: 116462 - DNA, 398 bp, Homo sapiens
tctagcagagagaaatagtgttggctgtttctcaaaaattttattatggaactattttgttgaatgcctactaatatttacaggaacacaaatacctttttgaccttaaacatgttatgaatcttcctgaatcatagcctcctaatccataacatggggataatatttgtctcataaggttattgtgaatgttaaaggagatgatgtatttgaagtacctcttttagtgtttgagccatataaagggctcaaacaatgtttattcttattactatcttttaagatttttatttcactatgtgatttttcttgctatatttttatattttgtcatcaaaattcaaaaaaaatgctcatgtacgtcttcatttttaaataaaattaccagacctcttcta

SEQ ID NO: 116463 - DNA, 801 bp, Homo sapiens
agacttgttttattcatggaatatttcaccatatatttgccataaggcctgaagactctgttaggtgcttttcccatttttttcccctcacacttgaggggtaaagaaagatatcggtaggtcataatcatttatacatgtgaaattttgatattgcatatgcttggcacattgaaagtaagcatatcagtaccatagatgaggaagcatattgctcccagattttattgattctttctcatttctgcctgtctttcctctccttatccccctaaattataatttcattgaaaaagggcttcttttcaacacacactggtgcctgtcagggagtgcggggttgtgcggaggagagcatcaggaaaaatagctaatgcatgctgggcttaatacctaagggatggctgataggtgcagcaaaccaccatggcacatgtttacctacctaacaaacctgcacatcctgcacatgtaccccggaacttcaaataaattttttttttaaaaaagggattcttttatagcccttaccttgagtgataaagggtcagaatgaaaaggtacttctagaatgtaatgcgattttatccccatttagatgtgattctattctctgttaagaaatgaaataactgtaaacacaatatgtaagtgaactgttaaactacttccattaaatgtttcaagtaatggaaatacatcaacactaaccctacaagctatgtgccttaaaagttcatagcctcatttttatgagcttcaaggctttttgcattagatgaaaggaatagtaccctgtaa

SEQ ID NO: 116464 - DNA, 135 bp, Homo sapiens
attttcaccacccaagatgaggtgaactagcaagtccattgggcctcatggtcttatattcttacaactgagatgacagctgtcactcacatgcaaaatctcctattgccataatatcccctgtgttatcactgt

SEQ ID NO: 116465 - DNA, 403 bp, Homo sapiens
aaaaaagaaaagaaaaaaagaaataacctggttgttggcagataattctattgagtatataactggggatagctcatttttgaaatcagtttagaacatttaaaatgtgggaaattcaaataaaaatgcaaattttcactgttttctaaaaagtcagatcaacattgctggcccaccactgatataatactctatatcaatactcagctaatattctttagaccctccagactattttactcacttacattaaatgcctgactcctatggacatttaagtaactgatttctgccctaattctctgttatctaatttctcctcccttataacatgtttgtttggggatttattctcatttgttagcgaagcagaattttgagacttcaaataaaagacaattcc

SEQ ID NO: 116466 - DNA, 218 bp, Homo sapiens
agcaagggggatgttcattcccatgattcagtcacctcccaccagaaccctcctctaacactggggattacaatttgacatgaaatttgggtggggacacagaacgaaaccatttcggggattaagtagataagttgtatttagaacagtggtgcctagctggatgcagtggcacatgcctgtagtcctgcctgggcaatgtagcaagaccctctctc

SEQ ID NO: 116467 - DNA, 324 bp, Homo sapiens
caatttagtgtattttagagagggtcagccagaatcctctttaagagaaaacacttaggctgggtgcagttgctcactcctgtaatcccagcactttgggaggctgaggcaggtggatctcccaaggtcaggaattcaagatcagcctggccaaaatggtgaaaccctgtctctactaaaaatacaaaaaattagccaggctataatcccagcattttgggaggctgaggcgcgagaattgcctgaacctgggaggtggagctacagtgagccgagatcgtgccactgcactccagcctgggtgacagagcaatattccatctc

SEQ ID NO: 116468 - DNA, 400 bp, Homo sapiens
acacgtgagggtaagtggagaggcatgacaaggaaggaagaggttggaataatttcattcttttacaagaattaatgagaaattcttaaacatgccaattcggttatgactcacacaaaaacaatagctcacgactacaaaacataaaacagaatgatttggggggtaaaaacaagagttataacctttctcctgccctttaaaaatattttcaataaatcaaagccataactagtttttgccaaacagctcatatttatatagaattttacccctgtagagaatttttctctggaacaatgtttctgcacttgaacgatggtactaacctcctttacagtaaaaaaaaaaattatctcaggcctccccagagcaaactaaaaagaaattatgcataaga

SEQ ID NO: 116469 - DNA, 902 bp, Homo sapiens
agcgggtgggggtgggcacctgcccacctgtggtcttcattgaggaggaaggacgttttcgaagatgccttggaaaccatctcaatatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaaaggaaatgcatgctgaaatctgttatgccgagtgtctcctacagaaagctgcactcacgtttgtgcacggatgacacatcatgatcacattcatcaacggtggactcacaaattagaacaagttaccaaatatataagtcaccattaacagatacagtaataactaaaaagttgcgccattttatgacgaatttacttggcaattgtggacccctgaaaaaccacaaaggtgaggcacataattgtttggacaacaactggggtcggataagacttgggctccaacaccagagattggcccacaaattctttccaatctggtcaaccacatggcgtttcccacaaatttgcggctaaaacacagcacacaggctttctatactgggtgaaaattcgcagac

SEQ ID NO: 116470 - DNA, 1054 bp, Homo sapiens
agcgggtgtggtttcttctcatctagagaggctactgctttttctttttgaatttattttcatttagatgggcgtcccccccacctcccgtttccacctcttctaggggtgtaactatagcgttagtatgttgggtagggtcttttgggttcgcttctaaggccctgcgcgattctgtctgcaggttttatattggtctgtgcagtttgacctggaggtcagtaggtggcgcctatggatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaaaggaaatgcatgctgaaatctgttatgccgagtgtctcctacagaaagctgcactcacgtttgtgcacggatgacacatcatgatcacattcatcaacggtggactcacaaattagaacaagttaccaaatatataagtcaccattaacagatacagtaataactaaaaagttgcgccattttatgacgaatttacttggcaattgtggacccctgaaaaaccacaaaggtgaggcacataattgtttggacaacaactggggtcggataagacttgggctccaacaccagagattggcccacaaattctttccaatctggtcaaccacatggcgtttcccacaaatttgcggctaaaacacagcacacaggctttctatactgggtgaaaattcgcagac

SEQ ID NO: 116471 - DNA, 392 bp, Homo sapiens
gcccagcttctgtgttcagatctgatgcttggtgcccgcagctccaaggagaccccatggttcaagctgcaattacttgctccacaggcccttaccaaggaaagtcaggttttttccctcctgaggatcctctgaccagcatcttcagattttttttcagttagaagtattcattgggcacctgttttttgtttgtttgtttgtttgtttatgaccacatcagtctttcattagaatctttgctttatctcattgcatagttgaatttcttctctgccatgttccagtcagaccccattcatactcacccatctttgttcacgtctttccctagaactttgtttttgcaacatgggtccactcttccatagttagtttctcacttccctctg

SEQ ID NO: 116472 - DNA, 719 bp, Homo sapiens
ctcactctgtcgcccagaggctggagtgcagtggtgctatctcggctcactgcaggctccgcctcctgggttcacgccattctcctgcctcagcctcccgagtagctgggactatgggcgcccgccaccacgcctggctaattttttgtagttttagtagagacgggatttcaccatgttggccatcatggtcttgaccttctgaccttgtgatccgcccgcctcggcctaccaaggtgctgggattgcaggcatgagccacagcgcccggccatcaagcttctttctctctccccctctctgtttcttgcacagctgtacagactttttgtatgtagtaagcatgtttacctgtgactagtaattccaccacaagcatttcacccccttatagctctgcagatattttctggaatgactggagatggcctgtcttcagtcatgatccatccctgaaccaatcatgataaaatctctttggttggttctaccacatgcattaatttctgctagagcatgggggtcctgtgaaggaaccaaatatctatgatgcttgttaaagacagaatgaaagactttactcaagagggactatcgtgataggtgaaatggggtcttgcagtgggggagaaagattgggctcaattctgaacgcaacaaccaaaagtggtgatttatagccaggaagtcaagtgagggtcagtggatggagacagcag

SEQ ID NO: 116473 - DNA, 489 bp, Homo sapiens
cttatagacatcaacagagacctaaaaaaaagcacataaacaaaacttcctaaagaaaatttataaagcggtatggatgttaaaaaacaaacacaatacaaacacaactgtttgcgatacatacaaattgagaggtacatggtattttaagcgtgtaacaagttgctgccgaggatggagtactgtccacagatcttacaactgaaaaaagccctcaggaaggaaattattgaagaaggaaaggaggaaggcctgatggctttagataagaaagacatttcaagcataggaaaaagtctctccaacatacagggtcagaaatataggaagaagtttcagctctctttgcttgcagctcagatcctctctagtgtggttttcccttaaatccttaagccagatgtagtaaacatctggggcaccaaagtatggtaggatttttcgagaaaactgatcatttacatgccattactaccaaagctgtcgttc

SEQ ID NO: 116474 - DNA, 268 bp, Homo sapiens
caaggagggctgtaagtagattcaatccctgggcagggtggaagaagcctgggaaagctcaagactaagcaaggccctgtttccgctgaatgggactaaaagcagaaattcagctgagttctagagcactcgagagcctcgcgtctcactcatctgagcctgctgaggtgcggtgggaggacagcagtgacgaggaggctgatagcatgcactgactgagatggtctgcctgtctgagaaatgaagacgggcagatgctgacctggag

SEQ ID NO: 116475 - DNA, 323 bp, Homo sapiens
caggctggtcttgaactcccggcttccagtgatcctcctgcctcagcttcccaaagtgctgggattacaggcatgaaccactgcacccaaccttttttcattcccttaacgaaacctttggatgaacaaaaattcttaatttcagtgaagttcagtttatcgacttcaatttatacattttataaagtttatgaatttttttttttttttttagacggagtcttgctctgtcgcccaggctggagtgcagtggctatacccaggtgtgatcataactcactccagcctcaaactcctgggctcaaggattcctcctgcctcag

SEQ ID NO: 116476 - DNA, 389 bp, Homo sapiens
agacgtcattctgcatattggatcagatagtgacatctttctgtatataaactctttaactgctattttagggacctgcagttggcacataatggttttatatcatagcagtaaatattggcaagaaatcccactcatcgaccccgggtaaaaaagggaaaggcttatgcaagaatggactgcatattccgaggctagtatgtgctcagctgggctgctccaggctgaggagaggagctgcaaaaaatatgattttcatgctcctaaaagagctttcagtcttgttggagaagcaagatgaacaatacctgacagaaagaatcatatccaatgagtgctttagaaaatattgccaaggcactgagaaagaaatgaggatggaagtaggc

SEQ ID NO: 116477 - DNA, 392 bp, Homo sapiens
ggtctggtagaatttggctatgaatactacatctggtcctaagctttttttttggttggcaggctacttattactgattcagttttgaagctaattattggtctgttcagggaatcaatttctttctgattcagtcttagaagggtgagtgtgtccaggaatttgtccatcttttctaggttttctattttgtgtgcatagagatgttcgtagtagtttctaattgttatttttatttctgtggggtcagtggtaacattccttttttcatttctaattatgttatttggatcttctctcttctttattagtatagcttatgttaagttgaggaattagtcttcaaattcttctcatttggcttcaaatcttccctcaggctgtttctaatg

SEQ ID NO: 116478 - DNA, 297 bp, Homo sapiens
tgactacaggccagttctgggtgagagtggaaggtcatgcagcttaattttttttcttaaaaatttgttttaaaaaaatagagatgggtctcgctgttgcccaagctggagtactgtggctattgacaggtgtgatcccactactgatcagtgtgggagttttgacctgctccattctgacctggactggttcagtcctccttaggtaacctgctggtcccctgctcccaggaggtcaccagtgctgaatttagtgtagatatccaatcagcataacccactgcagcctagaactcc

SEQ ID NO: 116479 - DNA, 799 bp, Homo sapiens
cagacctttctactgagccccaactccatgcttaagaggtttttcttattgaaagtcacctatctcttccctcaggaatgccaggatgggggttatggtggtctcgtgcattggttctcaaactgttatgtaccaaggagtatcctggggatcagttcaaatgcagattcaggagttctggggccaggcctgagactctgcatttatagcaagcccccgggtgacgccgacacagacctcccttggagcagtaagggcctggtggagtcagccagctccccagatctgagtgcaccccggccagccctgacactggtcccatctgagcccctgtcctctctcctctccactggagttcgtgtcactacatgcagttgccgtggggacaaaatgagagaaaccatatttaaaacttgtaacaacgcatcatctcaaaagatagaagcagttcaacgatactgttcattatcctgtttcttaggaaatagtacctctacatggtctggtggtgggagcagggcggggggcaggggacatgacattaccactcctgtccacagcgtctcctggcttctgagtactttgtggaaatatttttctcaaggatgttggaggaatattaggagctttagaaatttaggagcttttgagatttatgcaaagacatttaaactagactcttttcactttctgggagtaatttttatttttaatgtcacttatcacaaaaggaaagaaagagatgaaaataacttttcctgtcgggactttttgactgaggatggaagttgataaggac

SEQ ID NO: 116480 - DNA, 248 bp, Homo sapiens
gtgtctcctctctgggtcatctctctgtcttctctctgggtcatctctctgtcttctctctgggtcgtctctgtcttctctctgggtcgtctgtgtcttctctctgggtcatctctctgtctcctctctgggtcatctctctttctcctctctgggtcatctctctgtcttctctctgggtcatctctgtcttctctgtgggtcatccctgtcttctctctgggtctttagctgctgagcgtgcatct

SEQ ID NO: 116481 - DNA, 924 bp, Homo sapiens
atcttttgaaattctaaattctgatgcagaacgtatcagtgaaactccctcccactgtctcttgtattagcatcaaggaagcgagaaaaaataagcaccctgagaatggagacagtgtttgaagagatggatgaagaaagcacaggaggagtttcatcttcgaaagaagaaatagtccttggccagagactccatctaagctttccttttagcattatcttctcaactgttctctactgtggtgaggttgcctttggtttatacatgtttgaaatttatcgaaaagctaatgacacattctggatgtcatttaccatcagctttattattgtgggggcaattttggatcaaattatcctgatgtttttcaacaaagacttgaggagaaataaggctgcattacttttttggcacattcttcttttaggacctattgtgaggtgtttgcacaccattagaaattaccacaaatggttgaaaaatcttaaacaggagaaggaagagactcaagttagcatcacaaagagaaacacgatgctggaaagggagattgcattctcaatccgggataatttcatgcagcagaaggctttcaagtacatgtcagtgattcaggcttttctcggttctgttccacaattaattttgcagatgtatatcagtctcactatacgagaatggcctttgaatagagcattgctgatgacattttccctgttatcagttacttatggggccattcgctgcaatatactggccatccagatcagcaatgatgatactaccattaagctaccgcgatagaattcttctgtgtcgtgatgtggcgttttttggaggttatctcacgtgtagtgactctggcatttttcattgcatctctgaaactgaagagcctacccgttttgttaatcatatattttg

SEQ ID NO: 116482 - DNA, 308 bp, Homo sapiens
tggtgctgcacgcctgtagtcccaggtactcacaaggctgaggtgggagaattgcttgaacccaggaggcagaggttgcagtgaactgagatcgtgccaccgcacttgcatttcagcctgtgtgacagagcaagactccatttcacaaaaaaataataaaaaaaaaaaacttaatgccaaagtggaatattttggggtggcaaatctggaccttttcaccattcagtaagttaattcccagttaacatctcttcataaatcaaagagctgcttctttagataacctgtggtaatgaagcctttaatgg

SEQ ID NO: 116483 - DNA, 146 bp, Homo sapiens
ggggagcagtattcacaatatggtaagtgattttgaaaaacaagttacacagacattttgaagtagtatgcagatgtctaataagcccttgaaaagatatttaacatcagtcattatagaaatgaatatcaagccagaataccact

SEQ ID NO: 116484 - DNA, 465 bp, Homo sapiens
gaagctaataagttaaacctttgagagatgccaaaaaaagaggtgattcaaactgttgagagaagtccattgttttctaaggggaaatagaactccagaatgaaacagtgtacttataagtatttaactggaaagtttaggggaaaaaagcaaactcacacattattttattattattttaaatctggtaatctttaaaaagaactgttctcagtgtacttccaaggaaaagaaaatgtgaacagctagggttaataggatacaaagtgcaaataaactattttttttatagaaacagcacataatgaggagtaattttgccaagttagtctggattctatctgtggacaaatacaaagaatcttaggttatattataacatattatagcaacattttatgtttagcattgttttctataaaccagcttcaggtggttcaactactattgaatgaaaaaaaatta

SEQ ID NO: 116485 - DNA, 493 bp, Homo sapiens
taaacagcctgctctgttgcccaggctggtgtacagtggtggcatcaaagctcactgcagccttgacgtggcctcaagtggtcctcccaggtagctgggactgactataggcatgcaccccacacttggctaattttttatttttttgtagggacagatctcactgttggtgcctaagctggtctcaaactcctgggctacagcagtcctcccacctcagcctcccaaggtgctgggatgaaaggtgtaagccactgtgcccagcccaactgtgttatttgtggaagtttctcagagggagaaattacagggctaaagtactacacgtgtgcatatattaaagttttttccagtaactacttaataatgtgtacttgaaaactgctaaattcttaaatgtcctcaccattaaaaaatagtaagtgccgggtgcatggctcatgcctgtaatcccaacactttgggaggccaaagtggtcagatcgcttgagac

SEQ ID NO: 116486 - DNA, 666 bp, Homo sapiens
ctgagactcggtcctgggcctgggagccagcagcaccatgcccacctggtgctttctgcctgccccatcccctgaagtctcgtgctgtgatgcctacatggaaacagaagataaagatttcccctcattcaaggcgggacgttagaaccaaaaaccccacatgatgctgggaccctctaagaattggaccctcaggaaggttaaactggaaaagaaaattacctcccagcacagagaaatggccttgaaacctgcctttctcctcttgggctcaagaaagtcttcctgggaattcataattacaggcctgtcctccaacaggcttgaagtttgaatttatacaaacaacatagttcaagaagcacacagccaaaatgtgtgtgccaggacactcggggacattccggaggcagggagctgggtgctcaggggtggccaggacacgatgacacctgcctttgcacggacacagtgtgtggctggcagggggcaccccaaccccagtttccagcaggaagctgagaaccatgaagagatcaaagagatcaactagaaatatcttgaagccagtgagctcagtgataacagtctccaaccatcttttgggaggccgaagtgggtggatcacgagatcaggagttcgagacaagcctggccaactggtga

SEQ ID NO: 116487 - DNA, 666 bp, Homo sapiens
ctgagactcggtcctgggcctgggagccagcagcaccatgcccacctggtgctttctgcctgccccatcccctgaagtctcgtgctgtgatgcctacatggaaacagaagataaagatttcccctcattcaaggcgggacgttagaaccaaaaaccccacatgatgctgggaccctctaagaattggaccctcaggaaggttaaactggaaaagaaaattacctcccagcacagagaaatggccttgaaacctgcctttctcctcttgggctcaagaaagtcttcctgggaattcataattacaggcctgtcctccaacaggcttgaagtttgaatttatacaaacaacatagttcaagaagcacacagcctcaggggtggccaggacacgatgacacctgcctttgcacggacacagtgtgtggctggcagggggcaccccaaccccagtttccagcaggaagctgagaaccatgaagagatcaaagagatcaactagaaatatcttgaagccagtgagctcagtgataacagtctccaaccatctttaaaagagagcgggtcggccaggtgtggtggctcacatctgtaatcccagcactttgggaggccgaagtgggtggatcacgagatcaggagttcgagacaagcctggccaactggtga

SEQ ID NO: 116488 - DNA, 216 bp, Homo sapiens
gaccctaagcctcttcaggatatttgttttcctggctcccttcctgaattttttccatcctgcacaggaatgtttaatctcctctaaagagttagagcctagatcttctcttccagtaagaagatgtagaatttataggaaacagtgaaaacgacaacaacaacgcccttacacttgcatttagttttcccattttacagaatcatttcccatggt

SEQ ID NO: 116489 - DNA, 413 bp, Homo sapiens
ttcatggagtgaaagtcagagagtgaaatttagcttagtttctatggggatgtgagtaatctttagggattattaaaacaatatactttttttccccccaagttttcccttgctcctctttttctagctcttcccccattcacctatggaatcatctgcattcattatttcaggagagaggtagatacagtctaaaatgtaggagtaattgctcagctctgagacttacattttataaaaataaattcttatcttaatgtaaaatacttcttcaggaacaaaattcaaaagatccaaaaggatctaattgtacataaatctcctccttctttctccccaacccaccagcattctttctctttgtcattcagttctgtatacacaaacagtacatagtttacactcttgtacac

SEQ ID NO: 116490 - DNA, 828 bp, Homo sapiens
gtcaattcagttcatgtaaaatgaagaaaataataatcatcagatttatctgtgttctgaggctataagggaatttaaaattgaaagcaattttaatgactgcttaataactttaataactggagcagcaaatttgaacgattagacaaaaagttaatgcgaagtactgatattatttaatttctctactaactatttcagaacaagttgtgtgtaccttttgaaataaactctagaaccgttaggtgagctgtgaagtgatatctaatagagatgggtctaagaaataggctcaggttctaagagaaaattgtcaatatgatattggggctggggttacagattaacagcatctcaaggcagaagaatttttcttagtacagaacaaaatggagtttcttatgtcttcctctttctgcatagatacaataacagtctgatctctctttctttcccccacaatttattggtaacaatatggtggattggattgtcatccaccaattcgggcagttctcaatttagaaatctcaatttagattatgttccaaatgtgcttcattgattataacttggagtacattttccttatagaaagaatggtataaatgatttccatattagcattcttctggttttgatacaattgaatgtaattttttctacattttttggagagtaagttaataatttctagcattttctcagaatatattactattaaaataataggaatgaaaatatataatcaagtatatagtcttttaacatttcattttctgctagtaaaataatatctagaattttatttactagtaaaatgaaaaa

SEQ ID NO: 116491 - DNA, 711 bp, Homo sapiens
aacaggatgactaatctatcttccatctaattctttaagggtgtattgtattaaatagaagcatttctgaacatgggatataggtttgttctcagtttatgataattacattctgacaagttttagggaatggcctagagggctggagtagcaaaggacagctctaagcaggtggaaagcagcctcttgtgcttagataatgagctgtgtaccattagttggttcttagtcctgtatcccctccccaaagtggcccccttaacctctgcagtgattggtatctccgttcagacctcattttgtggcacagcatctgatcagggagagaggaaaatgagtatcagcatctgagcatgttactcagaaggtgtgctggcctggcttagaggtcagaaggtcatctctaggatgttgggtttctaaaacctagcatggatgagctataaacctatgaattttcattgtgtgttcaagtatctgtacttgccctcctgttttcaagaggtttcactaactcaaaaaaaaaatcaaaaggattggtttcctcatctcattatttatggcctcatttctgtatttataagagagatgaaagaaacatttgatttactgaagattccttttcaaaggtttgtttctcaaatagctttgaggtagtgggagtaaatcagggattaattccagcccggtggctggttttcctctagcttt

SEQ ID NO: 116492 - DNA, 470 bp, Homo sapiens
actctccctactgtatcctaaggacaaatactgtgtgattccacttatataaagtgtctagagtagtcaaatttagagaaatggtgtgtagaaacagaaaggtggtctccagggactggaagaagggggaaatggagagttgtttaatagttataggatttcagttttgcaagataaaaagttctggagattggttatacaacactgtgaatacacttaatgctactgagctgtacacttaaaatggttaagatggtaaattttatgtaaattttacccaattttttaaaaagtctatctcaaaagtttatatattgtctgattccatttatataacatttatatcattttcaaaatgacaaaactgtggagatggagaatagtaagtgttttctggagtcagggacaatgtgaggaatagggaggagtgtaaatacaaagaggaatattgtggtagaacagttgggagt

SEQ ID NO: 116493 - DNA, 360 bp, Homo sapiens
catcctcatgttgcttgtgatagagggtgggctccttaccctcttgttgaatcaggagaataggctgtaatagaaataaaagcgtttttaaaatgaatgctgataggctgggtgcagtggcttacagctgtaatcccagcactttggaaggccatggtgggcagaccacctgaggtcaggagtttgagaccagcctggccaacatggcgaaacccatctctactaaaaacacaaaaattagccaggcgtggtggtgcatgcctgtaatcccagctacttgggaggctgaggcaggagaatggcctgaacccaggaggcggaggttgcagtgagccaagattgcaccactgcactccagcc

SEQ ID NO: 116494 - DNA, 170 bp, Homo sapiens
aaggccactctatgagggaaaaaggaacctacaatcatgggctgctgagttcccacgtggtctttaagaaaaactgggcacgttctcctgtggccaaagggtcaataccgtacttgaagaaaggaacatggctgagtgtgtaatcccagcacttggggaggccaatgcgg

SEQ ID NO: 116495 - DNA, 194 bp, Homo sapiens
tgacttgcttcacgtctccaatggggataatattatctgccagctgtcccctggagctactgttgtgtaggtgaagggccgactcagaaaatgctttgaaacccataaataatgacatggatgagaatgagtattttgtgtgttttactttcacatgttaggactcaaaggtggaatgaagtgttttctaagtt

SEQ ID NO: 116496 - DNA, 674 bp, Homo sapiens
agctctttctgccatgtgaggataagaagtcagcagtctgcaacccagaagagggccctaaccagaaagttgttgtggccctgatctgacttccagcctccagaactataagaagtcaatgtctgttgtttacaagccactctgtcttgacttttgttacaggagcccaaattaactaagataaccctatctgagactgggcacagtggctcacgcctgtaatcccagcactttgggaggctgaggaaggcagatctacaaggtcaggagtttgagaccagcctggccaacatggtgaaaccccatctctactaaaaatacaaaaattagccaggcacggtggtacacgcctgtaatcccagctactcaggaggctgagtcaggataattgcttgaacctgggaagcagaggctacagtgagccaagattgtgacactgcactccagcctgggcaacagagcaagactctgtctcaaaaaaaaaaaaaaaaaaacccatctggagaaaactaaaaagctcagtctttcccctgggcccagaatgcccttcttcccctgccctaggaaagcccagtcacctctgaggaggcagcaacatcctggctcctcccacttgctttcagtgcatccccacgtccattctctcatggaaccctgtgcacatctctatctga

SEQ ID NO: 116497 - DNA, 520 bp, Homo sapiens
  misc_feature (5)..(5): n is a, c, g, or t
  misc_feature (42)..(42): n is a, c, g, or t
caaantaagtagggtcctctagatgagatcatacctgaattnactggttgggtcctttatccaatacagtcccattcacaagttcggagggatacagcttttggggaacaccattcaccccatacacccccttctctcaggcttgtctgggatctagatggaaagccaggggacccggatgcatggtcctcaggccttactttgagaaccacctcttgcggctgtgcctcactggttgggtccctcaccaccagctctgcccatcaggcccacatgggcctccatttgtagatgagggaacaagctcagggctaaggaacctggtgagggtcacaccaggagcaaggatcccagccgggcctcgaacccaagtctctcaacctcaggccaggcccttaaccctgagcctccgggtctgggacccaccacgccctaccctgctctgccctgacccaggtacagctgcagtgtgttcacctgcacgtgaccagtggcccggtgtccactccccacatgacca

SEQ ID NO: 116498 - DNA, 366 bp, Homo sapiens
ctaacaccacccccacccgggacacacacaccacatttaattccactccatttcaacatgtatgttctctagactccctctgtgactgcgcacagcccagcggcagaggcatgtttataaaccattaaaacacgaagcttgcaatcggacagatctgggttgctctctattaaacgttcatttgtgacctcaggcctgttaccgtctttgagcctcagagtcctcatatggtaaatggggacaataccagtacctgccttgtgaggttgttttgaggattagagtgactgaaggtaacgccgttagaacagtgctaggcacgtggcgccaagtaagtacaagtggacggcagtgaggagaaactga

SEQ ID NO: 116499 - DNA, 285 bp, Homo sapiens
ggcagcttcgccgacagagcagggttcaaccatcatgcctattactgacttccagcaaatccaataacctctctatgcccgtttcctcccctgtacaacggggacgatcgggacagcgagctgccaggctagtcggggccccgactagcccgacagacagatatcagctctaataattacttccaccgtagcatcattcatcatgctgcttgttgtccaagatcgactgcagcataatataccagaacaccactcttgttgaacaggagggctgaagtcgtctca

SEQ ID NO: 116500 - DNA, 319 bp, Homo sapiens
ctctctgggcctgagttgccttatctataaaacagaggtgatgataataataatatgtgtttcattgttttgttgtgagccttaatgagctactgaatatcagttgcctagaacaaactcttacatatagcatgtggtcaatcagagttaactaccatttaataaatttttgtcttttaatattttcattcagaagaattagacactggctacctcattacccaatgttttagaaatattgcttatctgggaaatctaaaatctgagaaccatgatttctattgtgggctcatagaattctttgcagttgtgcattatg

SEQ ID NO: 116501 - DNA, 481 bp, Homo sapiens
cgatcttagttcactgcaacctctgcctcccgagttcaagcgattctcctgtctcagccacctgagtagctgggattacaggtgcacaccaccacaccggcgaacttttgtatttttagtagagacagtgtttcaccatgttggctgggctggtcttgaactcctgacttcaggtgatccacccaccttggcctaccaaaatgctgggattgcaggcgtgagccaccgtgcccagccccaaactacagtttttgtagaatgtttcctgcttgaaacagagcacctttggccagtggctggtgagtaatgtggtgttcgcaagatccaggagcaccaaagatgccagtgctcctggaagtggggccacccaggcccagggcagggtcccagctcctttttcttccagaggctaccactgacgttattactaggtacatgttaaataattactaagtttcccatgggggaggagttgcctttg

SEQ ID NO: 116502 - DNA, 263 bp, Homo sapiens
tgactggaggatagaattaatcaggcaagcaatagcacctactatggaatattatctctgcagggtactgtaggaaatgcaagaataaatataagacattgtccttactcccaaagtgctgggattacaggcatgaaccaccacacctggccaacttttatgtttttgatatatattaatatattcctgttgtttaacttttgaaaataatgaatatatattactttttaatactacttttacaaccataatcaaatctgttt

SEQ ID NO: 116503 - DNA, 337 bp, Homo sapiens
atgtgtacattttttatttaactaacactttggtgctccaggtctcacctagactctggaaagacaaagaaaagtgagacaggatctcttatggagctcacagtgggggtgaaccatcatcctggttcgctcagaactgcaagtgtgactttagcagtcacactttatcagggaagaaagacatgtaggccaattaactatatacaattagtgagggcagaggaggagtgatatggcttggatatttgtcccctccaaatctcatgttgaaatgtaatccccagtgttggaggtggggcttagtgggaagtgtttgggtcatggggaggcagccccc

SEQ ID NO: 116504 - DNA, 276 bp, Homo sapiens
caacagagcaagactccgtctcaaagaaaaaaagaaaagagaaaaaggggagtcctagtaagtgtgcccagtctgtcaccatcaagatagtgagggtcagcacagtggcctgcaagtcagagtaagcctgggatgagacttcagagctgctcttctcagactgcagctctgctcctcagtttctacctcccagagtcttgtgcatcccagagtccaggctgaaccgggccctctggcccagcgagtcctttgcattcctaggcaaggctggtgcgt

SEQ ID NO: 116505 - DNA, 277 bp, Homo sapiens
ttttactttcttctctgttaaagctgccttggtccttctgtctcctctgatagtatcgagtcattcagatgtatttgctttagttgattgccatgctttcaaacaggttccataagctacacatccacttttaagactaaattgagcttcattgaatgtccttaatgaccacaactaattcctagcccaaaggagggaagctgcagccaactccctcaatcctcaagaacaacaatgccgatagaacccctgtgtgatccgggagctttggtctggt

SEQ ID NO: 116506 - DNA, 389 bp, Homo sapiens
aaaaaacatataatagaaaatgaaaaattctgtttctattccctgttggtagtttagtgcatagttttctaaactttttagcatgcttatatgtaatgtttcatttttaacattgaaataattttagatgtacagaaatgttgcaagaataatacacaattggtcaggtgcagtggcttatgcctgtaatcgcagcactttgggaggtcaaggcaggtggattgcttgaggccaggagtttgagctcagcctggccaacatggtgagaccccatctctacaaaaaatacaaaatttagccaggtgtggtggcatgcacctgtagtcccagctacttgggaggctcaggctcaataattgtttgaacccaggaggcagagattgcagtga

SEQ ID NO: 116507 - DNA, 613 bp, Homo sapiens
ggaatccatgtgtaagctttccatgatctctcctttctgggatgagtcacacacaacacagttttccctgcagcaaaatgcagcgacacgtgtctcatgtttctgcccagggaagcccactagagactcagtgcccagggtttatactgggggcgggtcacataggcaccctgtgcttggcagttgccaaattccacagtcccagcttacaggaaagcagatgttcaccataaatcacattgttaatctaaggaaagcaaaacacctttgtcagtatatggaacttttacgaagcttaattcccaagtgccagccaagggtcaaccttataagcaggttcttttttattttatttcatttttataaatagagacagggtcttgctatattatccaggctggtctcgaactcctgtcctcaagaaatcctcctgcctcggtctcacaaagtgctgggattgcaggcgtgagctaccacacctagctcaggtgcttctaaagatagcagtttcaagcctgctatgtttactgttttatgaatgtcaacattctccataggatataaacaagacccagagttttataatgctcaaaatatccaagacattaaccaa

SEQ ID NO: 116508 - DNA, 483 bp, Homo sapiens
gctgggattacagacatgcgctaccacacccggctgatttttgtatttttagtagagatggggtttcaccatgttggtcaggctggtcttgaactcctgacctcaggtgatcctcccaccttggcctcccaaagtgttgggattaaaggcgtgagccaccgctcctggtcgcatctttttatttatgtaacaacactgcatacataactgctattctggttgtattaattcccattactttttaggtagcctcattcctcacaaattaattgttaaataaaccgactaaaaacacttctcttatagcatgaatttatatagcatgaatgaaattcagtaacataattcatcattctcttgagtgtttaccattaactttgacgcttgtgttaaagtgttctctgcagtggtatgactgggtacgtgtgtgttgatatggagaacacagaattgaatgatacctgtattgttttgatctcttct

SEQ ID NO: 116509 - DNA, 717 bp, Homo sapiens
agttggaaaattagcattttgcaatcatatagtaaagattggttggagcaagtcacgcacagatgctaaatctatggggaaagtatgaagaagatgatatttgcttgctctcaatgtatcttcctatggattgttactaattacaaaagaaaaatccctaattacacagaagaaagaccttacaataccatgaccgggtaatcaaaattaaaatcaccaatgagggtagatgaatattgtgtgcttctagatgtgataccatgagaaggataaaaacattactgggactgtgtaacctgaatctactcttgaggaaacagataaactcaaattgaggatattctatgaaataactcacttgcattattcaaaaattaagatatgaaagatatagaaaagctgaggaattcctccagatgaagggagaccaaagagacatggcaactaaatacaatacatcatcttaactggatcctgtacctgagggggaaaaatgacataaggggcattatgagaacatttgaaaagattggaacatagactgcagataaggtaaaaatatggtatcaacattaaattctctgaatttgaaaactgttctgaaaccaaatattcttggtcctagaaaatgcacattcatttatcaagaagcaaagggtcatgttgtagcaatctactctcaaatagtttagaaaaataaattacatgcatatacat

SEQ ID NO: 116510 - DNA, 666 bp, Homo sapiens
tacatgatgtaggacagttttcatattagttatctattgctgtgcaacaatattactgcaaactttgtggcttgagacagcacacagttatcactatgtggtttctgtgggtcaggaatccaggcgtgactcagctgggttcagtgcaaggctacaaccataatgtcagccagggctcagttctcatctggaggcttgactggtgattgatctgcttccaggctcatctggttgttggcagcattcagttccttgcaggctgctggactcagggccccaggttcttgctgtcctcagcttcttgccacatgggcctctccatctggccactcatgacatggcagctcacatcttcaaagccagcaagataacctcctagcaagacaacttaacatcctatctaacataatcactacatcccatcacctctgccatattctcttggttataagaaagtcattggtccctttgtcagatgagttgattgcaaaaattttctcccattctgtaggttacctgttcactctgatggtagtttcttttgccgtgcagaagctcttgagtttaattaggtcccatttgtcaattttggcttttgttgccattgcttttggtgttttagacatgaagtccttgcccatgcctatgtcctgaatggtattgcct

SEQ ID NO: 116511 - DNA, 4066 bp, Homo sapiens
gtagttgagggtggctgtgcaagtcagactcctttccaccaggaaacacagaaaacattctatcttcccaaatgttactctctcagatttgcaccaagaccctagaagtttcttaaatttccatatactttatggacactacaaagcaattccaggaaacactgatacagtagcaaaactactgggagtggaaattggatggagatctgggtcccagttcagagtctgacacctgatttgcaacataattaggcacagggcactcaactattcagggccctaaacccttctattgaaagggaaatgggagaacaatatgtgttcctatggctcagtccctataagattctgtactattcagagttgattttaagtgtcacttaactgaaattatccaacaaaccttcatggcatgaaacattaacacagctctttttatatggcatggttcctatggctcaatccctataagattctgtactagttcagagttgattttaaaagtcacttaactgaaattatccaacaaaccctcgaggacattaaacattaacgtggctctttttatatggcatggttcattatcatgccaataaatgattaatcgtaactctctgtcttgaccaataattttgctggacttttgtgattcacaacgtgctctgtgttgtaatgctacctcttgaaactgacatcctagctttattgttttttattacttccctaaggtggctttcaaaagagacaccaagtgacatatttttaggaggggtttaaaagtttgatggggtagaagtaaacgttgcttaactcaaccagcagcagagccagggcccagggaccagcgcttctgtggacttggcctttccagcagcagacccagcaatgaatgatccgaacagctgtgtggacaatgcaacagtttgctctggtgcatcctgtgtggtacctgagagcaatttcaataacatcctaagtgtggtcctaagtacggtgctgaccatcctgttggccttggtgatgttctccatgggatgcaacgtggaaatcaagaaatttctagggcacataaagcggccgtggggcatttgtgttggcttcctctgtcagtttggaatcatgcccctcacaggattcatcctgtcggtggcctttgacatcctcccgctccaggccgtagtggtgctcattataggatgctgccctggaggaactgcctccaatatcttggcctattgggtcgatggcgacatggacctgagcgtcagcatgaccacatgctccacactgcttgccctcggaatgatgccgctgtgcctccttatctataccaaaatgtgggtcgactctgggagcatcgtaattccctatgataacataggtacatctctggttgctctcgttgttcctgtttccattggaatgtttgttaatcacaaatggccccaaaaagcaaagatcatacttaaaattgggtccatcgcgggcgccatcctcattgtgctcatagctgtggttggaggaatattgtaccaaagcgcctggatcattgctcccaaactgtggattataggaacaatatttcctgtggcgggttactccctggggtttcttctggctagaattgctggtctaccctggtacaggtgccgaacggttgcttttgaaacggggatgcagaacacgcagctatgttccaccatcgttcagctctccttcactcctgaggagctcaatgtcgtattcaccttcccgctcatctacagcattttccagctcgcctttgccgcaatattcttaggattttatgtggcatacaagaaatgtcatggaaaaaacaaggcagaaattccagagagcaaagaaaatggaacggagccagagtcatcgttttataaggcaaatggaggatttcaacctgacgaaaagtagacatcaagtggacaaaacagacgagttccaaattacgttcttaaaccgtaactatatttaattatttgttttggtaggacagttggcagaaaagagttaaagtgaaaattggaatttcattggaattcatgtattggtttcagtaccaagtgactggtggcccaattctttaatgggacaaatattgtttcctatatatatgtatatgttttatatatgtatgtatactcatatagatatattgtcattgaaatattcccccaaaatattctcagactaaacctgacatagggaacaccgagaatgaaaacatcgttaacaccaaaactgaattcttatgcagaatttcctagcccatagatgacaacctgagtttctgtatgttaaagtagatgtaatgaattattattattacagtggtcacgattttcttcagtgtttatgattataaaaattgacatgaacatctttcactgacattttaatcattattttaaaagctttgcaacctatatatttatataactttgtaatataacatgggcaaatatctgacttcagtatttttaaaaagttgccttctccagtggcagtccaaaagcagaaatgagaggaaattattacaaaatagaattcaataaccatattggatgcaggctcttaactcagcagggatatcgtacatctattgctctacctcaggggtccagtgatacccactagatcttccaaggaaaaacataattctttcaaacggtgtgtatttggcaaagagctcttcaaatctgggagagggacttcctcaaggttttcctgtgtgcagtggatccacatagctaatatgacagctagtcagttgacagggaccacccacagtaagcaccatggtcagggaggtggcaggaggtgcaaagacagaagtattgagagaaacaccaagactctagtggaggaattaattcaatgggagatagtataaaatacatagaaaacacaagtaacagaaacctggttgaaatgcttaactagagtcaattagatgtgcaggagtaagtagtataagaagaatcaagtccgagagtgatcaggaaatgagtattaaacagtatttgaaacagagaacgtgtcccagggcccaaaagtcagaagggccccaccagccaggaaagttgtttcaatgctgtaagtaggtgtagccaagggaagccaggactatctgatatacggtagcaggggtttacggctgccaggggaaaataactcatcaagtgttggactttcaattataagatcgaatttaatttcctttccctcattctgcagcaatcagaatacacaatcttaaccactcggtccttagtggttttgttccattttgcattgggtattttcactgcctcatagagtctatttcaagtgtttggctgaaagggctttttgcatttgcatgttctgagttcagattctgctggtgcacccaagcattatgggaacaggaactcaacttagctcttccagtagaggggtgagggattctgcttttcaaattcataacattgatctttttatgcaagatttccatttacagttgaataagtacttcatatttttccatcattagacaaatacaaaatggactaaataattttaagagatagtggaggagagggggtacagacttccttcttagagagtgtcagagaatatgctcccaatggtggaaaggaagatttacagtctagcggctaagtacctcctacacatttcccatcaatcagaaaatagacaggtacactaaagggaccctgagaactcctcttgtaatttcaacacacccaaaatcaagggcctggatgccagcagctgcagcaagcaggtttttcctccctgttgagcaagacaggtgagcaagataggacttggctttcttacatgatgcggtaacttgtgacttgagtctttttccctaatttgctagtgggaagaaaaatagctgagctttctaaaatgatagctctctatttttaaatgaatttgaaaagtcgattaaattatgtattttattgcctctgagtatcatattaaatgaatattttattttaaaggcttaaataaatgaaaatgatttttgtaa

SEQ ID NO: 116512 - DNA, 4120 bp, Homo sapiens
  misc_feature (4113)..(4113): n is a, c, g, or t
gtagttgagggtggctgtgcaagtcagactcctttccaccaggaaacacagaaaacattctatcttcccaaatgttactctctcagatttgcaccaagaccctagaagtttcttaaatttccatatactttatggacactacaaagcaattccaggaaacactgatacagtagcaaaactactgggagtggaaattggatggagatctgggtcccagttcagagtctgacacctgatttgcaacataattaggcacagggcactcaactattcagggccctaaacccttctattgaaagggaaatgggagaacaatatgtgttcctatggctcagtccctataagattctgtactattcagagttgattttaagtgtcacttaactgaaattatccaacaaaccttcatggcatgaaacattaacacagctctttttatatggcatggttcctatggctcaatccctataagattctgtactagttcagagttgattttaaaagtcacttaactgaaattatccaacaaaccctcgaggacattaaacattaacgtggctctttttatatggcatggttcattatcatgccaataaatgattaatcgtaactctctgtcttgaccaataattttgctggacttttgtgattcacaacgtgctctgtgttgtaatgctacctcttgaaactgacatcctagctttattgttttttattacttccctaaggtggctttcaaaagagacaccaagtgacatatttttaggaggggtttaaaagtttgatggggtagaagtaaacgttgcttaactcaaccagcagcagagccagggcccagggaccagcgcttctgtggacttggcctttccagcagcagacccagcaatgaatgatccgaacagctgtgtggacaatgcaacagtttgctctggtgcatcctgtgtggtacctgagagcaatttcaataacatcctaagtgtggtcctaagtacggtgctgaccatcctgttggccttggtgatgttctccatgggatgcaacgtggaaatcaagaaatttctagggcacataaagcggccgtggggcatttgtgttggcttcctctgtcagtttggaatcatgcccctcacaggattcatcctgtcggtggcctttgacatcctcccgctccaggccgtagtggtgctcattataggatgctgccctggaggaactgcctccaatatcttggcctattgggtcgatggcgacatggacctgagcgtcagcatgaccacatgctccacactgcttgccctcggaatgatgccgctgtgcctccttatctataccaaaatgtgggtcgactctgggagcatcgtaattccctatgataacataggtacatctctggttgctctcgttgttcctgtttccattggaatgtttgttaatcacaaatggccccaaaaagcaaagatcatacttaaaattgggtccatcgcgggcgccatcctcattgtgctcatagctgtggttggaggaatattgtaccaaagcgcctggatcattgctcccaaactgtggattataggaacaatatttcctgtggcgggttactccctggggtttcttctggctagaattgctggtctaccctggtacaggtgccgaacggttgcttttgaaacggggatgcagaacacgcagctatgttccaccatcgttcagctctccttcactcctgaggagctcaatgtcgtattcaccttcccgctcatctacagcattttccagctcgcctttgccgcaatattcttaggattttatgtggcatacaagaaatgtcatggaaaaaacaaggcagaaattccagagagcaaagaaaatggaacggagccagagtcatcgttttataaggcaaatggaggatttcaacctgacgaaaagtagacatcaagtggacaaaacagacgagttccaaattacgttcttaaaccgtaactatatttaattatttgttttggtaggacagttggcagaaaagagttaaagtgaaaattggaatttcattggaattcatgtattggtttcagtaccaagtgactggtggcccaattctttaatgggacaaatattgtttcctatatatatgtatatgttttatatatgtatgtatactcatatagatatattgtcattgaaatattcccccaaaatattctcagactaaacctgacatagggaacaccgagaatgaaaacatcgttaacaccaaaactgaattcttatgcagaatttcctagcccatagatgacaacctgagtttctgtatgttaaagtagatgtaatgaattattattattacagtggtcacgattttcttcagtgtttatgattataaaaattgacatgaacatctttcactgacattttaatcattattttaaaagctttgcaacctatatatttatataactttgtaatataacatgggcaaatatctgacttcagtatttttaaaaagttgccttctccagtggcagtccaaaagcagaaatgagaggaaattattacaaaatagaattcaataaccatattggatgcaggctcttaactcagcagggatatcgtacatctattgctctacctcaggggtccagtgatacccactagatcttccaaggaaaaacataattctttcaaacggtgtgtatttggcaaagagctcttcaaatctgggagagggacttcctcaaggttttcctgtgtgcagtggatccacatagctaatatgacagctagtcagttgacagggaccacccacagtaagcaccatggtcagggaggtggcaggaggtgcaaagacagaagtattgagagaaacaccaagactctagtggaggaattaattcaatgggagatagtataaaatacatagaaaacacaagtaacagaaacctggttgaaatgcttaactagagtcaattagatgtgcaggagtaagtagtataagaagaatcaagtccgagagtgatcaggaaatgagtattaaacagtatttgaaacagagaacgtgtcccagggcccaaaagtcagaagggccccaccagccaggaaagttgtttcaatgctgtaagtaggtgtagccaagggaagccaggactatctgatatacggtagcaggggtttacggctgccaggggaaaataactcatcaagtgttggactttcaattataagatcgaatttaatttcctttccctcattctgcagcaatcagaatacacaatcttaaccactcggtccttagtggttttgttccattttgcattgggtattttcactgcctcatagagtctatttcaagtgtttggctgaaagggctttttgcatttgcatgttctgagttcagattctgctggtgcacccaagcattatgggaacaggaactcaacttagctcttccagtagaggggtgagggattctgcttttcaaattcataacattgatctttttatgcaagatttccatttacagttgaataagtacttcatatttttccatcattagacaaatacaaaatggactaaataattttaagagatagtggaggagagggggtacagacttccttcttagagagtgtcagagaatatgctcccaatggtggaaaggaagatttacagtctagcggctaagtacctcctacacatttcccatcaatcagaaaatagacaggtacactaaagggaccctgagaactcctcttgtaatttcaacacacccaaaatcaagggcctggatgccagcagctgcagcaagcaggtttttcctccctgttgagcaagacaggtgagcaagataggacttggctttcttacatgatgcggtaacttgtgacttgagtctttttccctaatttgctagtgggaagaaaaatagctgagctttctaaaatgatagctctctatttttaaatgaatttgaaaagtcgattaaattatgtattttattgcctctgagtatcatattaaatgaatattttattttaaaaagacattaaataaaaatgaaaaatcgatattttagtacgcggcgcgcccacgcactcttcgctctccattaagtgnaagaatt

SEQ ID NO: 116513 - DNA, 438 bp, Homo sapiens
ctcccaggttcaagcgattctcttgcctcagcctcccaagtagctgagattacaggcgcctgctaccacatcctgctaatttttgtatttttagtagagacagggtttcaccatgttggccaggttggtctcgaactcctggacctcaggtgatcctcctgccttggccttccaaagtgctgggattacaggcttgagccaccgtgcctggccgttaaagaacttttgagccatatatcagcccgttctaggatctgagaagacagctgaggaaagagcatttgtggcctccaggaacacggtccagtggattagtagtgggctttggagtcccacaaatctgggttggaatcacagcttgcttacttcgtaggtatgttatcttgtgcaggttccttaaccacactaagtctcaagagcttcatccgtaaaataggg

SEQ ID NO: 116514 - DNA, 779 bp, Homo sapiens
caagatgtatacgttgaatatatatagctttatttgtctgacaatcatatctcactaaaaaagtaaataaatggatgtggctgtattccaataaaacttgatttatggacactgaaaaaaaatattcagttagactacaaaatgatgaaagaccatgtagtgagagtcgccgccttcaagccatctatgccaaagccatgttaaaccctccagcttctgcgaactcaccagctggctgcagccccctgagtgagctcaggctagaccagcagagaaattgcccagctgaccccaaaaatgtgagaaatagcaaattactgttttcagccactaagttttgggataatggataactgagacatctgataagtactataatgaaagtaaaaagtgatttggggataaagaagagttagaaattatttcctacccagaggatgcgtggtgatcttatagcagtaacgatttttaatgttttcccatttttttcttttttaggggtattttttatatggtttaattgcaaaaatttaaactgctaaaatttggcaagttctggcataggtaaacacctgtgaacctgttatcacaatcaagataataaatgcggggaggccagacacagtggctcatgcctgtaatcctagcagtttgggaggccaaggcaggtggattggctgagctcaggagttcgagatcagcctgggcaacacagtgaaaccctgtctctactaaaatacaaaaaattagccaggcatggtggtgcacgcctgtagtcc

SEQ ID NO: 116515 - DNA, 298 bp, Homo sapiens
tcttagtctgaagtttaagtagggactttaattgactactgactctaaactgtgcggctctaataaatctactaaaagtaatctaattttttaaagcaccatatgaatagacaatttaggaaagaaatgttaataggcctcaaggaacatgtttttgaagtgagccttgaaaatctgcaaaatgacgaggttgcattgtgcaaattgaagctattatgagaatgttcaggtcaaaaaaattacctgacaaattcacgcacaggatctcacaaggaacacaaatgtgttcgttggcttt

SEQ ID NO: 116516 - DNA, 386 bp, Homo sapiens
aggatctgggattttaacccagttgtgccttggtctgggtggtttcctttttccctcaccatcagagggatattttaaaatcacaaacagaacctggggagaggaggcccaatttgacatctttgaaccttgatggggccactttatagattcagatttacagggattgttgggtggggatttgcaacccaggagagccttttagtgcctttcatagagggacacagaatcagagtttcctgaaatggcgtttttctgtgtgagacctgtcaatagaaatatcaaactgtgaatatacaattgaactttattatcccctttgattttgtaactacataggtatgacagacagaagctgattttaaaagaatctcacaattgccagt

SEQ ID NO: 116517 - DNA, 197 bp, Homo sapiens
aggtcctggatttcactgaaccagaacttgatgggtggttttggtattctgtgacctaggtagtggggagctccttcctttggatgtttcctttatgcccacagtcgaaccatatcctagttgtacagccaagaaggatcttttctgtttaatctatctggaggaatagaaggtccaggtatgccagaaggtccagg

SEQ ID NO: 116518 - DNA, 249 bp, Homo sapiens
actgtctcatcaaacaaagtattcggcagaatcccaataaactaaactgacaaaaagcaccatctgggctgcaacaggcctaggctgtctagggacagcaaacaatttggtcccctttgtcccacagcaggggctgaggctcttctgcacgaccacaaaagactgccaccacgctgaccaaagaacatgaggagaagctaaattagactcttaaccagcactggtttataagcacttctgagacagcat

SEQ ID NO: 116519 - DNA, 6319 bp, Homo sapiens
ggttgttgcgggatctcacaggctttaaaccgcggcgccgcggcgcccgggtgtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactggtctgtagggtaactccccactgttgatcctctgagatgattgtggactgggtgctgtgagtcctgccactttgtttaagtgaatgtgtcttttgtccagctcagccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggaggtgacccttgcccttttccacccttcgccagtccactgtgaaaagctgggttgattgtgcgggttagatagaggtcatcagccgggttgattgtgtgggttagacagaggtcatcagccaggttgattgtgtgggttagatagagatcatcagcctggtagattgtgtgggttagatagaggtcatcagccaggttgattgtgcgggttagatagagatcatcagccgggttgattctacaggttagatagaggtcgtcagccgggttgattgtgcgggttagatagagatcatcagccgggttgattgtgcgggttagatagaggtcatcagctgggttgattgtgtgggttagatagagatcatcagctgggttgattgtgtgggttagatagaggtcgtcagctgggttgattgtgtgggttagatagaggtcatcagctgggttgattgtatgggttagatagaggtcatcagctgggttgattgtacgggttagatagaggtcgtcagccgggttgattccgcaggttagatagaggtcgttagctgggtgtgtgggtcccaaggcgtgctgcagatggagaatcagaattccttgggcatcaccgggcggggcatgtccctgtcccttcgctcccagacccaggctagccgctaccaggactcctatcgagagctcttcagacactttgtcagaacccttaaaggtgggtgacgttttcaggaggaacctgggatgtcctgatgctcaatgggtagatgccttccaggctgcagtcagtgcagatgatatgccaatttcaggtggaaaattgcattccagataccgggttcagatttgaaattgtccatctcagtgatcatttacgttgcgtgtacttgagggagattctgagagatgctcctttggggttctgtgcgtgtaccatgttgcctgacacgtcctgagaaatcttcttaaactctgagtttataaaataactacttctgaactcctgagatctagtggataccatgtatcctggaagataggacactttctaccctctgtcagtcctgggggtgactgggaaccagagaggttgagcagaattcctggacctgggtggggcttgtccaagaggggcaggtgggcctctctaggatcagtgtcccacccagaggccagtggccccttcacatgccccaacaagaggaagactgtctggctccgcagtgttgggttttgtcctgaatctgtgcaaatgtgcagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccacggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggcttggcatggcacctcacctgtgggggaactcggcggagcttcctggcggcatctccccctcttgccttggtcctttctatctttgttttaggccaatttctaaaaagactgaggcctccttcaaggttgaacagatttctagagccttgtttttgctgtgacaagtccctagtccctgttcacaactctgaaaccaagaaacctgagaaccaagagaactgaaatgaagcccgttggtctcagcctggcttgagccaacatgaggctctctgctgccttttgttttcttaggttttgctgagaaacgggagtgcgttctgtgtcggtgtttgtgacgccctgagaccctgcttggcctagctaaagtccagaaggcctgggccccacagggcttggatgagggctcatgggcctgtacttcaggaggcctgagaggcccggtcagtcccatgaggctactcggcttggcccgcaggtcctccgaggcacagggcagagggacaccccagggacccatcagactcacgacacagagaaactcaagtggggtgccagggccggccacagaggccacgggcttcctgcctgtgacgagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggtaacagaggagtggatgtttgtgcgttggagacactgactgttctgagtgacaagtggctctgtgccaggatactgcgggtcgggctcctgggtacagcaagggcttcccagcagcccaggcctggtgggaacgctgggggaatgggggagagtcgctgtttctgaccagagcgacttggacagatgtgagctgacctgcctggcgagctccttctgccttgcctctctgagcagactcaggaccactgcctgtcccccttggccccaggagtgccagcagcctccctccaacccctgcactgctgggaaaaccatccgccttcaagatttatttgttgatttgtttagttttataaaaacatatcacttaaagga

SEQ ID NO: 116520 - DNA, 5762 bp, Homo sapiens
ggttgttgcgggatctcacaggctttaaaccgcggcgccgcggcgcccgggtgtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactggtctgtagggtaactccccactgttgatcctctgagatgattgtggactgggtgctgtgagtcctgccactttgtttaagtgaatgtgtcttttgtccagctcagccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggaggtgacccttgcccttttccacccttcgccagtccactgtgaaaagctgggttgattgtgcgggttagatagaggtcatcagccgggttgattgtgtgggttagacagaggtcatcagccaggttgattgtgtgggttagatagagatcatcagcctggtagattgtgtgggttagatagaggtcatcagccaggttgattgtgcgggttagatagagatcatcagccgggttgattctacaggttagatagaggtcgtcagccgggttgattgtgcgggttagatagagatcatcagccgggttgattgtgcgggttagatagaggtcatcagctgggttgattgtgtgggttagatagagatcatcagctgggttgattgtgtgggttagatagaggtcgtcagctgggttgattgtgtgggttagatagaggtcatcagctgggttgattgtatgggttagatagaggtcatcagctgggttgattgtacgggttagatagaggtcgtcagccgggttgattccgcaggttagatagaggtcgttagctgggtgtgtgggtcccaaggcgtgctgcagatggagaatcagaattccttgggcatcaccgggcggggcatgtccctgtcccttcgctcccagacccaggctagccgctaccaggactcctatcgagagctcttcagacactttgtcagaacccttaaaggtgggtgacgttttcaggaggaacctgggatgtcctgatgctcaatgggtagatgccttccaggctgcagtcagtgcagatgatatgccaatttcaggtggaaaattgcattccagataccgggttcagatttgaaattgtccatctcagtgatcatttacgttgcgtgtacttgagggagattctgagagatgctcctttggggttctgtgcgtgtaccatgttgcctgacacgtcctgagaaatcttcttaaactctgagtttataaaataactacttctgaactcctgagatctagtggataccatgtatcctggaagataggacactttctaccctctgtcagtcctgggggtgactgggaaccagagaggttgagcagaattcctggacctgggtggggcttgtccaagaggggcaggtgggcctctctaggatcagtgtcccacccagaggccagtggccccttcacatgccccaacaagaggaagactgtctggctccgcagtgttgggttttgtcctgaatctgtgcaaatgtgcagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccacggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccaggggccggccacagaggccacgggcttcctgcctgtgacgagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggtaacagaggagtggatgtttgtgcgttggagacactgactgttctgagtgacaagtggctctgtgccaggatactgcgggtcgggctcctgggtacagcaagggcttcccagcagcccaggcctggtgggaacgctgggggaatgggggagagtcgctgtttctgaccagagcgacttggacagatgtgagctgacctgcctggcgagctccttctgccttgcctctctgagcagactcaggaccactgcctgtcccccttggccccaggagtgccagcagcctccctccaacccctgcactgctgggaaaaccatccgccttcaagatttatttgttgatttgtttagttttataaaaacatatcacttaaagga

SEQ ID NO: 116521 - DNA, 5064 bp, Homo sapiens
ggttgttgcgggatctcacaggctttaaaccgcggcgccgcggcgcccgggtgtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactggtctgtagggtaactccccactgttgatcctctgagatgattgtggactgggtgctgtgagtcctgccactttgtttaagtgaatgtgtcttttgtccagctcagccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccacggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggcttggcatggcacctcacctgtgggggaactcggcggagcttcctggcggcatctccccctcttgccttggtcctttctatctttgttttaggccaatttctaaaaagactgaggcctccttcaaggttgaacagatttctagagccttgtttttgctgtgacaagtccctagtccctgttcacaactctgaaaccaagaaacctgagaaccaagagaactgaaatgaagcccgttggtctcagcctggcttgagccaacatgaggctctctgctgccttttgttttcttaggttttgctgagaaacgggagtgcgttctgtgtcggtgtttgtgacgccctgagaccctgcttggcctagctaaagtccagaaggcctgggccccacagggcttggatgagggctcatgggcctgtacttcaggaggcctgagaggcccggtcagtcccatgaggctactcggcttggcccgcaggtcctccgaggcacagggcagagggacaccccagggacccatcagactcacgacacagagaaactcaagtggggtgccagggccggccacagaggccacgggcttcctgcctgtgacgagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggtaacagaggagtggatgtttgtgcgttggagacactgactgttctgagtgacaagtggctctgtgccaggatactgcgggtcgggctcctgggtacagcaagggcttcccagcagcccaggcctggtgggaacgctgggggaatgggggagagtcgctgtttctgaccagagcgacttggacagatgtgagctgacctgcctggcgagctccttctgccttgcctctctgagcagactcaggaccactgcctgtcccccttggccccaggagtgccagcagcctccctccaacccctgcactgctgggaaaaccatccgccttcaagatttatttgttgatttgtttagttttataaaaacatatcacttaaagga

SEQ ID NO: 116522 - DNA, 4405 bp, Homo sapiens
ggttgttgcgggatctcacaggctttaaaccgcggcgccgcggcgcccgggtgtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactggtctgtagggtaactccccactgttgatcctctgagatgattgtggactgggtgctgtgagtcctgccactttgtttaagtgaatgtgtcttttgtccagctcagccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccacggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggcttggcatggcacctcacctgtgggggaactcggcggagcttcctggcggcatctccccctcttgccttggtcctttctatctttgttttaggccaatttctaaaaagactgaggcctccttcaaggttgaacagatttctagagccttgtttttgctgtgacaagtccctagtccctgttcacaactctgaaaccaagaaacctgagaaccaagagaactgaaatgaagcccgttggtctcagcctggcttgagccaacatgaggctctctgctgccttttgttttcttaggttttgctgagaaacgggagtgcgttctgtgtcggtgtttgtgacgccctgagaccctgcttggcctagctaaagtccagaaggcctgggccccacagggcttggatgagggctcatgggcctgtacttcaggaggcctgagaggcccggtcagtcccatgaggctactcggcttggcccgcaggtcctccgaggcacagggcagagggacaccccagggacccatcagactcacgacacagagaaactcaagtggggtgccagggccggccacagaggccacgggcttcctgcctgtgacgagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggtaacagaggagtggatgtttgtgcgttggagacactgactgttctgagtgacaagtggctctgtgccaggatactgcgggtcgggctcctgggtacagcaagggcttcccagcagcccaggcctggtgggaacgctgggggaatgggggagagtcgctgtttctgaccagagcgacttggacagatgtgagctgacctgcctggcgagctccttctgccttgcctctctgagcagactcaggaccactgcctgtcccccttggccccaggagtgccagcagcctccctccaacccctgcactgctgggaaaaccatccgccttcaagatttatttgttgatttgtttagttttataaaaacatatcacttaaagga

SEQ ID NO: 116523 - DNA, 1874 bp, Homo sapiens
ccatattgtgttcggagcacaatgagtgaaaggaatccacatcggaaagtacacgcaggaaaagataaatggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggcttggcatggcacctcacctgtgggggaactcggcggagcttcctggcggcatctccccctcttgccttggtcctttctatctttgttttaggccaatttctaaaaagactgaggcctccttcaaggttgaacagatttctagagccttgtttttgctgtgacaagtccctagtccctgttcacaactctgaaaccaagaaacctgagaaccaagagaactgaaatgaagcccgttggtctcagcctggcttgagccaacatgaggctctctgctgccttttgttttcttaggttttgctgagaaacgggagtgcgttctgtgtcggtgtttgtgacgccctgagaccctgcttggcctagctaaagtccagaaggcctgggccccacagggcttggatgagggctcatgggcctgtacttcaggaggcctgagaggcccggtcagtcccatgaggctactcggcttggcccgcaggtcctccgaggcacagggcagagggacaccccagggacccatcagactcacgacacagagaaactcaagtggggtgccagggccggccacagaggccacgggcttcctgcctgtgacgagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggtaacagaggagtggatgtttgtgcgttggagacactgactgttctgagtgacaagtggctctgtgccaggatactgcgggtcgggctcctgggtacagcaagggcttcccagcagcccaggcctggtgggaacgctgggggaatgggggagagtcgctgtttctgaccagagcgacttggacagatgtgagctgacctgcctggcgagctccttctgccttgcctctctgagcagactcaggaccactgcctgtcccccttggccccaggagtgccagcagcctccctccaacccctgcactgctgggaaaaccatccgccttcaagatttatttgttgatttgtttagttttataaaaacatatcacttaaagga

SEQ ID NO: 116524 - DNA, 400 bp, Homo sapiens
acattccactttactcctgcagcgtctctggagtagttgtttgctgcccgccggaggcagcttctgaaatcgtgagggatgctctccgagcagctatgggctgggctggctgaggtgatgtctgcacctgtgcccaggtgtctcagggagaatgggcttcggggaataggcttgcctgcttcatctcctgactcctttgctaggcactttgatccggttttccagttcttgcacaagcaagtttgtgtcagccacgccctggggaggatccactggatcaccgccgtcactgcctgttcccggcggcctctccggcttccctaaagagagcaggtgggcatctgcgtttttgggggaatgcacagcgttgtggcatctgtgtccatgtcacgtggttccc

SEQ ID NO: 116525 - DNA, 6409 bp, Homo sapiens
  misc_feature (2634)..(2634): n is a, c, g, or t
ggttgttgcgggatctcacaggctttaaaccgcggcgccgcggcgcccgggtgtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactggtctgtagggtaactccccactgttgatcctctgagatgattgtggactgggtgctgtgagtcctgccactttgtttaagtgaatgtgtcttttgtccagctcagccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggaggtgacccttgcccttttccacccttcgccagtccactgtgaaaagctgggttgattgtgcgggttagatagaggtcatcagccgggttgattgtgtgggttagacagaggtcatcagccaggttgattgtgtgggttagatagagatcatcagcctggtagattgtgtgggttagatagaggtcatcagccaggttgattgtgcgggttagatagagatcatcagccgggttgattctacaggttagatagaggtcgtcagccgggttgattgtgcgggttagatagagatcatcagccgggttgattgtgcgggttagatagaggtcatcagctgggttgattgtgtgggttagatagagatcatcagctgggttgattgtgtgggttagatagaggtcgtcagctgggttgattgtgcgggttagatagaggtcatcagccgggttgattctacaggttagatagaggtcntcagctgggttgattgtgcgggttagagatcatcagccgggttgattgtgcgggttagatagaggtcatcagccgggttgattgtgcgggttagatagagatcatcagctgggttgattctgcaggttagatagaggtcatcagctgggttgactatgtgggttagatagaggtcgtcagccgggttgattgtgtgggttagacagaggtcatcagctgggttgattctgcgggttagatagaggtcatcagctgggttgattgtgtgggttagatagagatcatcagctgggttgattgtgtgggttagatagaggtcatcagctgggttgattgtgtgggttagatagaggtcatcagctgggttgattgtgtgggttagatagaggtcatcagctgggttgattgtgtgggttagatagaggtcatcagctgggttgattgtatgggttagatagaggtcatcagctgggttgattgtacgggttagatagaggtcgtcagccgggttgattccgcaggttagatagaggtcgttagctgggtgtgtgggtcccaaggcgtgctgcagatggagaatcagaattccttgggcatcaccgggcggggcatgtccctgtcccttcgctcccagacccaggctagccgctaccaggactcctatcgagagctcttcagacactttgtcagaacccttaaaggtgggtgacgttttcaggaggaacctgggatgtcctgatgctcaatgggtagatgccttccaggctgcagtcagtgcagatgatatgccaatttcaggtggaaaattgcattccagataccgggttcagatttgaaattgtccatctcagtgatcatttacgttgcgtgtacttgagggagattctgagagatgctcctttggggttctgtgcgtgtaccatgttgcctgacacgtcctgagaaatcttcttaaactctgagtttataaaataactacttctgaactcctgagatctagtggataccatgtatcctggaagataggacactttctaccctctgtcagtcctgggggtgactgggaaccagagaggttgagcagaattcctggacctgggtggggcttgtccaagaggggcaggtgggcctctctaggatcagtgtcccacccagaggccagtggccccttcacatgccccaacaagaggaagactgtctggctccgcagtgttgggttttgtcctgaatctgtgcaaatgtgcagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccacggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggcttggcatggcacctcacctgtgggggaactcggcggagcttcctggcggcatctccccctcttgccttggtcctttctatctttgttttaggccaatttctaaaaagactgaggcctccttcaaggttgaacagatttctagagccttgtttttgctgtgacaagtccctagtccctgttcacaactctgaaaccaagaaacctgagaaccaagagaactgaaatgaagcccgttggtctcagcctggcttgagccaacatgaggctctctgctgccttttgttttcttaggttttgctgagaaacgggagtgcgttctgtgtcggtgtttgtgacgccctgagaccctgcttggcctagctaaagtccagaaggcctgggccccacagggcttggatgagggctcatgggcctgtacttcaggaggcctgagaggcccggtcagtcccatgaggctactcggcttggcccgcaggtcctccgaggcacagggcagagggacaccccagggacccatcagactcacgacacagagaaactcaagtggggtgccagggccggccacagaggccacgggcttcctgcctgtgacgagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggta

SEQ ID NO: 116526 - DNA, 6772 bp, Homo sapiens
ggttgttgcgggatctcacaggctttaaaccgcggcgccgcggcgcccgggtgtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactggtctgtagggtaactccccactgttgatcctctgagatgattgtggactgggtgctgtgagtcctgccactttgtttaagtgaatgtgtcttttgtccagctcagccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggaggtgacccttgcccttttccacccttcgccagtccactgtgaaaagctgggttgattgtgcgggttagatagaggtcatcagccgggttgattgtgtgggttagacagaggtcatcagccaggttgattgtgtgggttagatagagatcatcagcctggtagattgtgtgggttagatagaggtcatcagccaggttgattgtgcgggttagatagagatcatcagccgggttgattctacaggttagatagaggtcgtcagccgggttgattgtgcgggttagatagagatcatcagccgggttgattgtgcgggttagatagaggtcatcagctgggttgattgtgtgggttagatagagatcatcagctgggttgattgtgtgggttagatagaggtcgtcagctgggttgattgtgtgggttagatagaggtcatcagctgggttgattgtatgggttagatagaggtcatcagctgggttgattgtacgggttagatagaggtcgtcagccgggttgattccgcaggttagatagaggtcgttagctgggtgtgtgggtcccaaggcgtgctgcagatggagaatcagaattccttgggcatcaccgggcggggcatgtccctgtcccttcgctcccagacccaggctagccgctaccaggactcctatcgagagctcttcagacactttgtcagaacccttaaaggtgggtgacgttttcaggaggaacctgggatgtcctgatgctcaatgggtagatgccttccaggctgcagtcagtgcagatgatatgccaatttcaggtggaaaattgcattccagataccgggttcagatttgaaattgtccatctcagtgatcatttacgttgcgtgtacttgagggagattctgagagatgctcctttggggttctgtgcgtgtaccatgttgcctgacacgtcctgagaaatcttcttaaactctgagtttataaaataactacttctgaactcctgagatctagtggataccatgtatcctggaagataggacactttctaccctctgtcagtcctgggggtgactgggaaccagagaggttgagcagaattcctggacctgggtggggcttgtccaagaggggcaggtgggcctctctaggatcagtgtcccacccagaggccagtggccccttcacatgccccaacaagaggaagactgtctggctccgcagtgttgggttttgtcctgaatctgtgcaaatgtgcagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccacggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggcttggcatggcacctcacctgtgggggaactcggcggagcttcctggcggcatctccccctcttgccttggtcctttctatctttgttttaggccaatttctaaaaagactgaggcctccttcaaggttgaacagatttctagagccttgtttttgctgtgacaagtccctagtccctgttcacaactctgaaaccaagaaacctgagaaccaagagaactgaaatgaagcccgttggtctcagcctggcttgagccaacatgaggctctctgctgccttttgttttcttaggttttgctgagaaacgggagtgcgttctgtgtcggtgtttgtgacgccctgagaccctgcttggcctagctaaagtccagaaggcctgggccccacagggcttggatgagggctcatgggcctgtacttcaggaggcctgagaggcccggtcagtcccatgaggctactcggcttggcccgcaggtcctccgaggcacagggcagagggacaccccagggacccatcagactcacgacacagagaaactcaagtggggtgccagggccggccacagaggccacgggcttcctgcctgtgacgagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggtaacagaggagtggatgtttgtgcgttggagacactgactgttctgagtgacaagtggctctgtgccaggatactgcgggtcgggctcctgggtacagcaagggcttcccagcagcccaggcctggtgggaacgctgggggaatgggggagagtcgctgtttctgaccagagcgacttggacagatgtgagctgacctgcctggcgagctccttctgccttgcctctctgagcagactcaggaccactgcctgtcccccttggccccaggagtgccagcagcctccctccaacccctgcactgctgggaaaaccatccgccttcaagatttatttgttgatttgtttagttttataaaaacatatcacttaaaggattcttgttcctgggaatttgcattttctcctgaccacggcgaagtctcaactctgtctactttcacagctgcttctccagtgcaaggaggctgcatgggctccctagacaggtgcagctggggccatctggctgctccgtgttctggccggcttccttggacatctggctggggttccagtgacagctgcccctgggcctctcccagcccccccagcccccccagcccttcccaggagcacactacaggggctcttgggacagcctcactggactcagggtggacaggtaacgtacctaagaaacaaatcaacaagccctctggaactgaagcacatctgcgctgggctgaggaaccccgggtgtcaggatgggcccccgcggctcctgaagtggaacatgggggaagagtgggggcttcaggaggtggcctcgggtagcaggtgcccagccc

SEQ ID NO: 116527 - DNA, 5712 bp, Homo sapiens
ggttgttgcgggatctcacaggctttaaaccgcggcgccgcggcgcccgggtgtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactggtctgtagggtaactccccactgttgatcctctgagatgattgtggactgggtgctgtgagtcctgccactttgtttaagtgaatgtgtcttttgtccagctcagccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggaggtgacccttgcccttttccacccttcgccagtccactgtgaaaagctgggttgattgtgcgggttagatagaggtcatcagccgggttgattgtgtgggttagacagaggtcatcagccaggttgattgtgtgggttagatagagatcatcagcctggtagattgtgtgggttagatagaggtcatcagccaggttgattgtgcgggttagatagagatcatcagccgggttgattctacaggttagatagaggtcgtcagccgggttgattgtgcgggttagatagagatcatcagccgggttgattgtgcgggttagatagaggtcatcagctgggttgattgtgtgggttagatagagatcatcagctgggttgattgtgtgggttagatagaggtcgtcagctgggttgattgtgtgggttagatagaggtcatcagctgggttgattgtatgggttagatagaggtcatcagctgggttgattgtacgggttagatagaggtcgtcagccgggttgattccgcaggttagatagaggtcgttagctgggtgtgtgggtcccaaggcgtgctgcagatggagaatcagaattccttgggcatcaccgggcggggcatgtccctgtcccttcgctcccagacccaggctagccgctaccaggactcctatcgagagctcttcagacactttgtcagaacccttaaaggtgggtgacgttttcaggaggaacctgggatgtcctgatgctcaatgggtagatgccttccaggctgcagtcagtgcagatgatatgccaatttcaggtggaaaattgcattccagataccgggttcagatttgaaattgtccatctcagtgatcatttacgttgcgtgtacttgagggagattctgagagatgctcctttggggttctgtgcgtgtaccatgttgcctgacacgtcctgagaaatcttcttaaactctgagtttataaaataactacttctgaactcctgagatctagtggataccatgtatcctggaagataggacactttctaccctctgtcagtcctgggggtgactgggaaccagagaggttgagcagaattcctggacctgggtggggcttgtccaagaggggcaggtgggcctctctaggatcagtgtcccacccagaggccagtggccccttcacatgccccaacaagaggaagactgtctggctccgcagtgttgggttttgtcctgaatctgtgcaaatgtgcagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccacggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggcttggcatggcacctcacctgtgggggaactcggcggagcttcctggcggcatctccccctcttgccttggtcctttctatctttgttttaggccaatttctaaaaagactgaggcctccttcaaggttgaacagatttctagagccttgtttttgctgtgacaagtccctagtccctgttcacaactctgaaaccaagaaacctgagaaccaagagaactgaaatgaagcccgttggtctcagcctggcttgagccaacatgaggctctctgctgccttttgttttcttaggttttgctgagaaactcaagtggggtgccagggccggccacagaggccacgggcttcctgcctgtgacgagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggta

SEQ ID NO: 116528 - DNA, 4959 bp, Homo sapiens
ggttgttgcgggatctcacaggctttaaaccgcggcgccgcggcgcccgggtgtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactgccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccacggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggcttggcatggcacctcacctgtgggggaactcggcggagcttcctggcggcatctccccctcttgccttggtcctttctatctttgttttaggccaatttctaaaaagactgaggcctccttcaaggttgaacagatttctagagccttgtttttgctgtgacaagtccctagtccctgttcacaactctgaaaccaagaaacctgagaaccaagagaactgaaatgaagcccgttggtctcagcctggcttgagccaacatgaggctctctgctgccttttgttttcttaggttttgctgagaaacgggagtgcgttctgtgtcggtgtttgtgacgccctgagaccctgcttggcctagctaaagtccagaaggcctgggccccacagggcttggatgagggctcatgggcctgtacttcaggaggcctgagaggcccggtcagtcccatgaggctactcggcttggcccgcaggtcctccgaggcacagggcagagggacaccccagggacccatcagactcacgacacagagaaactcaagtggggtgccagggccggccacagaggccacgggcttcctgcctgtgacgagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggtaacagaggagtggatgtttgtgcgttggagacactgactgttctgagtgacaagtggctctgtgccaggatactgcgggtcgggctcctgggtacagcaagggcttcccagcagcccaggcctggtgggaacgctgggggaatgggggagagtcgctgtttctgaccagagcgacttggacagatgtgagctgacctgcctggcgagctccttctgccttgcctctctgagcagactcaggaccactgcctgtcccccttggccccaggagtgccagcagcctccctccaacccctgcactgctgggaaaaccatccgccttcaagatttatttgttgatttgtttagttttataaaaacatatcacttaaagga

SEQ ID NO: 116529 - DNA, 462 bp, Homo sapiens
ataccaaagaacatgattgctggaatgtatgttaagagtatgtttacttatgtaagaaactgccaaactatcttccaaagtggatatatcattttgcattctcaccagtaatgaatgggggtttctgttgctctatctcctagctagcatttgctgttgccagtgttttggattttcaccattctaatagatttgtagtgataacttattgttttaatttgcaattccctaaagaaatatgatgttgaacatcttttcataagcttatttgtcatttgtatatcttttttggtgaggtatctgttcagatcttttgccaattttttctttttttttaattttcaagtcctcatatctcagatgattttgccaatttatttttattttttatttttttgagatggagtcttgctctgttgcccaggctggagtgcagtggcacaatcttggctcactgcaacc

SEQ ID NO: 116530 - DNA, 301 bp, Homo sapiens
gtccgcctctgtgctgaggcagttcctgctccctgagtctctgtcctttcctgggaaaggtggaagcagttcatggtctttccctttcagaggaggaggggatggaggggattgtattagcaactgggattgaagctccccctggcagttatggggtgcccttgggagggctgctttaggggggctttctgagaagaggcaggtcgggctgtacctgagaccaatccccttgataaaatgcagccaggcctgaagcacgttcagaacggaagcagcaaaggtgatgatatcgctcgttgct

SEQ ID NO: 116531 - DNA, 573 bp, Homo sapiens
gagcccgagtgcccggtctgccacaccgcggtcactcaggccatccgcatcttttcttaaaggcagcgggcgctgctagtgcgcaccgtgctgggggaagggggaacccctccccatcctctttccccagcgctcgcctgcctccctgggtgccccccctctcccttctccttcccggccccaccaacactctgagatccgagaggagcttggaaagctgtagtatccgctcatttttaaaatttaatttttaagtaaaggaatttgccaggatatctgcatcaagagtactgtagcctgggaaacctgaacacctgaaatgcatgctctataaataataggaacggcgacattctagtaatgatagtttttacactgtacttaataggaagcttccaaaagaagaaaaccccacaagttttccattttcttaaagtaggaaaaaatgaacagtaataattatgatgaagatgatagtagtgctatgggatgtgtggactgtttagtgtgttcccctttgtgggtgggttcctatgatacttattatagaacacagtggatcctttttgaatg

SEQ ID NO: 116532 - DNA, 376 bp, Homo sapiens
tatactttaagttttagggtacatgtgcacattgtgcaggttagttacatacgtatacatgtgccatgctggtgtgctgcacccactaactcgtcatctagcattaggtatatctcccaatcctatccctcccccctcccccccccccacaacagtccccagagtgtgatgttccccttcctgtgtccatgtgatctcattgttcaattcccacctatgagtgagaatatgcggtgtttggttttttgttcttgcgatagtttacagagaatgatggtttaacttcttttctaaagtgattttgggcaagtactaagcttctctacctcagcttcattatctggtaaattggcataataaaatcttgagattttac

SEQ ID NO: 116533 - DNA, 908 bp, Homo sapiens
agtgagcagttgacccctgaacaacatggaggttggggcactgaccacaggtgcagatgaaaacctgtgtagaagttttgcatttctaacttaagtactaatagcttacttttgactggaagccttagtgataaaataaatagttgattacacttttttacattttatatatattttatactctattcttccaataaagtatggtaaagaaaaaaatgttcttaagaaaaccataaaaatgagaaaatatatttactactgattaagtacttgctttcaggtgacacagaagaaaatataagtgtatctgcaaacttcaaacccaagttattcaagggttaactgtaccatgatgaatgtagcagtccccatctgtagtctagggctttctcctttgctgtacctctgctcacttccaatggccatatatatgtcttatgttctttatgatcttgggcagagaggtctgcctacatgcattgctggccagatgtcctggaatgtgtatctctgaggaaagtgctatggtttgactgtgtcctccaaaatccatctgttgtaaagttcattctcagtgaaatggtttttgccaggtgggccctattgggatgtgtttaggtcatgagggtggagccctctagtggaatacattaatgccagtataaacagggtttatagggctggaatctttctctctcttctgctggtctgtcctgataagacatggccttccttccattgaaggactcaatgccccaggcatcgtcttgaaagcagagaaagctgaccttaacctgcccatgccttgatctcaaactttccgtactccagaagtgtgagaaaatatatttctgttttttatgaattacacagcgacaaggaacctgttatagcagcttgaaagagaa

SEQ ID NO: 116534 - DNA, 491 bp, Homo sapiens
agttctcatcttaaagaggaggaaacaaacttaaagagtctgttagttcctttattcaacattgtgtactatatgctgggtgcgtactgctgtactgatcaaagtcataaaaaagactgaggcctcctcaagaaaattatgctctaaaaaaggaaatagagactcctctctcaagaatcttggctgtgaaaggaggtagttactataatgcagaagacaggaaaaagacattttccttctctgagaccagagggaaggagtcgagaatgaataaagatgcagattaaataatataattgaaagggaagaatgctgaatgaacttcgaactttcacctaattacattccttttcacactgatgtagtagttaggtttcttgaagtaagagcaatttgagaattctctcaagagatagcttaaggacaatgattaaagtttggaatagctcaggcaagaaaggggagaggaagctgaccagggacataaagga

SEQ ID NO: 116535 - DNA, 625 bp, Homo sapiens
ttaaagtatttgtttattataaatactgtggcagttaacatctatgcctgtaatactttatagtaccataacagtgatgttgttatggtgtagtacagtaggtgtatttacactgatatcagttacagcctggtgtaattacagttatgatgtaatgcctttagagagaggttggacagttcagttgctgtcccaaacctggctgagaagattacaaaagatttaaaatatttctactggtctttattattgaatgactacaccctctgaaaagtatgaattgagcattatgattgctcataggtaaaaggttagcaggcatttaatatgtgctaggtattttcttgtgtattctctcatttgagtcttataataatctcataaagaatgtgctgctattcactgtttatctggaactaagactgagaaagactgtggcttgcataaagtgacacagcttctaagaagccagttcaagatttgaaccctcatctgatgatcagtttgttttttctttccccattttctgaagctggttcattctcttaagaactgtaaggagaaaaatgatagaaggcagaatatctttgaactaatgaaatcatcgcatgagcagagaagcaga

SEQ ID NO: 116536 - DNA, 691 bp, Homo sapiens
gtccttattctctagcctagggtgagaaaaattccagtctttatccttaccttgttaaacattgctagagtcaccatggtatttgcttcaacacctaggacacaatatctgaatccttctcaacattataatggatccaaatgagaatgaaacctatttcatgaaacctatttgccaactcagattgtttatagagttcttgatttttatttgcttgcttcaaaacataaatttgaaatgttgtttacaaatctgagttttttgtttgtttttactaaatttcagagcagttttattatgaaaagcataaaaaagatatggtttctatagccagaaatagggtctaattctaagatgagttttgccagtgaattaatactattttgaatgcctttcactttatattcaaaagcagatgagtaaagcttcctgtcacagatactttaagatgttaaaatgattgtgcagcaataatagcacagtaatggaaacttaatttttcgaggctgttattagcacaaagtcatgagttctttagcatctctaccaggacattaggaagctaagtttttagggagggcttggtgcatgggaagctgatacttcactaattttaaaagaagaattgaaacaagattaggagagtctttaccatgtgccagttacttacctaagtattttatatttacta

SEQ ID NO: 116537 - DNA, 291 bp, Homo sapiens
ggtgagactaaactgcatggccagggacacctccccgagaaagggacacccagtcaaggcctgcaggaggagctgggagaacattctagacagaggacactcttctttccaagattctcaattcacctggcagggtggggagcatgaagttccctggggtctccaaatggtattattatcacactgagcacacagcaagtgccaaaaaaacacgttccgcagggtgatttttcaaaccggaggtcccagttgctgagagtacaatacgggctgtttgaacgttcagcattc

SEQ ID NO: 116538 - DNA, 724 bp, Homo sapiens
ccgttgcgacttgtaataatggcgctttgtggtttaacgagaacagggctctattaatccctctttgtctgacctcagccaacctcgccctcagtggaagcaggattcttaggcccttgggaccctattgagctgttgtcatagtgattggtgccaggggcagggtcactgggccagtgtccctaaccagaccatctctgtcttaatgacacccgtagatcacagttgttcattcccaagcgtggcaagaaaagggactaacaggctacaaggccagcatttggtccgactgcacagaggctgggctgttgaagctttctgaggcctggcattactctccccaggaaggaagcttaactgatttggccaaagagcccccaggggtccccctgggaccactctcaggcccctgagggctcgcatctggaatcagctctcactgctgtaactaaggctcacaaggaacgcaggcagacaggctgcctgtgacttcacagagtggaacttcttgtcacttgatggcagggctgaatgaaccttggagattatcaggcctgtctccctggggaacagatggggaaactgaggcacaggagctggacctgatgctggcatatcaagggcacagtgctaatcaggcagtccctccctacctcccacctccaaagaagaacatgtttggagtctcttgtaaaacaattgttatttttactgtagcttttaa

SEQ ID NO: 116539 - DNA, 297 bp, Homo sapiens
ccaacaggaaaatacttcatcagatggctttgcccaccatggcctccgtgccatttgtccctggaatcttcctgtgactgccagagttttcagcaaatggagagaattgttaactgagaatgggtttggaggcctgaaaaagaggttggggtcaatgcagtatcttcaagcagcttatttttcctgaaataaatgattattttactgggaaagagggttgtcacaagaaatccatttacatagcaaatggctggatgtgcccttcatctctttcacgaaatcactctgtgtgtgcgt

SEQ ID NO: 116540 - DNA, 470 bp, Homo sapiens
tttatatcccattatttcttttgctttttccattttccccggcaatgtagggtgggggttagtataggaaatgaggtttttgagttctaaattctagttccgtctttgaaaggaaatttcacaacggcctaagcaaaattttattatttttttaccttcatttttttcttctaagacatgaggtcaacactactcctcaagtaaaattagagattgatatagatatcaaattacggtgtagtataaggggacttcaaaattgattttacctttatcttcactcgcaatctgttcctatattaagatcctaattcttcatcaatatatatgttgaccatatgacttattgcccaaactgggacgctattgagaataaaagggaatgttactaaaactcaagtcagggcaattgccataaaccaggactggcctaagcaaattgggatatacggtcctcctacctacaaagc

SEQ ID NO: 116541 - DNA, 350 bp, Homo sapiens
agccaggagtgtcagggccagcagatcacatctcaagcttccccagagaattagatgggccctggctctacactggaagcactgtgtgccctgggaaaataaagcctgaccttcaattctccacgtccctgtttgtaatgtgagttagtaataacacttccctcccaagactgttgtcaggattacgtgaggaaatgtatggaaagctcctgacacggtgacaagcagggaccattattagatttaacgccactactcttaagaccagcccagggtgatactggactggagagggtcccatcaggccaagacagaattcagttaggaaggaggagttccctcctgccagg

SEQ ID NO: 116542 - DNA, 367 bp, Homo sapiens
agcctaattttgtatttttagtaggggcggggtttcaccgtgttggtcaggctggtcttgaactgccgacctcaggtgatccacctgcctcggcctcccaaagtgctgggattacaggtgtgagccaccatgcccggcctagtcatcatttgtaaccacaagaattattcatgaagcatgaacgagttaggtaagggaggcaccaaaagtccattttgtatttttctttcatatttaagacatgatgagtgtaaggattcccactggaggagattgccaagtacaagaatgtgtgcctgagctgggtgtggtggctcacatctgtgatcccagtactctgggagaccaaagtggtcaagaccagcct

SEQ ID NO: 116543 - DNA, 601 bp, Homo sapiens
catgggtcccaacgtagttattatatttgaccatttgcaaaagctgaaagcaaaacatgttacacattttcagagaggaaaatacacagtagttcctgagtgtaagttgtttttcttgacctcattcttaaattgcttcatgagggtgggagggaagtggtagttaataagtgaacctgtaaaccagcgtttctcaaaatgtagtccagggaattgcatcaaaattgcagttacctacagtgcttgttaaaatgcagattcctgggcccctgccccaggcttatcaaatcaatctggtgagtaggactcaagaacctgtaaattcacatacttctgcagatgattcttcttgcactgcacagcatgaaagcctctgcaatagacagaaagctaccagcattgcgaaagcaacttgagtgcttggcctttgaaggttgagtgggactttaatgagggagagagtaaggcatgagaaatggcagttccactgaggtcagtcagtggttcattgctgacgaagtcacttttaagtcatgttttagaagaactaccaagtgtggcaggtcaggcatgtggcaggactgtttctgagcacagatga

SEQ ID NO: 116544 - DNA, 606 bp, Homo sapiens
ctcctgtcccgtccttccaaaaacaagcatcactgcacaaggctctctgaagacacagagcttcttcactgtaaaaagctaaatagcacgaaaacttaatttaaacaagaccctctcaagaatttgtttggcttaaagctactaaaatgccattctgttggctcatattttcatttatgtaagatgagtgtcatgccaaagtgattttattgccatagaagtcaggcaaatatagagaaaatacattttagaaaataaagtgacatgtggcacatttgaatcctatgttctgcatttagaaatgaactcatgcctctccaagctgaagctttttggttatctaggaagacggtagcctggtctctacagggttccactccagagcctgcactgcacactctctgtcctgccatggccctctgccatctgtgggaggtggatcagttgggccaggccaggcacaggtccatctcacgctgaatgtagcagacgggagctgcttctgctgggtgagggagggggcttgtgcttggctgtgaggacaaggtcactcctttggagctgtagaagggatggggcaagcatgcctgcctctgctgtctgctg

SEQ ID NO: 116545 - DNA, 646 bp, Homo sapiens
tgttccaggcagagggaagagggcgtgaaggccctgagggagtcgtgctgcctatgtggaggccaagccaggagctgcccaggtagttggtgctgagtgaggaagcaggcaggaccagggcgggccgggtgctgtgagccacgtcagggcctttggattgggctttactcaggggtactaaaatccttctcgtttccctgatgatgaaactgaagacgacactatgatatcaatgggcacagacggtacctttagctttgcctgtccaagtttccagtttgcaaatgagtcttagctatacccctgcctagctctccttgggcaagtcacctacttctctgggcctcagtttcttcatctgtcaaacgggagtgaaaacctccaccttccaagagtgttgtaagacgggactaacaactcacctcaaatgctgctgtaagtcaggagctgagcctgggccctggtggacacagagaaggctcagtaagtatagcccatcactgtcactgtcattattaccaggctctgaatgggggcagggagaagtgagggaccaaaacagccattgatagcacatgtgctggcttacggttagagactttcagggctggaagcaaatctgggccaactcctagccagtgctact

SEQ ID NO: 116546 - DNA, 294 bp, Homo sapiens
cctgggtgtctgaagagcaggcgtgggctcagcactgtgggcatgtgaggtgtgcactgccccggcctgtctcagggatgcctgctttctgtgtagggagctgcagttatgcacagccttgcctacaccagaacttcatatttaaagtgaacacatactaaaatcataggcataaagcagctttcccaccgaaagcaactctgattttatccatccattactctacctgtccatctcccctgggggtgagcctgctgtgtgtcggatgcccttccagggactcacagagtgcct

SEQ ID NO: 116547 - DNA, 268 bp, Homo sapiens
caagtagtgcacctctctttaacaagaaaaaccaagttacactaaaacaagcatctaatgtgaacacaatcattcaccccttcctctccagtatcagagatacactaaaatgacatgggtggatgatgatgggcaatgaactcaatgagctatcctcatcctaaggatatcatatccttgcagtctcctcgtgttgccccaacaaaataatgccctgcatgaccacaaaatttatgtaaccctttaaaactcttaataatctcatatg

SEQ ID NO: 116548 - DNA, 273 bp, Homo sapiens
ctcctgatgctaagattctgtgactcggggtgactctattgctcatcatccaggtcacctctaggctcccaccagtgacgcctgcgtgttccatggcagcctctcctcaggctccaccctagtccccagggcatgcacagaaatgaaggagtcatgtcggctcctagagcagcgagttgtggctcttctgccaaacatggccacacatcctttaggataagagtttcagaagttagagccgggggtcagggtggatgcacagaaagcaaaaaa

SEQ ID NO: 116549 - DNA, 545 bp, Homo sapiens
cacaaatagtcgtactttgtggctttgcttagagtggtgctgaaacatactgtttgacttatgaatgattccttttttaaaagcctggtccttttttaaaaacagacagcacagtcctagagcaacaccttcacttttgaggaggaggttgtgatcaagactcagcaggaatcccatgtacaggagagaacagaaaagtcataagcaaggaccacagaaagagacctaggctagactatggaactctccctgatgagcaactgtgtcaataacactatgaagaaggcaataatacacagtgaacagcattcagccagctttaggtaaggctataggataatgcagaggcttttatgtcacttctgcattatcctatagccaaccgtggactagtagccaaccgtggactagtagccaaccgtggactagtagccaaccgtggactagtagccaaccgtggactagtagccaaccgtggactagtagccaaccgtggactagtagccaaccgtggactagtagccaaccgggggctagtggggatc

SEQ ID NO: 116550 - DNA, 198 bp, Homo sapiens
ccccgactagcccgacaggcgttctatgttttatctcatttaatcctaacagtgaccgatgaagtaggaatccttctccatttaacagacaggttccctaaggccattaaggaactggtccgattaagtgacagaacgcggccttcaccaagattcagtgacgcccagccccatcccctgacagccatttctcacggg

SEQ ID NO: 116551 - DNA, 426 bp, Homo sapiens
tcttccctgtctcccccaccccactggtgccacagagatagactctagccctggacaagtgcttcctgtgggtagctcacttccaggagaaagtgagatgaaaagggagggcgctgcaggcccagtcccagctcccaaactccccagtcagatcagtccctacatcctataggaggaaatacgtgaggggtcagagacaggccaggacagtggagcttctccatgtggaaggaaacatcaggagtaaagcaaaagcatttctctaactccttcagcctgtatattactggagttcaagactaaggccacagtattgaaatgaatgtgtggatctgaaaagggagatgcacctgtcaaactgggaaggaagaatgtttgaaaatagaaaaataaaatgacctgggcttggattggggaaatcagtta

SEQ ID NO: 116552 - DNA, 703 bp, Homo sapiens
tagtagagacaaagtctcgccatgttgcccaggctgatctctgtctcctgagctcaagcagtcctcccaaaatgctgggattaaaggcataagccaccgcacctggcttcttagccatttttagagctactttgtgaactagatttactttgtgcatcttaaaaggaaaccaagtgtttgctttgtattgactttttttgttacatttctgcccagtgcggtcagttggttatttattccatttccccttatttgtccctttctacctgttagagtctattaaacgtgtatggatgcgttttctgatctacaattttaataatacttaattttattaatacttttgtgggttactgtaggaaatgagagattcagcaagggaattctgagttagaccatagctgctgcttaaccgctgtcatggtgtctgaacagattcctgctaacagtatttggttcaagaaaataagttatgtctttttaaagctgtcttagtgtgttcaggccactgtaacaaaataccatagactgcttggtttaagcaatagaaacttattttctcacagttctggaggttagaagatcaagatcaggatgtcagtgtgatcaggtcagaagattcccttgctggcttgcagatggctgccttcttgctgtttgtctcacatggcctttcctccgtgtttgccaatgccctttcttt

SEQ ID NO: 116553 - DNA, 383 bp, Homo sapiens
gttggatcaaatggtagatctactctcagatttagattttaatttacttttagattttagatttagaaatctccattctgttttccatagaggctgtactaatttacattcccaccagcagtgtataaatgttaccttttcaccacattcatgccaacatctactgttttttgactttttaataatgaccattctggctggggtaaagcggtatctcactgtggttttaatttggatttttgtgatgattagtgatgtagagtgtttttccatatgtttgttggccatttgtatgtcttcttttgagaaatatttattcatatcatttgcccactttttaatgagatctttttttgttttttgtttgctaatttgtttgagtt

SEQ ID NO: 116554 - DNA, 345 bp, Homo sapiens
accgggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaag

SEQ ID NO: 116555 - DNA, 642 bp, Homo sapiens
cccaaatctgcatataaataaaaatcaatttcagtataaaaatctttttagaaagctagacttaaaaattaggaaaataataaaagttagagagctttgtccttagttttgggataatttttcttctcatttggaatgggaaagacccttccctgactcccagcaaccagcccaacgtgcctcggcctcagggagctgtgcaattgctgttccctgcctctcttttggttccaaggaatataattgaccctcacactcccatattcttatttaggcatccttctctttaaagaaaaaaaaaaaggcaccagtgttgatttggctacatatagacctcacttctgagaaaagaatgatgaaatatgttgtccagatgtcccttttagagatatcatgaaggtttgcttaatttgcttacaatgattgagtaaagaaagctcaccaatagcactttaaattatacatcaatattgcgatacaatcccaacattcatattaaaagagtacttaaaaaaagtcaacgaggccagcgcggtggttcaagcctataaccccagcactttgggagggcgaggtgggcgaatcgcttgatcccagaagttcgagaccagcctgggcaacatggcagaacctcacctctgc

SEQ ID NO: 116556 - DNA, 493 bp, Homo sapiens
tgagacggagtgtttctctgtcacccaggctggagtgcagtggcgtgatctcggctcactgcaacctctgtctcccaggttcaagcgattctcttgcctcagcctcctgagtagctgggattacaggcatgtgccaccacgcccagctaatgtttgcatttttagtagagacggggtttcaccatgttggtcaggctggtctcaaactcctgactttgtgatccacccgcctcggcctcccaaaatgctatatctgtagaatccgtagaatccgggattacaggcgtgagccaccacacccagcctagagtatggtatagactcgtgtaagacttcagtgaatcttatcactaccactttgtggtatgggataagatacttattttctgtaagtctcagtttcctcaactataacatgcgagagggacaaaatgagcacttacctcaaggttgttgtgaggattaaatgagacaatacatgtaaagcacttag

SEQ ID NO: 116557 - DNA, 475 bp, Homo sapiens
ttgggcaacagagtgataccctgtctctaaaaaaaaaaaaaaaaattctctctcactcacagaatgagtcacctgaggttgctgcggctctattccatgcatttctttatcctgaaatccaggctgaaaagagaagcccctttctgagtcacgctgttctcaaaagaggcaggctgcttggatggttcagagcacggccttgcattcagataaggctaggcaaaaatgcctgcattatcagagttaatgcttacaacacccctacgagttcggaggtgatattctcaatttacagatgagaaaacctgaaatatcttgcccgaggacacacagggatgtgaagaaatgggagccgaactcaaacatgttttgtgtctggctctaaaccccaggctttccctcaccctgctattctgtccctgcaaagccaattcaggatcagccagttaaacatgctgaattgagagcacctgta

SEQ ID NO: 116558 - DNA, 631 bp, Homo sapiens
accattttccctgggtctgtctgtagatgcacatcagtgccagcaaagtccagtgggggagagtgagagagagagattgattttagaagccaattctaaaatgtacagagaagtacagaaaggctgggagcagcccagaccctcctgaggagcaggtggacggtgcaacagcggatggcaagtgggacgtgttatggggccgcagttgcccagagcacgaggagctgctggcggggggcttggccgctgacccacgaggtaggacaccgcctgggcaccgaggggggcctgtgctcgtgcccacgcacgcggatgtgtgatgaagggagtggcgttgcaggttattgggggaaggttggactcttgttctggtgccaggaaagtcaggtgcccacgtgggaaaaaaggaaagtagactcccacggcattcagatccccccaggtggatgcccagagggcagcacttttgacccagagccccatcctgatgacctcacagacaaggcccccaagagcctttgctgcagcggaagcgggtaacatcagcacacatgactttgtttctcagaagacacgggagagggtgaaggtgcggtcattcataaaactcacaggaactcaaaaccagaat

SEQ ID NO: 116559 - DNA, 1290 bp, Homo sapiens
aatatttaaggaaacaataacaattctacgcaaatccttccagacaatagaaaaggaaaaggtctttcctttatttgatgaagatagcattactttcttactaaatcaaacagacatcataagaaacaacaacagagaccaataaccctcatgaacaatgatgaaaatattcttactaaaattttagcaaatctagttcatctatatcatgacaaagtgtactttattgcaggaagataaagttgatttaacattcaaaaatcaataaatgaactttaccatattagtggactaaaaagaaaaatgcatatgatcatcttaatagaaaaagcacttagtaaaacccaacattgagtcatgattaaaagccctcacaaaaccagggataaaatgaagagtcctcataggatgcaggccatctacacaaaaatctatgtcttcctaaaattgagaacaaggtaaagatatctactctcatcacttttattaaacattgtactggaggttctaactcatgaaataaggcaagaaaaagaaataaatcatctagattggaaagagtaacactttccttatcatttgtgtacaccagtccatggaatccatgaaataaaagctattagaactaataagtgagttagcaaggtggcagagttcaagattaatatacacaaatcaagggtatttttatataaaacaatcagaaattgaaattttaaaaatgttatttccaataccattaacaaatataaaattgttagccataaaccaaataaaacatgtggaagacttgtacattgaaaactgcaaaacattgctgagagaaattaaagaagacctaactaaatggaacatgtaccatgttcatggacaggaagacttgaagttgttaagatgtcaattctcccaagttgagttatagatcaattgaatatcaatcaaaattccagaaggcttttaaaagtgaaaatcaataattgaactttaagttttatatggaaaaaatgaaggacctagaatagtgaaaataactttgcaaaagaagaataaagttggaggacttacttatctgatttcaaggctaaatataaagctatattaaaacagtatggtattgccatacatatagacaaatagatcaatgaaacacaatagagattccagaaatagactcacatatatatggccaatagattcttgacaaagtacaaagacaattcaatggagaaagtattgtcttttcaacaaatgatgctgaatccccaaaaaagtgaactttgattcgtacct

SEQ ID NO: 116560 - DNA, 585 bp, Homo sapiens
aatatttaaggaaacaataacaattctacgcaaatccttccagacaatagaaaaggaaaaggtctttcctttatttgatgaagatagcattactttcttactaaatcaaacagacatcataagaaacaacaacagagaccaataaccctcatgaacaatgatgaaaatattcttactaaaattttagcaaatctagttcatctatatcatgacaaagtgtactttattgcaggaagataaagttgatttaacattcaaaaatcaataaatgaactttaccatattagtggactaaaaagaaaaatgcatatgatcatcttaatagaaaaagcacttagtaaaacccaacattgagtcatgattaaaagccctcacaaaaccagggataaaatgaagagtcctcataggatgcaggccatctacacaaaaatctatgtcttcctaaaattgagaacaaggtaaagatatctactctcatcacttttattaaacattgtactggaggttctaactcatgaaataaggcaagaaaaaaaagtcgagcggccgcgaatttagtagtagtagtagtagagtaggggccgc

SEQ ID NO: 116561 - DNA, 218 bp, Homo sapiens
tcccaagctccctgggctcagagtcctgtgctcgagagctccttccccattcttccggcagccacacccccgagtttgtccctccactcctgaacatcctatggacgcctccttttctaccctcctgggtggaagaatcctttctcttggtccatttccacttcatcctgaagaacagtaaggagaggggattgctgtttgtcgggatgaaccatttg

SEQ ID NO: 116562 - DNA, 331 bp, Homo sapiens
aacataccacataacttgcttatttatcttgctaatggcctgtggtccccaacaaaataaaagctctgtgagatcagattttctctgtcttgttcactgctgcatccccagcacctagaactgtgcctgttatttagtaagcgcttaatagatgtttgtcaatggcatgcacaccatgccacgatcctgcccacagccatatccccacactggctggggatgggcctggaggacagcacctgagctctgttcatctctggggcctagcacagtaagtatcaggaaatgttagttgactgacccacagattcacattcttagtgctgaggag

SEQ ID NO: 116563 - DNA, 983 bp, Homo sapiens
aggcgtgcgccaccacgccctgctgatttttgtatttttggtagagacggaatttcaccatgttggccagtctggtcttgaacttctgacctcaggtgatctgcccaccttggcctcccaaagtgctggaattacaggtgtgaggcacaacgcctggcctaaaaatgctaaaataatttaagccaactttgaggaataactaccttcaaatgatgcattattaagtatatggttatataagttttgacaaatgcatatacctatggaagcatcactaccatcaagataaaagaacattccatgacccctaaacactcccttgagcccttttgcagtcaatcacccttttcttaccaccctaggcaaccactgttctttctataactaaattctatctagaatttcatgtctacaggatcatacagtaggtactcgcgtctatcttcttttactcaccaagtttttgacactaatccatgttgttgcatgtgtcagtttgttcctttatactgcagagcagtatagtccattatatggatataccacaatttgtttatgcattcatctgttgacagacattcctgtaaagctactataaatattaatgtgtatttctgtaaacaaacgttttcctggaattgctgggtcacagggttaagttttcagaaactgtcagttttccaaagtaatgtaccattttactctcccatcagcaatatatgattatttcagtagctccacatccttgctaacaagtggtattgcctattttttcatatatttttattagtgaattgtgcttttaaaaaaaaagcgttatgtaaaagatttgtgaaattctctatatactgatccaagtcctttgttaggtattttctaatagtattttctcccagtctgtgagcttgccttttcataggtgtatttttaaaaccaaaacctttcaatattaatgaaatagaattttttccctttatgattcc

SEQ ID NO: 116564 - DNA, 229 bp, Homo sapiens
aaatcaacaatgaagaagagacatatggtgaagggagggacagaggaactcatcgtgaatcagctctctccactgcaggaatggtatagagtgcttgcacagagaaaaggccatgtgaggacacagcaagaagacagccatctgcaagccaaagtcaggaacccgatgtcaaaccaaatctgctggtgccttgaacttggatttccagcctccagaactatgagaaaat

SEQ ID NO: 116565 - DNA, 302 bp, Homo sapiens
taaaataggttttggaagcttgtttctaggaaagaggcctggagtaatctatttccagtgccttagagaattaatatctgtactaacttagatgagcttcctaagggagagttcttgattcttgattgtcatcacatcaattaaatgcttacttgtgttatttaacgatattaactactgtcattcaaagaatttttttacaggtttagaatttctacagaagttttcaagtactttgttcattttgtttttatccagtaccttttctccccacctgttaagatttcagaaattgagtgtac

SEQ ID NO: 116566 - DNA, 881 bp, Homo sapiens
ggagttcaggagacagaggcctgggttggggacagagatgagaactcatcagcaaatggtgaccaaagagggtgacgagaagactgagaagacacctgtgggaatcacatttcactaagggaaaggcaggggagggggagggagccaggaaaggaggccaagaagcagtgtcttgagatagaataaatatcaggagagaaggagccggaatggcaaggatgaggtgcctggggaagcagacagggtcagcgcttcaaatgctgctgagacgccgggcaagaccagcactgaaactgtcctctccactcgtaaggagttgactggagacttcagtgagaattgtcttcagcagagcgatggagccagggccagagtctggtggactcagccagagtgtgggagggaagggaatgaggctggaacattcttacaggccattcagctgtgacagtgcagggtggggagacgtggtgtccagacactccataggtacacactttcctgcccccagatcaatcagtgtgggtaggaggagagaagaaggggtacctctgggaccctctccatctaatccttaaagtcattttgtagcatttgatatatatgaaaaaagaatacatggaacatacttgtaagccatgaagccaaacaacaaaatgattatctcaaaccttcctcccaacccaagatctccaactagtgtgtttctgccccaaaccatgtccctgcccagccctggggtagacattaccctgaattttatgttgattatttccttgcttttgaaaatacttttattaggcatgaatgtatccctaaacaatatattgttttgttttgcttgtttttgagttttataaaaatgctattataaagtatgg

SEQ ID NO: 116567 - DNA, 669 bp, Homo sapiens
accaattgtacttttattatatcaggctgattcactgtttctaatgcaatgaacttgacacagattttaaattttttctcaatctgtcccattgtgtagacaaattaattcaaagttctttttcttccttctctttttcatctaagcctgtgcttatgagtagaaaaagagaagaggctaccttgaaatgcctcgggcccaaactcagaaggctctgcactcaactgagcctcccttcctactaagaatggaatagtgttgcttataggggtgttggtccaagtatcagctgtggatgattaattcccagggctgctatcacctaaggtaacttcagtaatcttatgtgtttggaaaggaggatgaggattatttttcaaatacataattttgttttattttgaaacaatctcacacctacagaaaagttgcaattataatacaaagagcttccccctcgcctgaactgtttgatagtaagttgccaaactgatatacccacgatccccaaatgcttcagtgtatttcctcccagcaaggacattctcctgcataaccacaatacaaccataaaagtcaggagattaacaccagttcattttgaccatctgaaattcaggtgtcattcatgttttgccagttgttctttgtatgttcttcatagcaaaa

SEQ ID NO: 116568 - DNA, 395 bp, Homo sapiens
ctattacaatttatattaaactgcaagatatcacttcatatcaagactacgatggtggcatcccttccaaaatccatgccttactagtctgcatataaatgcaaataagcattctgaatgctttgatttcctcacgtttacagagaggattcacattcatctggaggagagatccaggcatgtgaatgtccaaaagaaacataagatagaccagaagacaaggtatctgtttttttttttgtagatggagtctcgctctatcacccaggctggaatacaatggcaccattttggctcactgcaacctccacttctcaggctcaagcgaatctcctgcctcagctcctggtcctcttcctcctaaatcactgatctgaggctctaaccttgtctgc

SEQ ID NO: 116569 - DNA, 514 bp, Homo sapiens
agctgcctctccacagtgctttggcctcttacccccctggatgctatttaggaagcatctgcttcagttttagggtgtcccagaggcactgactcccagaacctgctactggatgagtcctatggatgcatccccatggtgccaggagaaaagagaactcacggtcttccagcttcattcttcaccagatacccaagtcccatacccatcttcccaccccccaaataaagtatcttatgagatatcaactggagataaagagaggagcaaagattaggcagggaaaaaatgaaaggctatagaaaggtaggggagagaataggtagagagtaaggtgtttaaatgcagaggaaagagaagtagctaaagaagcatgacagacagaataggagaagggccatgctccacagaagggaaccaggactcagctgggctgccacacgccatactccagggagagtcacttcatttgtaggctaggtgaatggtgcctcctggagttgtgcagtgcacg

SEQ ID NO: 116570 - DNA, 388 bp, Homo sapiens
agctgcctctccacagtgctttggcctcttacccccctggatgctatttaggaagcatctgcttcagttttagggtgtcccagaggcactgactcccagaacctgctactggatgagtcctatggatgcatccccatggtgccaggagaaaagagaactcacggtcttccagcttcattcttcaccagatacccaagtcccatacccatcttcccaccccccaaataaagtatcttatgagatatcaactggagataaagagaggagcaaagattaggcagggaaaaaatgaaaggctatagaaaggtaggggagagaatgaagccggaagaccgtgagttctcttttctcctgcacctggggatgcatccataggactcatccaaag

SEQ ID NO: 116571 - DNA, 151 bp, Homo sapiens
aagcaagcactaagggaatttgttaccactagaccagcctcacaagagttccttaaaggtgttctgtattagtgtgctcttgcattgctgtaaagaaatacgtgaggccaggcatggtggctcactcctgtaatcccagcactttgggagg

SEQ ID NO: 116572 - DNA, 798 bp, Homo sapiens
actcacaccgcctttgccatcaccaccgtcattgccccctctactaccaccaccatcaccaccaccgggtctgcctcagccagacccaccactgcctctaattagactgccaccatcatcactgccaccaccactgcccctccaatgccttcctgatgtcaccatctgctttctctctgctatcctcacacccaactccatcacaaccaccaccttcatctgagccgccatcaccctcacagtacacagccctcaaatgtgtaccaaggaggaggacatttactacacgctgcaccctgaacagtctgggaccagcggtcagggaacaaggaatcgagatgctcacctgcagctcccaggtgagcggctctctagagcttgcctgggagctgctgaggagctcacggtattccaggaagctccccatccatgcctcagcctgtggctcagaagcagggtcttcgcagaagattgccccgagctgttgcaaagctcaccattgtcacctgcctgcaacggcctctcttttccactctccaaatcccttgtattggcaggctctaatctggaattataccggtgatgggattctggaaaatccctcagatttctccaggatgcaaggagaccatggaagaggaacaagcctgcaagggacagcaggtgctaactgctaaccgagacatagtgacaaaaatccagccacagagataaagaatcaggttcatctgtagctacatccagtggagaagttctgctcttcaactcctctgctaagccacatgtgtcagcaggtgt

SEQ ID NO: 116573 - DNA, 293 bp, Homo sapiens
tagttgtgacagaacctgcatggcctgcaaagtgtaaaatattagtatctggcccttgcaagaaaatgtacacatcacttacgaagtattcttgccaaaaatgtttaacttgaacccaatcgtgaggaaacaatcagataaatccaaaaatgtgggacattacacaagacaagtgggctgatgcttcaaaaaaatcagtctaaaactagaaagaaagaacaaccaaatgcaatgcatgaagcctgatgagagcctggagcagaggaaaaaaaaaacacagctgcaaaagacat

SEQ ID NO: 116574 - DNA, 126 bp, Homo sapiens
tcaaggaaacgcattctcccatacagttttaggaaggaatataggctgctgacatcttgattttagctctgtaaggcctactttttacttctgacctccagagctacaataaatttgtgttggatt

SEQ ID NO: 116575 - DNA, 303 bp, Homo sapiens
agtgcctcagaagcaaagggagcagaggatttccaggagggagtgataatagcatcagacccagcagggagagaccagacagtgtccactggatgcagaggaatgcatgatgactttgggagagaactgtttcaaaagagtggtgggggtccattgctgtacttttggaagtgagtggaaggtgagagagtgaatttctccctttgaagccactgtgccaggagttgaagatttcctagccagagaagttctgagtcttgagaaggttgaaggtgttcactgtgtgcatgagtaaagagcagg

SEQ ID NO: 116576 - DNA, 434 bp, Homo sapiens
gaatcgggatcccacagggcagatataagtaagtctggacaaaatctggctcacgtccggctctctctgtaggggaggggtccttacgttcctttgattgattgaagcccgagaaagcctgagagctctaatctctgggacaatctgccttgtttgcagcgtcagtaactgaggcattgggagaccagggggttgcacagtccccagacctgcagacaaaccagccatctgatcatcggaagccattacacattaaagcagaaaagactttccaaaaggacactaagagttagaataaagagacctccagcaggctgtatctgaggctttaagcattagagcaaatattgtgaagcacataactccaaaaaagcctcccttgtaaagaatattcaatatctgtaaatcatcacttagaaatgcagcccagattt

SEQ ID NO: 116577 - DNA, 303 bp, Homo sapiens
agcctggggtgacagagcgagactccgtctgaaaaaagtaagataactacttttcaaataagctttggtagaatcttatgagctcacatcattgttttccaactatgatatgagttcaaaattttcttctttgaccctacattttattagatatatacatttttagatgtatatatttttaaccattttaaaagtttctctatgaaatttgttgtgttcagtttacatagaagactgcatgctttctagtctgtatcatatattggaagcatttactagtacctgataaatgattttaggttg

SEQ ID NO: 116578 - DNA, 434 bp, Homo sapiens
aggcactcgccaccacgcctgactaatttttgtatttttagtagaaacagggtttcaccatgttgaccaggctggtcttgaactcctgacctcaggtgatccgcccgcctcagcctcccaaagtgctgggattacaaggtgtgggagaagtgagttgaccctggagggccagacagagtggggcctctgggtgcttccaaaggaacaagagcccagagctgaggagaccttcggtggcagatggattggatgaagcaagggtgagggtttctggggccctgggctctgtttccatgtggaaatctgaaatgttttctagacagtgatggaaggaggtcagccaaagggctgtttaaaaacaaagcctccatgtaaaccatttctgcaagaatattttaaaataaataaaaataaaactgaagacatgaaatgtc

SEQ ID NO: 116579 - DNA, 397 bp, Homo sapiens
gtgccggagctagctggtaatggacaggagaggattagttccatggacaactggaggcgtgtccctggcagagagagaatgtgttcagtgacaacagctcatatttgttgagtgcgaatttcacaccaggccctatgctgagctcctgacctgcatctcttattcagcaagacaatactgttataaaggaacagttaattatgtcattttatagataagtaaactgaggttcactgagttgccaaaagtcacagctagtaagtggaggggctaggaggaccctgggtgtgtctagagcctgtgattgtaccactgcacctgctgtgcagaggccttggggagcaatgtgggtgcagcaagggggagctatgtgtttacatccccctcgtccccctct

SEQ ID NO: 116580 - DNA, 222 bp, Homo sapiens
tgataacagacttgtatccagaataaataaaaaactcttaggattcaataataaaaatataaataactccatgaaaaaataagcaaaggatctaaatagacatttatacaaaaaatatatacaaattgccattaagcacatgaaaagacggtcatcataggtcactagggaaatacaaatcaaaaccccaatgagatatatcacttcacatgcactaggatt

SEQ ID NO: 116581 - DNA, 258 bp, Homo sapiens
ggggaggggaagatagaaatggaaagagagacgcaggaggcgagttctggccattcccggaagcgggtggagatctgttgggagtgagccttcactgccagaggggtggggcagaaggagaggtgtgattaagtgatgtgactgagacagagttgaggggctcctcctcattcccccaattcccagtgctccagacatctagacaagcctcctcagaggggaaagtggtggatgaagaaggaaaagagacaggtagta

SEQ ID NO: 116582 - DNA, 640 bp, Homo sapiens
tataagattgataagtccctaacaaaactgattaaggaaagaaagaacaaccaagcaagttgccaataccaggaatgaaagagtagacgtcagtatagaccttaaaagaataatatgggaatatatgaatgtcaacaaatgtgatagtttggatgaagtgggcaaatttcttgaaaaatagcaaaccaacacaagaggaaataaaatctcaatatctctatatcttctaatgaaattgaaacagtaatttaaaatcacccagaaagaaaattctagactgtttttactgttacattctaccaaacatttagggaagaaataattttcactaatcttacacaaactctttcagatagctatgcaccatgatgcatgcctgtagtcccagtaactcaggaggctgatgcagaaggatctcttgagcccaggagttcaaggctgcagtgagccatgattgtgccactgcactccaccaaggcaacagagcaaaaccctgtctcttaaaaagtaaaaaaagactgggtacggtggctcaaacctgtaatcccagcactttgggaggccgaggcgggcagatcacgaggtcaggagatcgagaccagcccagccaacatggtgaaaccctgtctctactaaaaat

SEQ ID NO: 116583 - DNA, 288 bp, Homo sapiens
aagaccagcgtctgaatgataagagatttggaccttgtgtggcagcatttggtctcaggccctgctccgcctgcttgatattctactgtgatgaattggctatagctggtttcccaggagctttgtcatatccacattcgactgcagaaaaaaaacaggagttaactaactttcccaaagtgacacagctagtaagtggcagagcttattcattcactcaagaaaatatttagtgatgacctgttttgtgctacatgctggagctggatgaaaaccccaaagtgtctg

SEQ ID NO: 116584 - DNA, 366 bp, Homo sapiens
tcccccagctgagcctagttactgtttagccaagaatttccatttctcacacaaattgtccactaaacaactgttgaatagcgtccatctccatgctccaggataataggacctcatgtctggttccaaagaggaaatttatggcagtaagacaaggatccaccttgtgaacccaaaagtatctgtaacaggtccaaccctgtgaacccaaaagtatctgagacaggtcccagtcaatacagaaagattattttgccaaggttaaggacatgctggtgacacagcctcaggggttcctgatgacgtatgcccaagatggttggggcactgtttggttttataggttttagggagacatgagacatc

SEQ ID NO: 116585 - DNA, 528 bp, Homo sapiens
gaaactactttatacctactgggtgcttaagcaatatttgttgaatgaatgaataaataaaatacctttattaaaggaggtgtgtcgaaacttcacctgttggcttgctagtttatgtcaggttgttctctctgtaatcgttaaaaacaagcacttaaatccacatttgtatttggtcagtaaaattacaaaaataatcttacttttaagattaagctgtgaacaacgctgtgtccagcaggaacatctgtgagccgtttcctttgcccagaaaaagagagttgctgttgtccactctcagtgatatctcagaaataatggcttgtagctcaaagatgctttctctctttttacaaaaccataagacccacaaaaattacattagagccaggatttgcttaagtcccactcacattaaccattattactcacctccctacaagagtacaaaagtaaccaaatgttcccttcatgttagtcaaagttttttgttttttgctttttggttttttcagacaaggtctctgt

SEQ ID NO: 116586 - DNA, 523 bp, Homo sapiens
tgttaccatggttcttaatcatcaatgcttgttataataaccgggattgaatgcaccttcttcagttacagggatttggatttagggagttggaggtggggcccgtgaatctacttttaacaagtaccccaggtgattctgatgaaggtggatcagccaggcatggtggctcatgcctgtaatcccagaactttgggaggctgaggcaggaggatagcttgagcccatgagtctacctgggcaatatagtgagacctcgtctctatgaaaaaaataaaaaaattagctgggcacaatggtgtatacctgtagtcccagctattcaggaagctgaggtgagaggattgcttgagcctgagaggtggaggttgcatgaaccatgatcatgctactgcactccagcctaggcgacagaacaagaccctgcttaaaaaaaaaaaaaaaaagtagatcgtgatcaacatttaggaaattttgctcccatcactgttgctttctccagtagttttctaagtgaatcttt

SEQ ID NO: 116587 - DNA, 257 bp, Homo sapiens
ggatttcttctgggtaaaagctcgtttcctgcctgcacttgaggctgcgttccaccatgcttgtgctggctctgagttttgcctcccaccctcaatttcaaccattattttatcctattctctgggttgcttcagttcagtttcttcctctctgtagtttttttggaccagtaatttctaattatcctgtaggtctcagtttaaatgttgcattttcagggacgtctttgtagattcctttctagtgcattgggtcc

SEQ ID NO: 116588 - DNA, 646 bp, Homo sapiens
atttcatggatacagacccaccacaggtgaaggaagcactccatctcatcggccgcctttcctttacaaaggctttgttctgtgagtgtctgcacatcctcctttctcaggaataacagccttccatatatgtggttccctcacatacatgccaaggagcttctgccctctgctgtacataaaagatgctacagtgatgaggagaccaactatctcagcaggatactaacagtgaggttgtgaacaactgtgcaatcctttatcatcctcacttccattgccatagcttgatggacattattcatctttgaaacatttttcatgtcagtgagaaaataggtgttccacaaaattttctttgagacagagtcttgctgtgttgcccaggctggagcgcagtggcatgatcccagcctactgagaccttcctgcttccagattctcctgcctcagcctcccaagtagctgggattacaggtatgtgccaccatagctggctaatttctttatttttagtagagatggggtttcaccatgttggtcaggctagtcttgaactcctgacctcaagtgatccacccacctcggcctcccaaagtgctgggattacaaacttgagccaccatgcccggcccaaaattttctt

SEQ ID NO: 116589 - DNA, 221 bp, Homo sapiens
  misc_feature (201)..(201): n is a, c, g, or t
gttctgggggtggctttgtggtgacggtgccggtacttgagcctgtgagtgtgtggcccacttcctagcagagtggaacttgccttatctcagatgagactttggactgtggacttttaagttaatgctgaaatgagttaagactttgggggactgttgggaaggcatgattgggtttgaaacatgattatgagatttggngagggggcagggcacaatga

SEQ ID NO: 116590 - DNA, 326 bp, Homo sapiens
taagcggggactacttgtacttggaaacagactggtactaggatttattccggcaaattaggcataatcattgactggcactttcttctttactcacaggcctggataagcaaatgcaagcctgtgattctgctggatttactctataataattactttgagatgctgtatttcttttaaattaacaatgtcatgatttctatttcaacagtgagaaaatggaaactctgagaagttaagtgcagtaacttgcctaaggtccatccacaaagagctaggattcaaatccctgtcaatcagttatcaaacccagtacttttccactg

SEQ ID NO: 116591 - DNA, 155 bp, Homo sapiens
agtctggagacatttttgattgtcacaactgggaaaggtgggaagtgcttccggcatctagtggttagagggctgggatttttatagttattctaaaacatacagtccccacaacatatccatatggaattatccatatggaaatatcagtagtg

SEQ ID NO: 116592 - DNA, 373 bp, Homo sapiens
ttcgcctcccaggttcatgccattctcccgcctcagcctctctctacaggcctcagcctcactacaggcctcagcctctcagtacaggcacctgccatcacgcccggctaattccttgtttttgtatttttagtagagacggggtttcaccgtgttagccaggatggtctcaatctcctgaccttgtgatctgcccacggtggcctccctaagtgctgggattacaggcatgaaccactgcacccggcccagttccacatcttaaaaccagagcatttaatccaaactaaatatagttcttaataatagaattgcattggaagtatctgtgctttactaaaccttaataaaattttgtgctgtgtatacatga

SEQ ID NO: 116593 - DNA, 399 bp, Homo sapiens
tctagctttctgtctgcacggggcctgatgcctggtaggtccttggtaaggatttgttgaagggaggagagaaggaaggagggaaagagggaggcgaggattgttaaaaaggagaggaaggccgggcgcagcggctcaccccagcaatcccagcactttgggagccgaggctggcagatcacgaggtgaggagatggagaccatcttggccaacatggtgaaaccccgtctctattaaaaatattaaaaaattagctgggtgtggtggcatgtgcctatgatcccaactactcaggaggctgaggcaggagaatctcttgaacctgggatgtggagattgtagtgagccgaggtcgtgccactgcactccagcctggcgacagcgagactccgtctgaa

SEQ ID NO: 116594 - DNA, 724 bp, Homo sapiens
ggctcaaaagtgaatccctagctcatagcttatttctcaaatcacttagcattttaattacttttcaatttttgagatacaagtcacatattttctttttaaaattaatatatgtactttctcattgtaaaagacctgaactatacagaactgtaagaagtaaaagtcttagttttccttccagagagaacatgttaggaaaatctcttggcatctgaggagctggctgtctatttttacttctatattgactagctctttttccttctaataaagagtgtatattggtttaaattataccaacttcctctgggttttagaggttagcttatttgtagacgagtctacctaccacatctatttctccttatggcttagagcattttctgatcatcagcataaaattttaggtgccttattcattttgccccaagaatgttcaaactcctcaacctcagaaatgtttctagtagttgaaagactgttttgcgattacttttattggattctacacagaagtacccatagcatcattgaactagctctgttgcataactgtcctgtgtctaaaaatacactgctgagtagcatcagctcttgcccagggatatgaacccacactctgggttatttgtactgactctgaccacagactatcttccaatatatcctgcaaaatgatcctttatggaaaacaccaaacttcttccagtgaagtctgata

SEQ ID NO: 116595 - DNA, 305 bp, Homo sapiens
taagactatctggaatttacagtgctctcctaagggattacagaccttcagtcaaccaaccaatttatttccttaatcctttgagggtaaaacttagactaagcatttcaaggggagtagtttgagggccaaagtaaagaaaacttttcaaagaatgagaactatccacagtgagatggagtgccttgtgatataagaagttccccaacataaggcattcaggctggacagctgactgaacagaagattcctgcactagaaggcaggtgagacctaatcaagccaggagacctgagcaagccagg

SEQ ID NO: 116596 - DNA, 341 bp, Homo sapiens
ctccatcatcaagtacttgaccagcccttttgctactttacgttatttaatcccacagcacatggaggggcagatgctatttggggctcagagaaggtatttggggctcagagaagttaagtaacttaccaaggttctaccacaaattaaatggcatgtctgggatttgtgtccagctttgcctgactccaaagctcatgctctttcattatataccatgcctctttttttgctggtatttttcttgaaatattctttcccatagtcttgagaagcattgcagcacaggctgatgcatttgtagcttatggtcaacagtgataactgggcttgttttgtta

SEQ ID NO: 116597 - DNA, 259 bp, Homo sapiens
gggcacatagcgcagggaggtgcagatgtcgcccagcttctccggctgtccaggggaagagcaggacttgggtcatctcacccatcctagtgcctctctcatggctgacctctttcttgccaaaattagcaaggcagtgatgtgtccctgcctccctcatcaccagtccccatatatgtgatggccgagaaggtcttccagcatctgaccttgggtccccctgatgcagtgcaacaaagtccctgaaagtgacaggttg

SEQ ID NO: 116598 - DNA, 284 bp, Homo sapiens
agctggtaaatgcctggcgttgtgttgtgttctcccagcttcctttttatatgatgcctatgatgctgtctgatgttagatgaaaagctcctggcattgaagtctatcagcagaggacaaggggagggaggccgtggctcattcctgcaagaacagactgtaagaatggagagggcagaggtctgtgtgtcgggcagaaagggcgtcaggatacgatgttctttagcggactggctactcagcaaatttgattgttagtcattttcacactgtcaaatatgagc

SEQ ID NO: 116599 - DNA, 306 bp, Homo sapiens
aaaacactacagaccgatattcctcataaacatagaagcaagtatctgtaacaaaatattagcaaatagaatgtagcaatatatagaaataattataataccatggccaagcagggtttactccagagacacaagtgtagtttaatatttgaaaactgactgatgtaatcaaccatattaactaaagaagaaaaattacatgatcacatcaactaatgcagaaaaagaatttgacaaaattcaagagggctaccgcacctgacctgaattagcatcaattctatacactctgttttagggattaag

SEQ ID NO: 116600 - DNA, 737 bp, Homo sapiens
gttttttaacaaatgttgttgatcatttattatttattattttgagaagcttaaaaattattctgtcatgaagtatgttttaactaggctactttggaaagtgtttgtaggataaatttatgattggctagattagtttatagcattccttttattcagataactctagtgaatatagctctaatggttcagagcagtgtttctcaaactactagtgatgatggaccagttttttaaaaaaattatcatctgtcacagacaaatatgtgtatctgaaatacatgactaacatgaactcacaccatgtgtgaggcaccacacaaatttgatattccctaactgatgtatactctgataaatctgctaatcactcacttggatcttgtaacaatattaagttgctataaaagtttataaatatttcctctcaatttctatatttatattgttggagattgataacagtttgtggatgatcctcaggaccacactttccgaagcattggttctggtcttgcatgttagtttcgtgcttttattctggttcatgtggtgaagactgtgtgtattctgtattcttaaaaaaaccactcgctctttcagatatatttggaagtgcttctaaaatataacagtgtaatctactttaacattttaacctcccttttgctgtttagaatattttgtgtctaaatttgaaaatattcctaacaagttgatattattattttccagaa

SEQ ID NO: 116601 - DNA, 276 bp, Homo sapiens
tgtgttctagaatgctctaaaggcatggacttctgtagcatgttgtgttctctgccttgtgcttggcatatagctgcactccatatatagtggttgaatgaatgaaaaaagtctgcctatctgaataatcatggcagtggtgtttttttcttgctctatttctttatatattgattaaatataaatcacatgttcactacccaaaaaaccccaattgtccttaaactctagcaaccagaaataactaatgtaaccagaaatatatcctacaatatt

SEQ ID NO: 116602 - DNA, 605 bp, Homo sapiens
aggccagtccttgaacatgaagtacttgcttcttaaatatttgttggaaaagaggatattgtgtaaaatgcatgaaccgtggtatacttaactgtcccagttactggacaggtgggcttttgagttaatcaacggcagcaaggctgtagtgaagtctttggatctggggtgcatctctgaggacagcgtgttaggatcctggcagcttgaagcatgttgagtgacaggtggtctcagagggctgaacagaggagttgatgagggcctgtcaattacggggggaagggtagagttaagggaaccaacattgaaaggattaaggggagggactctgcagagagtgacccaggccaagaagctggaacccgagaggcagcctcggcctagaacccgagtgacacaggccaagaagctggaacccgagaggcagcctcggcctagaaccgcagccaggggccggagtgggaggcagggccagaattgggtcccccggcattcccttttcaccaaacaccctgggagttccccgccttggccttggaaagcccaaaagcccaggaaaagctcatttgggggcgcgaaactgggcaaggtgcttgtcgggg

SEQ ID NO: 116603 - DNA, 330 bp, Homo sapiens
actaaaatgagattctaaagtcttgagtaccgaatctgggctccattaaaaaaacagcctgagactttgagcaagtaataaatgaaatgatctctaaagtatctttcatcactaaaaccctttgattcaaagggatctatattttctttccttgcaaaatatgttacagaaccatagaattttaggtgggagggagacctgagaattggtgtagatgacctccaaagtcaatttatgctgaaaacaccatcacatagcccttgcacgagggcttaggaaatttggtctaacttcatgttactgctacatttcttcagcctcgtagagctg

SEQ ID NO: 116604 - DNA, 259 bp, Homo sapiens
ccagagtctccttacaaagtcatcctgctcttaccatcaggacaaccttagtgaagcaccaaatgcctcctctggtgtcctctgggtcctgattctctatctggtaaaggagcgggttaagtaaggttctgtgtcacatattaggtccaagtctgattttctttattctagatttcccaatgactagcatgcaaggtaactctttcaagaagttcatcctgacttccctgtgaatagtgattattctcttctttgaact

SEQ ID NO: 116605 - DNA, 390 bp, Homo sapiens
tagtgatgccggaaggctagggtggctattgcaatttcttaaagtcaacaatgaagtttgccacgttgattgactctttccttcatgaaagatttctctgttttatgtgatgctgtttgatggcattttgcccatagtcaaacttctttcaaagtgggagtcaattttacctttcgacccagcaatcaaaaaataaaaaatttaaaaaaaattaaagtcagtcctcttaaaccttgccactgctttatcaactaagcttatggaatattctaaatcctttgttagcatttcaacaatgcccacagcattttcagcattagattccatctcaagaaactactttcgtaagaagaaacttgttcatcataagaaactccttatttgttcaca

SEQ ID NO: 116606 - DNA, 253 bp, Homo sapiens
agccttatggtgactgcatcataatgggccatatcaagtgcccatggtaagtgcagaaaacctacccccacttcagatgatgcaaaataaggaaactgaaaaaggtactactggccgggcgcggtggctcacgcctgtaatcccagcactttgggaggccaaggtgggcggaccacaaggtcaggagatcgagaccatcctggctaacatggtgaaaccccgtctctactaaaaatacaaaaaattagctggg

SEQ ID NO: 116607 - DNA, 354 bp, Homo sapiens
gcacctgtaatcccagctacttgggaggctgaggcaggagaaatgcttgaactgtgggggcagaggttgcagtgagctgagatcctgccactgcactccagcctgggtgaaagagcaagactctatttcagaaaaaaaaaaacaaatagtctctctgaatccatattatgttgtgctgaacctatattagctccagtggggatggcaccaggttcaagaggctgaagaacagccccagagccagcagatgagacatggggttttactgggggcttccatgtggcaacagagtccaatggcagtgggctgcacaggggactgcaaccctgcaactgcttgcaaaaagcatgcact

SEQ ID NO: 116608 - DNA, 617 bp, Homo sapiens
ttcccagttcctgagaaaaccaacaaaaataggcaagcattttccaatgataccgataaagaggccaacaacctgcttacttcagagaaaaaattttccttccgtcactgcgaatgcaagaatgatttctctgccagatgtttcccacgtttccaagctgttttatttttaagacttagttttaaattctgattaatatgcatacgtgtgagaagtaaaaacttgtcaacaaggatgaatcagtatttgtagacctttaagcagtagtagccaattaagaatccattcattaagtcaacaaatatttaatgaatgccaactgcgtttcaaatcatttcagaattcggaggcaaagaagcagatgaggcacctgtctgccctcatagagctttcgtggcagaaagggggaccaattaaataagcaaatgaaaaaatatcaaggacaaatgctacaatgaaaataaaacaggttgatgtgatggcagctggtgaatgactacttcagatgagatggttaaaagaggcccctccaaggaggtgctcgttaagttgagacatgcatggcaagcagccagccatgaaaagatcagaggcccattgcaattggatgaaagaaa

SEQ ID NO: 116609 - DNA, 136 bp, Homo sapiens
gggcagtgctcaatatcgagcatttcttacaacaattaggacttattcccattcagataatgttgtcctagttaacccctttgtggtttttggagatgtaggtttattctttaaactttttttttttttttttttt

SEQ ID NO: 116610 - DNA, 629 bp, Homo sapiens
atatagaattttgataattactaaaaatcattttgtcaatttttttccagcaactttctgatgtagcagtctcttgatatacaagagggatatggtgagaccttgaacttcagctttctgtaattccactggtatatgttataacttcacaggctaactttctctatacataaaaggggagtaattgtatccactgtcaacttgtgaggaccgaaggataatcaaatgggaaatggggagtgtgtggttaacactttgtccactgcctggtaatggcgattcagtcactgctaacacagaattagaaatgacacgtgttatgtattttctggtcacctgagaatagtcagaaccattagcattgaaagccatgagtgccttgggtcaagagtagcttatgatgacatttatttttatagttaaagaagtggagacagaatagatagaatggttacaggtaagtgtaaacacattattttctttattaaagaggcttttcttgcttgaaaacatttttgaaaattgccactggccaggtgtggtggctcacacctataatcctagcactttgggatgctgaggtggaagcttgggcaacatagcaagaccatatctcttaaaaaaaaaaa

SEQ ID NO: 116611 - DNA, 448 bp, Homo sapiens
tctttttttttgagatgaagttttgctcctattgcccaggctggagtgcagtgcgatcttggctcactgcaacttccgccaaaaaaagaaaaagaaaaattcatttatcaccatgggaggatattggaaaacccaactcattttgaaaactgtcaaagaaagggaaagaagcatttatcctttttggtacaaaccatactttttggtagccaaatagttgataaattgataccttttatagacatatgtccactaccaaagacagaatcatagaattagtatgccaccatgttgtaatatctaatgaaataatgggccaggtgtagtggctcatccctgtaatcccaacactttcggaggccgagatgggaagattgtttgaggccagaagttcaagaccaccctgggcaacacagacctgtctatgcaacaagatcctgtctctaca

SEQ ID NO: 116612 - DNA, 209 bp, Homo sapiens
ttgaagtataatgcattgaagatatggcctgtacaaaggcagaacagggatgttaattagaattctgacaagcctactccaataaaatgatgagattatttgtaattgatgtcacaatcaattaccatttagttcatcatgagcattctaataggtttggctttggtattggccccaggatgttgctgagtgagtggctgccctgctta

SEQ ID NO: 116613 - DNA, 224 bp, Homo sapiens
ggggggtccttcagacttgaagcctcctgggcttacctcagccctaatgaattaactcccgtgggcagggtcctcacacccatgactctggttccagcaactgctgctacgggggtaacctccctactcagcacacaagggccgtctgacctgccccccacccccctacctccataccagggagcaggtgagttgcccaagtcaccctcagcaaggcctcctct

SEQ ID NO: 116614 - DNA, 460 bp, Homo sapiens
gagagatttttaattcagtccttgatttatgcaggacttacagcttggctttcaggctctaaactgtctttgatttgaaggtcatgtttcactggggacccacccctatctacctaggcatttgactggctcatttgactgccttctgcagctatcacaataaactctctaaaaatctttggtcatctctgtctatcccccaaatttcactcacaatagttactaaaaatcagccattctttccaaccttctctccagtgtcttcagaaccatgctgttctctgcttggctcctccttgccagcctgacccatcagccccttcattgcccttttctaacagcctgtcccagaagatgtggaaacttcccaccactcttgggaaaaaatggaatttctcaagaagagcagctcccaccaaaattgtagcaaataaatcctttcatcacttcaaattattct

SEQ ID NO: 116615 - DNA, 404 bp, Homo sapiens
gcttgttcaattctggagcttctctggcccctgggtacttactgctgaggcattttggtgccacaggatcagatctgctgggtggtaacttggtgatgtgtatttggaatgtggctttagtggacagtggctgagcagaggagaaacactgctagctcctgagcaacataccacagtgactcttgatgttccatgtaaggaattttttttcccccagttacataagttggagcaccctaatccataattactctgaattggttaccattaccataattaaaaataaaagaactagttctttcaaaaaagtggaattggccaggcgcggtgggtcacgcctgtaatcccagcactttgggaggcctaggcgggtggatcatgaggtcaggagattgagaccatcc

SEQ ID NO: 116616 - DNA, 306 bp, Homo sapiens
cctagttttagaagtttcaatagcagcacctcatgcagagagagcacccatccgcattagccaggaatgttcattatgactgctgtgtgccaggcacggtttaaggctctggatgtacagcaggagccacacagatgtggcatccggtctcctggagctctcaccttcatctgggaggcataaattaaccaaataaacaccaccgtgaatataactaccaattagagtacatgctctgaaggaaaaatagtacttgctattgaaacttctaaaactaggggtaccggctcgattctatctgtctcc

SEQ ID NO: 116617 - DNA, 387 bp, Homo sapiens
tgctaggattacaggcatgagccaccatgcctggcccctacctcctccttctataggtgtccagtacccttggtatcgaagcaccataactattaatacctaaagctttcctccaataataatttagtctgtgtccctgtttttctctaaaatgaatgttgccatgaacatcactgtgcacatatatctttgggaacttatatctacatgtgtctgtaggacagagttctagaggtgggatttctgggcaaattatatacatgttttaatttttgacaggtactgccaaattaccttctagaaatgccttacacactagagttttttcccccatcttctccccatactctcaccaacactgagatagtcagtcactttaaatgtttg

SEQ ID NO: 116618 - DNA, 410 bp, Homo sapiens
cctcctgggttcaagcgattctcctgcctcagcctcctgaatagctggaactacaggcgcgcaccaccatgcccagctaatttttgtatttttagtagagacggggtttcaccatgttggccaggatggtcttgatctcttgaccttgtgatccgcctgcctcagcctcccaaaatgaatgttgccatgaacatcactgtgcacatatatctttgggaacttatatctacatgtgtctgtaggacagagttctagaggtgggatttctgggcaaattatatacatgttttaatttttgacaggtactgccaaattaccttctagaaatgccttacacactagagttttttcccccatcttctccccatactctcaccaacactgagatagtcagtcactttaaatgtttg

SEQ ID NO: 116619 - DNA, 672 bp, Homo sapiens
ccaactccacccctctcacgtacaggaataaatcacctcccaccaggccacacctgcaacatttggaattacaatttcccatgtgttttggtagagacacacagccaaaccatattattctgaccctgatcccccgaatatcatatccttctcagcgagtaaaatacaatcttgccttttcaaaagttgccaaaagccttaactcattccagcgttaacacaaatgtaaaaggttcaacatctcatctgagaaaagtctacagtcccttttgcctatgagtccctgaatttcaaagggaggtctttttttcaaggtacgatgatggtacaggcattgggtaaattttctcaatccaaagggaagatatttgtcaggaaagtaacacaaatgggatcacaggcccagtacaagtccaaaaccaagcaggacagtatctattcaatcttacagctccagaatcatcacgagaactcaccatcatgaggaaagcattaaggagacggtgtttaaccatttgtgagggatcctccatgattaaatcatcttccacctggccccacttttaacgtttccaattacaattccaaatgagtttctgtagggacacacagccaaatcttattctgtccctgcctcccccaatctcatgtacttctcactttgcaaaatac

SEQ ID NO: 116620 - DNA, 185 bp, Homo sapiens
ccccgaggttctgatgaagggatatcctgcatgatcgagggtccctgtggttctgatgaggggagatcatcctgcatggtggagggtccccgaggttctgatgaggggagaccactccatatggtggagggtctctgcagttctgataatgggagatcatcctgcatggtagaaggtccctgagg

SEQ ID NO: 116621 - DNA, 564 bp, Homo sapiens
gaccttgtctggcagtctcctttaatttattttttattatttttttctttttgagatggagtcttgctttgttgcccaggctagagtgcagtggcatgatctcggctcactgcagcctccacttcccaggttccagcgattctcctgcctcagcctcccaggtagctgggatcacaggcaagtgccaccacgcccagctaatttttgtatttttaatagagacatggttttaccatgttggccaggctggtctcgaactcctgacctcaggtgatccacccatctcagcctcccaaaatgctggaattacaggtgtgagccaccgcacctggcctattttttttcagcaaattctttgtttttctctctgttcccaaatgcagggtactgagaccacagatgtattctgtttcctgttgaaaaaatgtttctcacttagctgggtgtggtagcatgcactgcagtcccacgggaggctgaggcgagaggattgcttgagcccaggagttcgataatcatgccattgcactctggtctgggtaacagagcgagaaactgtctctt

SEQ ID NO: 116622 - DNA, 668 bp, Homo sapiens
ttacaccagatgctcccacccttaagaaatctcattatgtatatgcaaatattccaaaatctgaaaaaacacaaaatcctaaatacttttggtctcaaatattttggataagggatactcaacctgtattgggaatgtttcccagcagccacttccctccctcttctactgtgaactagctatatagttttcatcccaaattagtctcagtaatcagtttaatcccattttacttgccacactgatttgttaaaggacaggccacagcaaacaccgatatttttgtttcctgacaggagtgaaggctagaggaggaaggttaaatctcttctaaggaaggtgtgatgtgcgaatacaaactcttaacttctgctgccacttaataactctgagggaagccacctgaagagaagtcaacagtgcataaaggttgcgcctaaacagctgcagtgaaatgaagctggagccacgttcaaattacaccctgaacacatgcccccaaaaactccttttaaattttgtgaaccagccaaattcctttatctcctctttgacctataaaccacagcattctaactgatagagaactccaaaggctgattcaacctcttttcccaagtcatctcccaccacttcataaaatgttgaagtggtgggagcatctggtg

SEQ ID NO: 116623 - DNA, 342 bp, Homo sapiens
accaggagttggaaaccagcctgggcaacatagtgagatcctctccctgccaaaaagaaagagagagagacagggtctcactctgtcacccaggctggagtgcagtggcacaaccacagttcactgtagccttgacctcccaggctcaagcaatccccctgccccagcctccctggtagctgaaactactgggtgtggtgcctgtggtcccagccactcctgagactgaggcgccatcagtcacttgagcccaggatgtccaggctgcagtgagccaagttcatgccattgtactttagcctgggtgacagagtaacaccctgtctcaaaaaaatatttaaa

SEQ ID NO: 116624 - DNA, 320 bp, Homo sapiens
gtcttggccatatgctacactaagctaaacagaatgttatttgcaaacattctggatttaaaattgatcaagttggctgtaacccaggagtagggtgataaaaagcgtgagttagaatagtagcagcaggaaaataaaaagcaagaatggaaaagttctgatcaaggctgagagcaattatttatagcttttcgaaaatagacaaactcacaaaacactatgcaagatacctgtcagctcttggccatatgctacactaagctaaacagaatgttatttgcaaacattcgggatttaaaattgatcaagtgggctgtaac

SEQ ID NO: 116625 - DNA, 571 bp, Homo sapiens
tgcttgcactgggggaaagggagagtatcatggttacagctggatcacctaaggcagagagggaaggaaccaacaggtatatgaagaagactgtatttcctcctcaggaagaaaaaatcacctataacactctcaaaaccatttctatcttacaccttcagagaagccagccttcattaaagactgaatgaagtaaaataaagacttaacacagactggcaaattggataaagagtcaagaccaatcagtgtgttttattcaggagacccatctcacgtgcagagacacacataggctcaaaataaagggatggaggaagatctaccaagcaaatggaaaacaaaaaaaggcagaggttgcgatcctagtctctgataaaacagactttaaaccaacaaagatcaaaagagacaaagaaggccattacataatggtaaagggatcaattcaacaagaagagctaactatcctaagtatatatgcacccattacaggagcacccagatttataaagcaagtccttagagaccaacaaagagacttagactcccacacaataataatgggaga

SEQ ID NO: 116626 - DNA, 464 bp, Homo sapiens
tctcccacccacactgtcccatgcctctaggctccagccatactgagctctttcactttcactaccacgcctgattctccctctctctgggcctttgtccgtggggttttctctgcctgaaacactgtcttctcttattttaactatttttctactctgcatccttcaggtctcaggtaggagtcacttcttccaagaagctttcttaacccttcatgcttctctgacaggccttttctaagcactcggtgctagtcttgcactgtttccaccacagcacttagcatattgtatggcaaatgcatctgaattttttctactgatccatgatctctataattcagtaactgtcatgttcatcacctcgtgtccccagagcctttcatagattgaggagtaggtgcttggtaccacactactgaatgaatgagtctatcttcaaagtcaactccaatagaaaggag

SEQ ID NO: 116627 - DNA, 598 bp, Homo sapiens
aagggacacccgacttgggtcctcttgcacctgcccacacacaaggacttcaatttgtgctgtcagtggctcttttctggactgtgggcaccaccacagctttgtccctgctgtactgtgtatccccttgcctttctggcttgtggctctgaacaaagcaggtcacccatcccaatttctagagcccccccaccgccacccccaccctcatggagcctctatcgtgcaagaagggaggtggggacctggcaagtcatccaggacaggcatttgaagagcaggagccaaaatctgagactcgggcaagtggttcctaaacccagctcatcagcaccattaaggggagcaaaaaaccagaccgggccaagcccccagcccagaagatcccgactcctgctgcccacagacaggcacatgagcagctttgctgagactcctttccatcccagacccctgcccttggggcctgccagggacctctgccctcatggttggatctggacactcccgggatgctgcggcttctctacctgctgcaactgcctcacctcacgggagggtctctctacgcaacttctgagtcgaggtgcataagcag

SEQ ID NO: 116628 - DNA, 438 bp, Homo sapiens
cccccagcagtaaaacaatcccaatgacgatacttcccacttgagtgtgtgaccctcctaacactcactccgcctctctgttttcgttttgtttttaaagatcccttttagaaaatatcacacgattttgttttacagttgagtaatgcgtaaaaaagacatcaagtttttaaatttctatgcaaatatttgtaatgttaatattttaatagaatgtctgcagtgtcttcaacctcttcttttcttaggcactttgcattcagcgttcaaacatgccgacttcctcctgcggaaacaccaaacgaaagggaacttctcccacctcagcctccgtccagtaacaaccgggctatcctttccctccggttcaccgccaaacttcttgaaagattctcatctatactttgtttaaacaaggccaacttaccttttcacacg

SEQ ID NO: 116629 - DNA, 675 bp, Homo sapiens
gccttcctccggctcagccgccgcgccgccgggctgctccttcttcctcctcgggcgcccgcggcgatgttcaaccgcgccgtgagccggctgagcaggaagcggccgccgtcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttctgtttgggctagcatgtgaagattttaagaaaatgcaagataagacgcagatgcaggaaaaggcacaaggagatctacatgacctttctgtccagcaaggcctcatcacaggtcaacgtggaggggcagtctcggctcaacgagaagatcctggaagaaccgaccctctgatgttccagaaactccaggaccagatctttaatctcatgaagtacgacagctacagccgcgttcttaaagtctgacttgtgtttaaaacacaagcgaaccgaggaagaggaagacagattgtgcctgatgctcaaactgcagctaaaagagcttccagaatttataacacatgagcccccaaaaagccgggactgggcagctttaagaagcaaaggaatgtcctctcaggaccg

SEQ ID NO: 116630 - DNA, 191 bp, Homo sapiens
ggtggtgggcagggtcagtgacccctaccctcacagaaccagttgcagctgtggggatgggggaaggccaaaggccgaggtgattgaaagccagagtaaggccaacccagccttgggggttcaggaagccttggggctctggcccagatgcctgtctgtctcccctacctgccccctgttccgatcctggg

SEQ ID NO: 116631 - DNA, 281 bp, Homo sapiens
tacatccacgctttccttccactcccactcaggctgccccgctccagacctcatccctgcactgcgggccccgctccctccagtctctgcgcggcagggaagaggtcctaaaaagtggtcattccaaccgggcgcggtggctcacgcctgtaatcccagcactttgggaggccgaggcagggatcacctgaggtcaggagtttgagactagcctgaccaacatggtgaaaccccaactctactaaaaatacaaaaattagccgggcgtgatggcaggcgcc

SEQ ID NO: 116632 - DNA, 315 bp, Homo sapiens
aaacatggaagacataatgtaaatgagttgccttagttaatttgatggataaaattcaagccaagtcccttctctctgcagagcattcattgcccttaccttgactatgaaggagtgaagatggagtagtgtaatggttaaacacacaagctcgaaagtcagattgcctgaggtcaaacctataccatttatcttgtatgacctcagccaattaacccccctttctcagttctccattggtaagatggggataacagtatctactttatagagttgtaaagattaaatgagataatggtacatagtaaacactca

SEQ ID NO: 116633 - DNA, 604 bp, Homo sapiens
gctgtaagatatgacttgctcctccttgccttccatcctgtttgtgaggcttccctggtcacatggaactttgcttgttgcatgccttctaaacagcctaccctgccaagtgccatgattactgtgaccacatcttcagaaccagaaaacaggatacctggccctaagcatgcactcatggagcagaagagttttaaatctggaatgccacagaagacagaagataacatgcttactacacttgtaaagcaacatgcagccagccatttccagtgcaaattatctcattgcatagtgtgacaactaaaggtcataaccataatacaaatcgtgtttttcttgtaatctatccttgggttaaatgtgaactccaggagagcaaagactttgtgggtatccccagcactgacatctgtgaccagcatatgataaactgtagttgtacataggagagaatcaataactatttgtagaactgaatatattttattgcaacccttttcataatgttaagataatagacatcatagtgtaactaacagtgccttagaagtggatatcagagacttggctaccaccaacaagcaactgtgaatgagtaact

SEQ ID NO: 116634 - DNA, 328 bp, Homo sapiens
catgttacactcatgtggcttcggaagctgcattctggtcacagctgagcgtctttcgtggtgcttgcctcatgggccagctgcttcatcagctcaccctgtgtttcccattttgaataatgccgtaattcataggttgaattgatgtaattcactgttgcaggcaccagagttgtacagattgttgacaagtgtcctgtccttgtgagttcgaccttatcttagaagcacaattattttatcgtcagaggtcaggctgtgtagaagaaatagcagggctttggagctggacagattgaagtcacccaacctctggtacatctgtgtc

SEQ ID NO: 116635 - DNA, 445 bp, Homo sapiens
cctcccttttgccttgatttaatgaaaggctgacataactaggtttgattttagtataagaaaaagaatctcctgaagtcacaaaagggaggttaaacataagagacaactatccagatggtttatcctcgcaggtctaataattctaactcatccttaaaacattgctaacctgattatcatggctgatgtaagcaaagtacttaatggagttgtgtttttgcagagaagcaaaatgttatcaacaagtgtcatttgaggtccttttcccaaaaacaccagagtatgaggttataggctgcctggagggcggagatattttatcacagagttaagggtggagaaatggggagaagaaattgataggttttccaaaccttgctttgccttctggtgtcagatgataattgtttttgcaaaatgctgcagggtgagagagagtgag

SEQ ID NO: 116636 - DNA, 332 bp, Homo sapiens
gagttaaaggggaagaaccccttataaaaccatcagatctcatgagaactcgataacacgagaacagcatgggggaaactgcccccgtgattcaattacctccgcctggtctctcccttgacacgtagggattacaatttttaagatgagatttgggtagggacacgaagcctaaccatatcaatggcacatgactatataaggaaacagcaagtcaaaataacaacaggtgacttttcatcagaaaccatggcagccagaagaaaatgaaatgacatatttaaaatgataaaaaaaccacaattatcaaattagaatcctatatacaattt

SEQ ID NO: 116637 - DNA, 523 bp, Homo sapiens
gtaactggggaagggtactcaaagcagaggtaacagtgtctgcaaaggccccgaggtgaagatgtgcctggattccagggacagctatgaggccagtgtggaagaagcacggagggtgaagggaacaaccagtaggagatgagtcaaagaaataactgaggatcagacatgtaggcagggaatagactttagattttattccaaattatacgggaagcatttggaggattctgaatacagaaatgacttgatctttttaaaatggccactctggctgttgggtagaaaacagactatgggagtgaatacttggaagtaagaagatcagccaggaggctgttccaaccatccaggcagggaatgatggcagtttacatcagggtggtgatggccgaggtggtgagaaacagcaagactctgtatcttctgaaggtagagccagaaggctttgctatggactgatgggtgtcatttaatggtacaagaatactgaaagaaatgcatgcttgtggggatggagaat

SEQ ID NO: 116638 - DNA, 161 bp, Homo sapiens
ggacacccgacggggtggggtgaggttactttaattatgatgatagaggcaagtctctctgaggaagtaacatttaagcagagactaaatagaacagtttagggatgttcttaactacatgcagggatgtagttagaattaaaatatgtgtagccagtttt

SEQ ID NO: 116639 - DNA, 277 bp, Homo sapiens
acggtcctttctctctttctaaaggtctagtttctgcccgtcgggggcatcacggcctccatcccaggaagctagaggcaagactcacactcttcagaaaggagcggctcattaacccccaccttcctccagctttgctggaacagcaccaaggacaattcccttcccccaggtcaggaggaagggtgttcatcctcaccttggggagaacctcagagcagcccactgcaaggccgacctcgggagaggaacaaggcctcagaatcccaagagtcct

SEQ ID NO: 116640 - DNA, 212 bp, Homo sapiens
aagttcttcaaaaggtggactccatctgtttgctggtgggaagctggggagaccctgtctgacagcttctgtttgctctgtgatgtagaaggccaggcctccactgagagtggagagtcagaagttcaagggaagggtaagaatctgaactagtgattgagtagtgagtagtatgtgctaactagagaatgtggttatgatttatgggtggt

SEQ ID NO: 116641 - DNA, 327 bp, Homo sapiens
gaatcacttcactgggaggactaacctcacccagacaagttgccatctccttttttatttgttctaatgcctaacttttatcccactgcatgacactgaacttcctggctcttatagtaaagaaaaagataaaacgaggccgaagcaggcacaaggtcaggagatagagaccattctggctaacacggtgaaactccatctctactaaaaaaaatacaaaaaattagccaggcgtggtggcgggcgcctgtagtcccagctactccggaggctgaggcagggaaatggcatgaaccccggaggcggagcttgcagtgagccgagatc

SEQ ID NO: 116642 - DNA, 1438 bp, Homo sapiens
  misc_feature (1160)..(1160): n is a, c, g, or t
cttattttcaatagttttcctctgatgttctgctgggtatgtaggattttacctcgatttttcttttttcgttcatgcaagtgtcccctttgtttttcattataattatcattataatgataattgaaaatgaaacttccccatctatttctaattatttaatggtcacagagctatgtttattactgaagctaaatgtaacaactatgaaatgtataattgccactctgaagtctaaacttgcaaatgaaatttgatatctgagaagatatagcaaaccaaaaattgctaactgtagaattaacattttatagctaagacagactgtaagtggtatagtttctgtatagtttcttttttgtttaaaaaaaatgtacttactcatttggaaaaaatttttaaaattcacattaaaaagttcttataaaatacccttcataaataaccactgttaaaattttgctatgtatcattctcttatgtttttctatgcatttaaattcttatcataccaagaaggcagtgattaagagctcagtttctggagtctgacaggcctgatgatgaatcacttaatacatgtgtggctttcaaaaagttacttcacctctataaccttaattatctcatctgtaaaatgaaaaataatgatactatttgcttcatagggttgtcttaagaatttaagttaaaaatgtatataaatcacagcacaatgattaaaatataagtactcattaaacagtagccattattattaaattgtctatagcttttaacctatcttgcttacttagtaatatgagcatctttctatgtcatgaacatctttatatgttgtaaattaccttctacaatattacttggatttttgatattctaattgatagatgtgacatagttttttcaccaacccgtattttggatatttttgttgtgtcttattttctagttttaaaaacaatgctgtagatgatccttcagaagttaaaggttttggagtcatctcttaatcaaactcagtaacttctgttatttctacttttattgaaagtatatgcagaacttttaggtctaagatttctatattttatattgacagcaggaatagatcatttttatgtcttcatgagtttaatgatatattggaagaagcagtntttagcatttgcatttgactgatttactggcagacatttaaaaactataaacccaaagtcgtctgaaaagctaacaagcttgagtgtgtaaaaatattatactgcgaggcacagcatattgagtaccagccctaggctaccatattataactttatgagggctgggcacagtggctcatgcctataatcccagcactttgggaggccaaggagggaggatcactgaagcccaggagttcaggaccagcctgggcaacatagtgagaccctgtctctac

SEQ ID NO: 116643 - DNA, 458 bp, Homo sapiens
agagagactctgcctctaaaaaaaagaaaggcacagggcaaacagcgaaggtagcagttagcaatcagtaatctgccatgtcgccgtgtgaagtgataagcaggagtgagtgggtgatgtttgctgacactccacgtctttcaatgcccttcctctgcctcctgagcactgctgtagagtatctctcatggactcttgtgatggtctgcttggtctgctctcttccctccaattcatctgctatcccacaactacagttatcttttccgaacatggatctgatcaaggcactctccagcctcacagcctctttgagtccaggcctgcccgctttgctggccatcctgttggccgctcctccccttggcaccatcactgcccccttcactctgccctgcaggctttagacttcacagccatgcatgtgcacatcttgttctctcccacagaaatgtcca

SEQ ID NO: 116644 - DNA, 515 bp, Homo sapiens
ggaagctcctgcccctcctaaagctgaagccaaagcgaaggctttaaaggccaagaaggcagtgttgaacggtgtccacagccacaaaaaaaagatccacacgtcacccaccttccggcggcccaagacactgcgactccggagacagcccgaatatcctcggaagagcactcccaggaaaaacaagcttgaccactatgctatcatcaagtttccgctgaccactgagtctgccatgaagaagatagaagacaacaacacacttgtgttcattgtggttgttaaagccaacaagcaccagattaaacaggctgtgaagtagctctatgacattgatgtggccaaggtcaacaccctgattcggcctgatggagagaagaaggcatatgttcgactggctcctgattacgatgctttggatgttgtcaacaaaattgggatcatctaaactgagtccagatgcctaattctaaatatacatatatatatcttttcaccataaaaaaaaaaaagaa

SEQ ID NO: 116645 - DNA, 561 bp, Homo sapiens
aattcgggggcggcgtcgaccaaacaccacacatcgataaggatttggggacattggcttgtgtgtgtcctgccgagagtgtagatggtcacccatttggggaatgaaatggccttccctggggagatcagagtcatgcaggatacatgactggcagttccgttctaggcgcttccttctccacccgcaaggacacgtgaagttgttgactgtgacatggttcacaaagccaggggcagctcaaatgacggggttagttgtacagtggaaggtaacgcaagattaaatgagttaaccagagctgtgtgtcttgggccagataaatcctcaaagcctaacattaaagaagcaagttgctagaaaataggccccattttgacactgaagaggttttttgaaatgtggaaggcatgttacgttgttgatgagcgtgcgtaagcaggaaaacctcagcagcccctgggaggcgccctcagcccaagggacagccctcccaggcaggtgcaggggcagacgatgcttttactgtgtctaaaattatgcttctctatgaaaaaaaaa

SEQ ID NO: 116646 - DNA, 350 bp, Homo sapiens
ctcaaattgggatcctatgatgtggcttgggagtcctagggaatgccatggaatattaaaatgacacattttcctgagcagcaattttaccccaaaatttgagagtaaataataattttctattcaaacaaagaatgaagcagaataaaaagttctcatatatttagacagtaaaagacaagctttaacagaaattaagtacttgcaagaagccactttaaactactccttgactcgccagagggtatatactttcccttaccattagaagaagtagaattatttgagaagcactatgtccaggtaaacttctgaactgtgaggggaacagaggagattagaaataaaga

SEQ ID NO: 116647 - DNA, 599 bp, Homo sapiens
cacatgttccagaggagaaaaagaggaggaatggcaaaggctgattgactttgtcagctacttactttaaaaaacatttgagaaagccagaaagcagaggggaggaagctccaccgtcatgagaatgggaagcagaggcagcggcagcgtgcacagacatcctttgaaggtttgttataaacacagaaactgatgtctgggaaaaggctggagtgcaatggcgcgatctcggctcaccgcaacctccgccacccaggttcaagcagttctcctgcctttgtctcccgagtagctgggattacaggcatgcaccaccacgcccggctaattttgtatttttagtagagacagggtttctccatgttaaggctgttttcgaactcctgacctcaggtgatccgcccgcctcggcctcccaaagtgctgggattacaagcgtgagccactgtgcccagcccaagctgtacttttatttaagtataatttagttagatatgtgaactcactgaaaatgtatacacaattttctgtgtatgtataaaatttgatatttaaatgtatttatggcaagagtatctgtaacttttatgaacatatca

SEQ ID NO: 116648 - DNA, 523 bp, Homo sapiens
tggggtccctgatatagagcagaacacacataggagacgcctgtccatctgtctgcctgtctgtctctctgtccacctagtcctatgtccctgagtgggaaagatggccaggaggagctgacgatctgagcagagtctttggctgcacccatgctagggagacccaggcccatgacaaggtccaggagaccaccctggacctgaggtggtgggtatcggggccaggagagggagtggggatggcttccagcagcccctcccactgagcggcccagctcggagctgtgctggcattgctggggtgaagggtcatttgtttctctctaaattgctagaagaagagttgggatattccccttctctttcatcctgacttaacattttaaataaatgtaggtctgggtgtggtggctcacgcctgtaatcccagcactttgggagactgaggtgagcagatcgcttgagctcaggagtctgagaccagcctgggcaacatggcaagaccctgtctcaattaaaaaac

SEQ ID NO: 116649 - DNA, 401 bp, Homo sapiens
cctggtggcaggtggtgatttggtgctctcattgtaaccaatgtctgtgttcgacatgtcttcttgctaggcctcactgttctggactaataggaataatgttgcattgccattttttttttaatcctgcaattctagttttttattatactgattgtgacttgccctccccctcactccctggctttacccacattttcagggtacactgtcctatagtgtggaaatgaggcttatgttgctgtggagaggggaggcacccaggctgcagatgggacaaggagtgacagagcaagtcgggtgtcccggctgcggcacggctgtggggagagaactgtctggagaggagggccagttttcctcaccctcttccccgccatctcctgtggcagcacatggct

SEQ ID NO: 116650 - DNA, 377 bp, Homo sapiens
ctgagtttttgatggccttttaaacaagactccagtatgtgaaggttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcct

SEQ ID NO: 116651 - DNA, 837 bp, Homo sapiens
caaaaaacaaaaaagatattcactgtctatgcatcccaggatctccagaacaacaattaaaataaataaataaaaaagatggctgggggcagtggctcatgtctgtaatcccagcactttgagaggctgaggtgggtggatcacctgaggtcaggagttcgagaccagtctgactaacatggtaaaacctcatctctactgaatataaaaaattagccgggcatgatggtgcatgcctgtagttccaggtacctgggaggctgaggcaggagaatcatttgaacctgggaggtggaggttgcagtgatccaagattgtgtcattgcactgcagcctggtcaacaagagcaaaactctgtctcaaaaaaaaataagtaaataaaattaaaaataaagatattcactgaacctgttactatgatatatttaagcaagacacggtgaccctaaaaattagagatcattgaagaccaaagtaacaacatgtggtcattatttctcaaattgaagtatataaaatatataaaataagtaaatttaattgcatgcttaggtaagaaaatattgataaaaatgattgaatattttatcttatttcataattctaagcagggctttagcacaatatgaaaactagattattcatgtaatccaaataaaagacaatttttattctaattttaactcagaaattattttgcttatttaacaattttactgaaaggtaaatgagataaataggacagattataattacctaacattgctatggtaacttatgtacaaatagctgttcgtcaccgaaagtcaaaaaagtaaccagcgctgcaacttaag

SEQ ID NO: 116652 - DNA, 298 bp, Homo sapiens
tgcatgtcaaactgactgtggaagcaaaacaatcaagaaatatatttcttgagtattatttatttatttatttattttattattattatactttaagttttagggtacatgtgcacaatgtgcgggtttgttaaaatgtaactgtcgataatcatggcaaatattttgatatataaaaggtgattaacatgaaaaaagcctctgatgtttcaaatattttggttagatttgttttatgggaatctaattacacattaggtatttggagtgtaatgtatacgttttttgcataagtgaa

SEQ ID NO: 116653 - DNA, 212 bp, Homo sapiens
caatgtcttcctcttacacaaacacacattcaccctgtctctcactcacatacctactaaatagcaaatacttcaggctcacttcatctaacctgtgggtgtctgttagtcaggggaggcaactgctgttgcaaataattgccataatgtaaagcctcaagcagaatcaaatttgatttctcactttcctaacagtccagagcggtgtgcca

SEQ ID NO: 116654 - DNA, 295 bp, Homo sapiens
tagaattccagtcgataactactagatataaataacagttcaggacaggaaccactgaaaataaagtaataaatttaaattactctgattattagtctcattaaatggtcatatatgctattcttttaatgttttgtacactggttgagatagcttggtttctcttcatggttactttttgtttttaaatttgtggacagatattctggtaaatttctcacaaaaggcctggtttcttacatttttcagtgctttatagaaagtgccaaggcctatatgtccagtctattctctc

SEQ ID NO: 116655 - DNA, 202 bp, Homo sapiens
aggaggagttttaaaaaggaagcagcagagtcctgggtaatacctcagcttagacatttagatactgaaaagatgagctaacgaaagagagactgatctgcaacataggtaaggatcctgtcttattcaccttcatatctgaggcacatcaatggtactcaacagttgtttaatggctaaaagaaggaacagggaaatagga

SEQ ID NO: 116656 - DNA, 398 bp, Homo sapiens
gtgttggtggctggtgagcctgggctggctgtggggacccttcgcttacaggcaaggtgtgccctgggcagtgggcagagatctcaagagaagctgaaatgggggcagagcagcctgactcaaaggtcctgggggaagggggatggagaatctggttgcctgatgggaagtagccaattaggagggtcctgaggatggacgcagagggtgggaggtggagcctgcagagattccccagccacagttttcaaaaccagctgttgtctcgcaaggcactggcaggcaggcgcagggctctgcaggtgtgcaagaggttccaggcagctgctgggctcaccctcctaggaagacatttgtcccaccatcccatgctgaaaatgacccaaggcagggacccc

SEQ ID NO: 116657 - DNA, 583 bp, Homo sapiens
tgtgtcttcacatggtagacataaagagaatgagagagctgtctggggtcccttttaaaagcacactaatcccgttcatggggactccaccctcatgaccgcattacttcccaaagaaccccacctccctatattatcacattggggattaggatttcaacataagaatttggggaaacaggaatattcagtccattgcatatgcataaggacatctgaaaagtggactagctgctggatcatgtggtaggtataggttgaacattttcagaagctgcccaactgtcttccagactggctctaccctgtcactttaccaccagcagtgaaggagaattctagtccttcatatccttgccaagaccatgtggtcagcctctagacaaggtagagccgagctcggctctaccttgtctctcggctctaccttgtctctcggctctaccttgtctctcggctctaccttgtatctcggctctaccttgtctctcggatctaccttgtctctcggctctaccttgtctggggttaatcgtgtgaacgcggtggctggcacgaaattgacaagccgagacaggtagag

SEQ ID NO: 116658 - DNA, 380 bp, Homo sapiens
tgggcctgtgggcccatttgtgttatttttctgggaggtttcttccctttggactgagaaagcttacacaatgcctgtaccatcattgtaccttgaaagaaaagaactccgttttaaattcagggactcataggcagaagggactgtggccttatctcaaatgagactgaagtttttacatttggaatgagttaagacttttgcaaacttttgaagagttatgattgtattttgctctgtgataaagacatgagattgtggaatatcagggtcagaattatatggtttgcctgtgtgtccctatgaaactcatgtggaattgtaatccctaatgttgaagcaggtgacttaattatggacaggagtttggtggtggtgga

SEQ ID NO: 116659 - DNA, 250 bp, Homo sapiens
ctgtaatgctagctactcgggaggctgaggcaaaagaatcacttgaacctgggaggcggaggtttctatgagctgagatcgcgccactgtactctagcctggatgacagagcaagactctgtctcaaaaaaaaaaaaaaaaagaaggaaaatcaagaatatattggtcttttggtgaactagattagtgataatttaataatcatgaagttgtgaagccaggggcttttttttttaaactcttaattaat

SEQ ID NO: 116660 - DNA, 229 bp, Homo sapiens
aaaaaaaaaaaaaaaaaaaaaggcgagggtgtggggagagccttcttacaattagattggaaagtaaagaataagagcagatcactgaacaatagacactagatatgggtgttagctaaagagttaggactaaaggaattagaaaaaggagttcattgaaatagataaaagaagagagagctatatatttttttctttttctgatggagaaatcagaaaagttcagtgg

SEQ ID NO: 116661 - DNA, 301 bp, Homo sapiens
tgctgggattacaggcgtaagccaccgtgcccggcccttttttcctttttagtttatttttttcttttttgagacagagtttcgctcttattgcccaggctggagtgcaatggtgcgatcttggctcaccgcaacctctgcctcctgagttgaagcgatactcctacctcagcctcccaagtagctgaaattagttatcatttttgtatttgattagttcactcattaaacagatatatttgagtgtgttcttggccaaaggcaacaaacagatgagttagaaagaggcctggcctgagag

SEQ ID NO: 116662 - DNA, 361 bp, Homo sapiens
taaaaacctgtcacacgtgtacttaattttatacaataagcaacaaggaatgtttaatgtatattgtataaaaaatttttcaggccgggagtggtggctcacacctgtaatcctagcacattgggaggcccaggcgggcggactgcctgaggttgtgagatcgagaccagcctggccaacatggcaaaacgctgcctccactagaaatacaactctctagtggcaccaagcctatgggatgtgccagtgtggtcactgccctcccaattctcacttggaggggtgggaggtggtcagttatgtgtttattagctggctactcactgtctgattctactttgaactatattttcttttttga

SEQ ID NO: 116663 - DNA, 853 bp, Homo sapiens
gagggcagagcccccatgacctaaacatctcccattgggcccatctcccatcactgttgcattggagattaagtttccaatacatgaattttgggtgacacattcaaatgatagtatctgggccccacctcagatccacagaatttgatttcctggagctgggacccagaaattttcatttcaaacaagtttcccaggagatttttatgcacactaatgtttgaagaaaaatacatccaaaatgtaagtgcaaatcttagctattaggacatatgaatttaatatttcaaatctctttttccactggggataattttagaagcgatatttcattttaaaaacattgcttgataggaaaaattacaaagatgttagaacatgggtcgctgcataagtggtatttttgtggggagaaaagttttcaagtgaaagcagttttatatttgtgattaaattatacatcagatcaatgattggaatgggtttaggcagagtatttctcctttggggaagaatgaaagaatcatttagcattataattttcactcctctacaaaaaaaaaaatttaaattgaaatagaaaaatatttgattaagaatttatagatccctcctttcccaccaaaggatcctatttatagtattctttgacatataatcttcattgttcatatatataatcttttcagattttgtttaaaatctgaataaaactctcaagtgacttgaaattttatttcacattttaaatctagtgtttaatgctgtgctttctgctgtttaactacgagcaagtctggtaacagacttagggcctccagccataagggccagagaagagggaaatctcaag

SEQ ID NO: 116664 - DNA, 335 bp, Homo sapiens
ccaaagcgtggggagaagtatatctgaagatatctattgcatacatatgcacgagcagagaaaattgcactccgaaaaatctcagtgctgtttgttaggaaaggcaacattttcattttaagtactcagtagcaattgatgaaggtcccccccgacctccactcagagtgagttttcattttttgttatttccacagctgtacgtattttattccagcagatgcaaatagcacttccaaattggtcacaattaaagtgagtgcgaagtgtgagggagggtgaaggcttgaaaacaacaatcgctccctagagctgagcgatcacaaagctcatct

SEQ ID NO: 116665 - DNA, 271 bp, Homo sapiens
cctcagcctcccaaactgctgggattagaagtgtgaggcaccacactgggcccacgatgtttttagtggacaagtacatctctccctaaatacttcagcatgtatttcattaactagtgttcaatatttatttagtttcctttctgctgaagtaaaatttatatacactgaaattttcaaatcttaaattagcatcccctgagtttgacaaactgtattattaaaccaaaactcatcaagatatagaaaactggctgggcccagtggctca

SEQ ID NO: 116666 - DNA, 365 bp, Homo sapiens
aaatgctcattgctgctgagcatgcagagagaagacaggccccccttttacttctgctgggagcactaatggttttactgtgtggaggaagaaatttgataacatatagtaacagatttaacaatatttatgccctcggactctgtcatccgacttctaaaatccttctaaataaataacccaataaattttaaaagtctaggttctgggatatttgttgcagcattatttaccctatcaaagagttggaaacaacctaaatgaaccaaaataagtagtttactaaataattatggtcaaccatcccatacaatgtttggcagtcattaaaaaccgaactttaaagaatagacaactacatagtg

SEQ ID NO: 116667 - DNA, 417 bp, Homo sapiens
attctcaagggctgccacaaccaagtaccaaaagctgggtgacttgaaaccagagaaattgattgtcttgtggctctggtggccagcagtctgaaatggaggtgccagcagggccacactccctcctgcacttgtcggggagtcctgccttgcctcttcctagcttcctgtggtctcctggcagtcttcagtgtttcctggtttgcatacacatcagtccaatcttccatccaatccatggccttcttacctgtgtctctgtgactcggcgtgtcctctccttttttataaggacaccagtcattgacttaggccctccctactccaggatgacttcatcctaatcaacagcatctacaataaccctctttctttctttctttctttctttctttctttctttctttctttcttttt

SEQ ID NO: 116668 - DNA, 728 bp, Homo sapiens
ggtgacaggtggactgaggatagcaggcgcatgggcttggaggcgggacacgcgtcagtagcaggtggcggcggggctatggagctcaaggatggagcaaatgtcaacaggcacagatgatgggaggtttaactgacgctgctgcactggataccccaccccggtgccgggcacataggtgcagcctgagagtaagcagacctgggttggaaggtcccgcgattcaccaccgacaggatgggcggcttggcaacccccgacccctcgcaggcctgttcccttatccatgagatggaactcggacaaggtggccacaggaaggctttgcaaactgtgaagtgcagtgcctacgtgggcgtgccagtggcctcgccggagccggtagggaacactctgcagtccaggccaggccccggtaggacacccagctgtgcatcccgcccgtggccgcaaggcccgcaccttggccaacaggagcagggtgcggctggtgcgggcgtccgcgtggcgctcccgcaggtggaagagcttgggcgacatgatggcgggagagaagaagcgcaggcacaggaagctggtgacggcgatgaacggtacattctggaggggtgcggaagagcgcgggctggagtcccccagaccagggctcctgggcagccccctccccttaggctccgtccctgaccctcgccgggacaacagctccctgggtcctccccagcgctccc

SEQ ID NO: 116669 - DNA, 1888 bp, Homo sapiens
acaacatcagaaacattttacctagagtgaattctacatataatcattcagggggaaaaatgtgaaaccaagtaaggattataatacttagtttattcttctcctttggcaaactttataaaggctctcaaactttgctctgaaacttgattcaaaagttgaaagatccaagcctgagttatttttgcaactactctttttgcaacatcagggaatgtttctctgtttttaatagggaaatgttaaatttccctcttaatatttaattaattttaacagagcattaaaaaaggatcttaccgattccaaattggagattgcatctctgtgctcccacaaaacccctgtgttggtttctatcacaggacacattgctcttgtcttagtgtatcaatctgtgcccttgtttgtgccaagtaccagatgataaactcctcgaaagcaggaagagtgaggtgcctacctttatgtcctagtacccagcacagtgcttggcaggtagaagttattcactggatatgtttttgctgaatgaatacatcaatgaaaggagatgcagactttaaatctacggtataaaaagggttgtaaaatacagaagcaatacaaattaattagaaaataaagtgttgacacactggatcccatttaagtgtgcctatctccatttcatttttgaagttctttgggttttgcttgagatattcattcctcctttcccagaggttccctgctctccaagcaatctgagctggatcgggctgcgttggacaaggtgacttctaagctctattcgtacgttcattcagcaaatacttccaaagcgttttctccagacccccttgtgctactgaacggtgaacgctcatttgtaagaaacatgcatcagttacagcacttgaggatgtcactgtgcccattcaacaccacaaagagtaggaagccaggaagtaccaagtgaaagtgtggggctgtctttgcgtagtatcctgctttttatttcctgcaatgctgaacccctttctaatacattttctagcaaaatccatagttcccttctttgcattctcatgactcttcagtcatttgcaatcatggagcccttctcatgtgccagggactactctagtaagcattttatgtttttcattcgtttaatccttaaggccctttaattctacaaggtgagtgcagttaatatcgtgctttaaaaataaataaatgaagcacagagaggtgaagccacttgctcaagctgtcctgctggcaagtggcagagccaggatgtggagcctggcacctggctccagaatgcagtaccctgtgccccctctcttttgacagaggatgtgctttgttcaacttctaatctcaagcatctgccatgcatctgctatgaccctctcttggtggactctaatagaagaatggaagaagaagtcttcataattaagatattaaagaatggtttattctcctgctgttgtccctgccacattatttccattcttctttctgtagtctgtcctgacacccctatcttaattaagtctccccattatgttctctgagcatccagggcttctcttggtagcttttgttacaattaattactatatattaatttgtgcaacatctgcttgttgttgagtccgttttaaaccccaagaggacagatggggagcactggttgaccacgtagccagccctgcacttggctcagagtgggtactccgtaaagacttgtggaattaatgaatgagtcatcattgactttactatgtggccacatcatatcatttaagcacccacataattgcttatgaataacagctctctttcaaccacttagaggaaaagacacctgctctatgaggagaggaaatgc

SEQ ID NO: 116670 - DNA, 215 bp, Homo sapiens
gtcctggcatgatagggagagttcaaagcaagtatttataggttattagaattgattttcttagttgtgaaactgtcttgttccacagctcttggataagcacaagaatacagagagcatggtggagcttctggacttgtatcagatggaggatgaagcctacagcagccttgcagaagctacaaccgaactctatcagtatttactacagccat

SEQ ID NO: 116671 - DNA, 116 bp, Homo sapiens
cagaagtgtgcaggtgccagaggatgcaaatcatcttacacttttgcagcccaatgtcactggcaaaagaccttagaaatgagccataaccttcattttgtaggaaagaaaacaga

SEQ ID NO: 116672 - DNA, 334 bp, Homo sapiens
cggtgcagagagagtgagctgccgtgtggtgagagtgagctgccgtgtggtgagtgtgagctgccgtgtggtgagagtgagctgccgtgtggtgagtgtgagctgccgtgcggtgagtgtgagctgcggcgtggtgagagtgagcttactcaaacaatgctgagtgacagcgggcaggcacaaagactacaccctgcgtgactccacgcatccaagcacaaaactgggcaggaaagcggccactgctggggaagggaggagctaagaggggcgccgagggggctcatggggctgcttgatttgggtgtgattacacgagtatgtgcagcttgtg

SEQ ID NO: 116673 - DNA, 898 bp, Homo sapiens
ggaagagggcgagtgttttgtcatgatccattgatttgagggcttggggttttgctttgtcttcctctgaaccaaagcctagcacaaagtgaacccaagtgcggcaaggagctttaaattttttaaattttaagtgtgtttctggcagaatgagaggccttgaaaacctttctggttctcatcccgaagccatttgtttcagttgctcaggccttgggctcaggagaggcttaaaataactcgccttttctggagggtcctaagacatcaggaagcagtgctttagggtctgcttagcaaatggatgttccaccgtctcccagtgctccccagtcagggcagagatgtttggggccaaggagagacgagccaggctctcccgtctcatttgtccagggagaattcagttgagttgcagggagtttggtggcctcccctgggaactgatgaaggagagcagtgtttccagggatgtgagtgtggtggggagccctggctgcctagaaacaggcctctctttgcttcactgtgttcaccctcatctagggtggcagagctggattgcccagaaggattcgaacataaacttgatttttccccaagtgccactcagggatgagaaagcagtggctctgatttcagactatctgttttctttctgaaatccctttgcaaggctaggcagtattatccctatttacagaggaggaaactatgggtcagagaggtcaagtaacttgtctgaagtcacacagccaggaaatggttgagcagagatttgaacccagcatcatctgactccagaattccttccccttctcctcttccttcttttacttcttcagctgctcctccctctccttttttcttcatcacccttaataaatgtgagcacagg

SEQ ID NO: 116674 - DNA, 620 bp, Homo sapiens
cacgaggcttcgcagaccctccacaagggtccccacgacgctgggcgtctgaggcagcagcacacaccagcaaggggtcactgggcccaaggggtcgggggagggtccaccctgagcatcctcgctacagcttgacagagactgacttgacagagactgacacgagggggtgacccaccaggaggcctccaggaaccaaagggatccagcctcactcagcccctccttagactgcctgaggaagttccgcccaccagagtccaggccgtggcgtccccacccctgttccgtgggggagtctatccccgccgctgctccacgctgcccctccacatcgcggcttttgggatttggggattggttgtggatccccagctgctaatccaaagccgcttagagtcagcagacagcttaggcggggactcccgcgggcagggcggcaggaagccctcaccgcactgctctccaccccatgtgcatcttaagtccagaatccagcccctcgcagccccaggccaggctgtccggcaggggctccaccccaacccgctgagagtcccaagcagccaccagagcgacctcccccgtcagacggccgcccctacctccttgcctgccgg

SEQ ID NO: 116675 - DNA, 689 bp, Homo sapiens
aatggatacgtgaataaatgaacgaataaatttattttaagagttgattttggaaaaatggcaaactgcaattaatctcagtactttttgtggaaatacacagcttaataaaaagtagtttggatctcttcaaatgttttctctggtgttaaagcaatacaagatagatcatcattaaacaatgctgtttattccaggaagtaagtcttgatgcatctttaatatacaaaggatttaactcacgccattaattttctcgtttcaggctatgtgacccttttcttaactagatgaagaatttattttgcctgcaggcaaagagtaataatttgttggtaaggcttcaagtctggactatcatgaaattttctgtaaagtataaaaaacagaactaaatcacagagattagaactccttctagtgcttatcacggactgatgaaagctgtgataattaaagaactgagtgtggcataaaagtaggaagataaatggggcagaggggttggcacaaagtatgacagacccgagacaggcaatctgagttgggaagcccaatcttaaagcctgaaggagggcagtggtgaggggaagagctaggaagtgacagcactagggtagaaataaggcctatgaaaatgaatttcaggaccataacatatgaggatcagggatttaaataggcagggc

SEQ ID NO: 116676 - DNA, 589 bp, Homo sapiens
tcaaattttaaagcaactcttacaggcagctatacagctatttccttgtttttaaagatgaggaaaccaaggtacagacaagttcaataactagttccagttacacagtctgatttcatagtccatgcttttaactactgtaataaactgaatctttagccttcttgtttgagcttttgatatcactaatacctcttataagattacctcatttagaaaaattgccctgaatttgacatttgtttttgtttttagacagggtctcagagtcttactctgtcacccaggctggagtgcagtggcgatcatggctcactgcagcctcaacctccccaggctcaggtgattctgtcacctcagcaccctgagtagctgagactacacgtgcatgccaccacacctaactaatttttgtattttttgtagagatggggtcttgctgtgttgccctaggctggttttgaactcctgggtccaagcaatccacccgcctcagcctcccacagtgctgggattacagacgtaagccaccgtgcctgacgatatttgttacctatgttcatacacaaatccccttgaaacaccatag

SEQ ID NO: 116677 - DNA, 385 bp, Homo sapiens
acgctacccggcagctatatggctattgcccatcctgggcattaaactgggaatacaggaaaaagggaattatggaagaaattgttaactgtgacgcagatatcattagtcttcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagctgttcaggcctgactggtcttcctgcacttcctagtaagatgacattataccgg

SEQ ID NO: 116678 - DNA, 3697 bp, Homo sapiens
tcaaattttaaagcaactcttacaggcagctatacagctatttccttgtttttaaagatgaggaaaccaaggtacagacaagttcaataactagttccagttacacagtctgatttcatagtccatgcttttaactactgtaataaactgaatctttagccttcttgtttgagcttttgatatcactaatacctcttataagattacctcatttagaaaaattgccctgaatttgacatttgtttttgtttttagacagggtctcagagtcttactctgtcacccaggctggagtgcagtggcgatcatggctcactgcagcctcaacctccccaggctcaggtgattctgtcacctcagcaccctgagtagctgagactacacgtgcatgccaccacacctaactaatttttgtattttttgtagagatggggtcttgctgtgttgccctaggctggttttgaactcctgggtccaagcaatccacccgcctcagcctcccacagtgctgggattacagacatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatatataaccttattggaagtattaattctaagcctgtctctcaagtttatttatagagaaaaagtaagtaatctgtattgccacataccttgaaaatagaatgtggtatgtttaggatgcccacggaatgaatttttccttattccaattcaaccttctgtctggttgtgccaggaaaacagatgttatatgacctatgtcatttttgccattatagtcaaatgttaaaagaagaaaaaagtctgctgaataaaaaggccttgatcaaagtttcagatggggaaaatcatacagatattttatgtgtttccaacatagattatgtggctgttggtttcttgagatgacagtgcaaaggatttgggagagagaacaaatttggggcagtagttgaaaacgttgggtcattttcctgactctagctgccaaatggccatcatatgcttttaatctttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagaggga

SEQ ID NO: 116679 - DNA, 4762 bp, Homo sapiens
acgctacccggcagctatatggctattgcccatcctgggcattaaactgggaatacaggaaaaagggaattatggaagaaattgttaactgtgacgcagatatcattagtcttcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatatataaccttattggaagtattaattctaagcctgtctctcaagtttatttatagagaaaaagtaagtaatctgtattgccacataccttgaaaatagaatgtggtatgtttaggatgcccacggaatgaatttttccttattccaattcaaccttctgtctggttgtgccaggaaaacagatgttatatgacctatgtcatttttgccattatagtcaaatgttaaaagaagaaaaaagtctgctgaataaaaaggccttgatcaaagtttcagatggggaaaatcatacagatattttatgtgtttccaacatagattatgtggctgttggtttcttgagatgacagtgcaaaggatttgggagagagaacaaatttggggcagtagttgaaaacgttgggtcattttcctgactctagctgccaaatggccatcatatgcttttaatctttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagagggaaaaaataaaaaaaaatgggaaacattgtaaacagcttaagtttattttgtgtatgatcgaggcactctgttgcaggaaggtgtgtaattgggttctctctgcttcaaatgcgctctttcaaaccattcattatcctgtgtatttttaatgtggttttagtaaatgttggtagtagctctgttgaagtaggtaattgtgttatgttttgggtggtacacacttggggcatggtaacccaaatttcatgtgcacggtttccctttagcccactgcccaaatttcacatacccttcaccctttgttccctttgtaaaaggagtggtatctgttttgagctgccaattcagatgatcagaaatgctgctttcctcagcattgtcttgttaaaccgcatgccatttggaactttggcagtgagaagccaaaaggaagaggtgaatgacatatatatatatatattcaatgaaagtaaaatgtatatgctcatatactttctagttatcagaatgagttaagctttatgccattgggctgctgcatattttaatcagaagataaaagaaaatctgggcatttttagaatgtgatacatgtttttttaaaactgttaaatattatttcgatatttgtctaagaaccggaatgttcttaaaatttactaaaacagtattgtttgaggaagagaaaactgtactgtttgccattattacagtcgtacaagtgcatgtcaagtcacccactctctcaggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcatttctttgatgtaaggcgtgtgaacattcgtttgaatatcacatgttgaagtcaggtatggcacaatgggttctgagaccagcttttcctcccctcccatttgccttgttccaagctctttcttttcaaattacttttctgatattcataggcaggtatttaattttactaattagcatcctgtgtgaatgtattaaagaagccactgtgttttagtgtagttggcaaaaatataaaagctgtttcttatttgcccctatttt

SEQ ID NO: 116680 - DNA, 5013 bp, Homo sapiens
tcaaattttaaagcaactcttacaggcagctatacagctatttccttgtttttaaagatgaggaaaccaaggtacagacaagttcaataactagttccagttacacagtctgatttcatagtccatgcttttaactactgtaataaactgaatctttagccttcttgtttgagcttttgatatcactaatacctcttataagattacctcatttagaaaaattgccctgaatttgacatttgtttttgtttttagacagggtctcagagtcttactctgtcacccaggctggagtgcagtggcgatcatggctcactgcagcctcaacctccccaggctcaggtgattctgtcacctcagcaccctgagtagctgagactacacgtgcatgccaccacacctaactaatttttgtattttttgtagagatggggtcttgctgtgttgccctaggctggttttgaactcctgggtccaagcaatccacccgcctcagcctcccacagtgctgggattacagacatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatatataaccttattggaagtattaattctaagcctgtctctcaagtttatttatagagaaaaagtaagtaatctgtattgccacataccttgaaaatagaatgtggtatgtttaggatgcccacggaatgaatttttccttattccaattcaaccttctgtctggttgtgccaggaaaacagatgttatatgacctatgtcatttttgccattatagtcaaatgttaaaagaagaaaaaagtctgctgaataaaaaggccttgatcaaagtttcagatggggaaaatcatacagatattttatgtgtttccaacatagattatgtggctgttggtttcttgagatgacagtgcaaaggatttgggagagagaacaaatttggggcagtagttgaaaacgttgggtcattttcctgactctagctgccaaatggccatcatatgcttttaatctttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagagggaaaaaataaaaaaaaatgggaaacattgtaaacagcttaagtttattttgtgtatgatcgaggcactctgttgcaggaaggtgtgtaattgggttctctctgcttcaaatgcgctctttcaaaccattcattatcctgtgtatttttaatgtggttttagtaaatgttggtagtagctctgttgaagtaggtaattgtgttatgttttgggtggtacacacttggggcatggtaacccaaatttcatgtgcacggtttccctttagcccactgcccaaatttcacatacccttcaccctttgttccctttgtaaaaggagtggtatctgttttgagctgccaattcagatgatcagaaatgctgctttcctcagcattgtcttgttaaaccgcatgccatttggaactttggcagtgagaagccaaaaggaagaggtgaatgacatatatatatatatattcaatgaaagtaaaatgtatatgctcatatactttctagttatcagaatgagttaagctttatgccattgggctgctgcatattttaatcagaagataaaagaaaatctgggcatttttagaatgtgatacatgtttttttaaaactgttaaatattatttcgatatttgtctaagaaccggaatgttcttaaaatttactaaaacagtattgtttgaggaagagaaaactgtactgtttgccattattacagtcgtacaagtgcatgtcaagtcacccactctctcaggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcatttctttgatgtaaggcgtgtgaacattcgtttgaatatcacatgttgaagtcaggtatggcacaatgggttctgagaccagcttttcctcccctcccatttgccttgttccaagctctttcttttcaaattacttttctgatattcataggcaggtatttaattttactaattagcatcctgtgtgaatgtattaaagaagccactgtgttttagtgtagttggcaaaaatataaaagctgtttcttatttgcccctatttt

SEQ ID NO: 116681 - DNA, 4838 bp, Homo sapiens
ggcagtccagaactggttcagctgcttccccatttttagaaggttggcttttgccttcctgcttcttatttcatggtcacaagatggttattatttctccgagcactagctgtaaggggcaaggtataaaagcatgaagggatatatatgctgtctttgttaggtggggcctctgagaaactttttacaataatcagacttcttgtgtcttagtggccagaactgtatcacatggtcacttgcagctagaaaatgacaagggagacaatgcatgtcatgtttctttcatttaatatctttcagcatgatagtctaggtacctaaaattataataatgtaccttttagatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatatataaccttattggaagtattaattctaagcctgtctctcaagtttatttatagagaaaaagtaagtaatctgtattgccacataccttgaaaatagaatgtggtatgtttaggatgcccacggaatgaatttttccttattccaattcaaccttctgtctggttgtgccaggaaaacagatgttatatgacctatgtcatttttgccattatagtcaaatgttaaaagaagaaaaaagtctgctgaataaaaaggccttgatcaaagtttcagatggggaaaatcatacagatattttatgtgtttccaacatagattatgtggctgttggtttcttgagatgacagtgcaaaggatttgggagagagaacaaatttggggcagtagttgaaaacgttgggtcattttcctgactctagctgccaaatggccatcatatgcttttaatctttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagagggaaaaaataaaaaaaaatgggaaacattgtaaacagcttaagtttattttgtgtatgatcgaggcactctgttgcaggaaggtgtgtaattgggttctctctgcttcaaatgcgctctttcaaaccattcattatcctgtgtatttttaatgtggttttagtaaatgttggtagtagctctgttgaagtaggtaattgtgttatgttttgggtggtacacacttggggcatggtaacccaaatttcatgtgcacggtttccctttagcccactgcccaaatttcacatacccttcaccctttgttccctttgtaaaaggagtggtatctgttttgagctgccaattcagatgatcagaaatgctgctttcctcagcattgtcttgttaaaccgcatgccatttggaactttggcagtgagaagccaaaaggaagaggtgaatgacatatatatatatatattcaatgaaagtaaaatgtatatgctcatatactttctagttatcagaatgagttaagctttatgccattgggctgctgcatattttaatcagaagataaaagaaaatctgggcatttttagaatgtgatacatgtttttttaaaactgttaaatattatttcgatatttgtctaagaaccggaatgttcttaaaatttactaaaacagtattgtttgaggaagagaaaactgtactgtttgccattattacagtcgtacaagtgcatgtcaagtcacccactctctcaggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcatttctttgatgtaaggcgtgtgaacattcgtttgaatatcacatgttgaagtcaggtatggcacaatgggttctgagaccagcttttcctcccctcccatttgccttgttccaagctctttcttttcaaattacttttctgatattcataggcaggtatttaattttactaattagcatcctgtgtgaatgtattaaagaagccactgtgttttagtgtagttggcaaaaatataaaagctgtttcttatttgcccctatttt

SEQ ID NO: 116682 - DNA, 4534 bp, Homo sapiens
tcaaattttaaagcaactcttacaggcagctatacagctatttccttgtttttaaagatgaggaaaccaaggtacagacaagttcaataactagttccagttacacagtctgatttcatagtccatgcttttaactactgtaataaactgaatctttagccttcttgtttgagcttttgatatcactaatacctcttataagattacctcatttagaaaaattgccctgaatttgacatttgtttttgtttttagacagggtctcagagtcttactctgtcacccaggctggagtgcagtggcgatcatggctcactgcagcctcaacctccccaggctcaggtgattctgtcacctcagcaccctgagtagctgagactacacgtgcatgccaccacacctaactaatttttgtattttttgtagagatggggtcttgctgtgttgccctaggctggttttgaactcctgggtccaagcaatccacccgcctcagcctcccacagtgctgggattacagacatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatatataaccttattggaagtattaattctaagcctgtctctcaagtttatttatagagaaaaagtaagtaatctgtattgccacataccttgaaaatagaatgtggtatgtttaggatgcccacggaatgaatttttccttattccaattcaaccttctgtctggttgtgccaggaaaacagatgttatatgacctatgtcatttttgccattatagtcaaatgttaaaagaagaaaaaagtctgctgaataaaaaggccttgatcaaagtttcagatggggaaaatcatacagatattttatgtgtttccaacatagattatgtggctgttggtttcttgagatgacagtgcaaaggatttgggagagagaacaaatttggggcagtagttgaaaacgttgggtcattttcctgactctagctgccaaatggccatcatatgcttttaatctttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagtttttgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagagggaaaaaataaaaaaaaatgggaaacattgtaaacagcttaagtttattttgtgtatgatcgaggcactctgttgcaggaaggtgtgtaattgggttctctctgcttcaaatgcgctctttcaaaccattcattatcctgtgtatttttaatgtggttttagtaaatgttggtagtagctctgttgaagtaggtaattgtgttatgttttgggtggtacacacttggggcatggtaacccaaatttcatgtgcacggtttccctttagcccactgcccaaatttcacatacccttcaccctttgttccctttgtaaaaggagtggtatctgttttgagctgccaattcagatgatcagaaatgctgctttcctcagcattgtcttgttaaaccgcatgccatttggaactttggcagtgagaagccaaaaggaagaggtgaatgacatatatatatatatattcaatgaaagtaaaatgtatatgctcatatactttctagttatcagaatgagttaagctttatgccattgggctgctgcatattttaatcagaagataaaagaaaatctgggcatttttagaatgtgatacatgtttttttaaaactgttaaatattatttcgatatttgtctaagaaccggaatgttcttaaaatttactaaaacagtattgtttgaggaagagaaaactgtactgtttgccattattacagtcgtacaagtgcatgtcaagtcacccactctctcaggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcatttctttgatgtaaggcgtgtgaacattcgtttgaatatcacatgttgaagtcaggtatggcacaatgggttctgagaccagcttttcctcccctcccatttgccttgttccaagctctttcttttcaaattacttttctgatattcataggcaggtatttaattttactaattagcatcctgtgtgaatgtattaaagaagccactgtgttttagtgtagttggcaaaaatataaaagctgtttcttatttgcccctatttt

SEQ ID NO: 116683 - DNA, 530 bp, Homo sapiens
gattacttattgtccttatgttcagataatctcgccatgaatgataatatatgtgccctgtatttaaaagcagtaactatctaaagcagccctttactgacatgaaagactaaagaatttcatttcaaaagttgcttggtttcccaatttgtgccagctgccctcctgccccaaatgtgcctgtcttgaacttttgcatttttggaagcagtgtggggtctttgctgactgctgtgattctctacccaactcttagttatttaatacgttgtgttacttttgggctgggcccagtggctcacacctgtaatcacagcactttgggaggccgaagggggaggatcccctgagcccaggagttcaagaccagcctgggcaaaattttagccaggcacagtggcacacacctgtggtcccaactcctcaggaggctgaggtaggagggtcacttgagcccaggagatcaaagatgcagtgagccataatcacaccgctgcagcctgggtgacagagcgagaccttttcccaaa

SEQ ID NO: 116684 - DNA, 276 bp, Homo sapiens
tgttccttcttttaaaaacacttggagtggcatctgtgttcctgactagaacctcactgatgaatcttctactggagaaagaagtttcaaagtttcttaggccatagaacctgtggtagtgactcctggttgtcctcaatatataatccatctaatatgaatatttagctgtgattctgcctctcagcctcttttgtagtttagcatggccatgtgaacaagttctggcaaaagtgatggaatcagatgtgctggatggatgactctaaaccttct

SEQ ID NO: 116685 - DNA, 1107 bp, Homo sapiens
  misc_feature (132)..(132): n is a, c, g, or t
tgatcagccgggggaactctgtgaccatccggtgtcaggggaccctggaggcccaggaataccgtctggttaaagagggaagcccagaaccctgggacacacagaacccactggagcccaagaacaaggccngattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggagcagctgataacctcagtccgtcacaaaacaagtctgactctgggactgcctcacaccttcaggattacgcagtagagaatctcatccgcatgggcatggccggcttgatcctggtggtccttgggattctgatatttcaggattggcacagccagagaagcccccaagctgcagctggaaggtgaacagaagagagaacaatgcaccattgaatgctggagccttggaagcgaatctgatggtcctaggaggttcgggaagaccatctgaggcctatgccatctggactgtctgctggcaatttctttttttctttcttttcttttctttcttttttttttttttttttttttgagatggagtcttgctctgtcaccaggctggaatgcagtggcgcaatctgggctcactgcaacctccgcctctcgggttcaagtgattctcctgcctcagcctctggcaatttctagagggaggaatgggtgtttgagtgcagagacactggtctggggtgatccatggaggaccattaaaatgtgacacctttcctttctatta

SEQ ID NO: 116686 - DNA, 1255 bp, Homo sapiens
  misc_feature (132)..(132): n is a, c, g, or t
tgatcagccgggggaactctgtgaccatccggtgtcaggggaccctggaggcccaggaataccgtctggttaaagagggaagcccagaaccctgggacacacagaacccactggagcccaagaacaaggccngattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggagcagctgataacctcagtccgtcacaaaacaagtctgactctgggactggtgagtgaggagatgctctcagttatggaactggcacagagggtcaggtcctgtcaagatgatatgggtgccctggggagacatccaggggtcctgggtgatactgatctgccctgacctctgtgacctctttgtccaccatccccagcctcacaccttcaggattacgcagtagagaatctcatccgcatgggcatggccggcttgatcctggtggtccttgggattctgatatttcaggattggcacagccagagaagcccccaagctgcagctggaaggtgaacagaagagagaacaatgcaccattgaatgctggagccttggaagcgaatctgatggtcctaggaggttcgggaagaccatctgaggcctatgccatctggactgtctgctggcaatttctttttttctttcttttcttttctttcttttttttttttttttttttttgagatggagtcttgctctgtcaccaggctggaatgcagtggcgcaatctgggctcactgcaacctccgcctctcgggttcaagtgattctcctgcctcagcctctggcaatttctagagggaggaatgggtgtttgagtgcagagacactggtctggggtgatccatggaggaccattaaaatgtgacacctttcctttctatta

SEQ ID NO: 116687 - DNA, 186 bp, Homo sapiens
ccagggtgaggggacaggagagaagctggaacaagaagtaatgggctaggagagcaagggatgtggggggtttttgaagaaagccagaaaaaaaccaggatgcagctggtgccagagaagaaggaagggctgtcgggctagtcggggactgtcgggctagtcgggggctgtcgggctagtcggggg

SEQ ID NO: 116688 - DNA, 287 bp, Homo sapiens
aatacccacatgtagttgtttaccagtacattttgtgccttcctctcgattgttccttctgtaatctcatagtcatcttctcatttctatccatgttaccacagcagtctcctaactggcttattagcctccagcactcccatcctcagagagcctgtctatcttccaaactgttgagctaggctagtggtttcacctggggataattttgccccgaggggacatttggcaatgtttggttttagttgtcataactagggtagggtgctactagcatctagtgggta

SEQ ID NO: 116689 - DNA, 531 bp, Homo sapiens
gcagagaactgcttgaacctgggaggtgggtgttgcagtgagctgagatcgcaccactgcactccagcctgagcgacagagtgagactccatctcaaaaaaaaaaaagaaggaaagaaaagaaaaatttcaaacttacatagtgaacaatacaataaatcttcacatatgtatctatgaaccagtttaattaacttgctcatggctgtttcatcaatgaccttaccatgagaagaaattttgaagtggaataaaagattcaactaacagaaaaatatatgagacaccattgactcctttttccacgatgagcatcacttattgggctgggcatcacacgagacctactgaataagaatctcgtaggtgggcccagaaatctgtcctttatgaatctctgatttttgtttgtttgtttgtctgtttacttttcttttttcactccccatgatatagagcttgaaagaatctctgatttttgtatatactaaattagagaagcactgctcagactacggtgcttggcagcatg

SEQ ID NO: 116690 - DNA, 337 bp, Homo sapiens
gtccaggacagtgtcagggcagggccaaggcagggtctgggccatggtaagatcagcaacagggctggggctaggccagtgacaggaccagagtcagggcaagggccagagcagtgcaaggccagggtagggccaggcatttcagggtcagggccaggggagaaccagggcaagttctcaagcagggaatggccagggccaggacaggtccagggcagggccatgacagggccaggggctgcgttagggcaagggcagggccacagcaaggtaagggtcagggccaaggccagggtagggacagggcaagaaatatggcatgaccaggggcaatgcc

SEQ ID NO: 116691 - DNA, 731 bp, Homo sapiens
agcggcctgtgaagaacattgtcattatatgttcttcctttatgatgaaatgtgcctaagccattcttagcaaaagcagggatgattgctggatgtgtgtgtgtgtgtgcatgcatgcgtgtgtgtgtgtgtgtgtgtgtgtgtgcacgcgtgctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcattttttttttttccacgagagagagattaagagagagagagacagagagagagagagaaagaacgagggtgacagagagaaacagagatcgggggaggagggagagcgagagaactggaaacaaagactcgttgtctctaagctggagcaggcaggaaaccccaatccctcgggaacttagccagcccgccctgtcctggagtcagactccagctctctgaattcaatttgacagcttgtctgggacactttctaagtaaccattatccttcctttctctaagtaaaaggactgttatttcttttcgtgggtgtgctgtgcgaactgctattgcacacgtgtggctcacacagtgactaggacacactttcctcaaattattggaaacagcccgtttcctaagacaagtgtaaatttgttccaggataa

SEQ ID NO: 116692 - DNA, 370 bp, Homo sapiens
aagcaagacacactctctctctctctctctctgaaacaagaaactctctctctctctctcacacacacacacacacacacacacacacacacacacacacacacacacacacaccccctatctccctttcctgccttattttcctccgtcacacttatcactaatacactgcaatggtctaaatgtttctcccaacattcatgtgttggaaatatatttcccaatgcaacagcgttgggaggtggagcctaatgagaggtgttgaaagcatgatagtaaaagtaaaatagtgcttatcggagaaaacattcacaagcagagaagtggcagagtacacatgatccatgtgccttattagcccacagagtgg

SEQ ID NO: 116693 - DNA, 827 bp, Homo sapiens
ggcccaagagcggaggtagagggaacgacgcatgcttgagaaatggcgggaaacagaggaggctcgaggcttgctcacacgcacacagccaactgcttctggaccgccttgctcacacgcacacagccaactgcttctggaccgcctgaaaggcaacctcgcccgccgcggtggtgtggggcgggcatcccttgagactgtgctctggaggcctggagaaacagctttctatcctcagcactggggagagcaggcctcaatccctgcctttgcctgccgcccctcttccttccctctcaaagcatacccagcagccccggcgctgagaaacgcgttactctcttatcagctgtgggagagacaagacagactggcctctgggcggaggggccgccattgcctgccctctggaccagggcctcacagataccctcagcttcaggattagggctgcgttggtttttccccccacatcaggggacttcaacaagtaacctccagttccatagataaaacttgtattccccccttctccatggcaggggttttgagcctagagaaggaagatcggagcttcctggggctcctgtgaagcaggcagggggcagcactgggccccgggaagaggcggagaaggcgagggagtgcctgcggtgagcccagagccttgggcccgttatcctctgatgctgctcccccaactttcctgccgtcagtccctgaccttgcctgagaccttggcggctcccgcacctctctcccggctcctccttgctgagaacacaacccgcaaggcccttccgcctggctggactgagtcccctatg

SEQ ID NO: 116694 - DNA, 840 bp, Homo sapiens
tgcccataggggatgcctttttctaattctcacaaggactagcaccatacgagagattcaaattgtcactgcaatgctgagcctagtaacagcagttccctgatattagcatctcttgtgcaatccacaaaaccaaacaccctggctcattctgatcattacttctttccctcttgctacattaaatcatttataagcctgtcatgaaatctctgtgttctaagttcagctcagtgactttgtgagctggaaactctctgctcctgcagattactcttttctgctgtctatatctcaagagactgaccttcaagggtggcattaaacaagcttacttgcctctgacttccatctggtttggccaatgagagatgctggcagaccagtaggctgccaggtgggctagagcaaagatcaattaacacttcctccctgtgggccacaggttggcagtgtccatgtcatgggctgaattaagtccccccaaattaatatgttcaattcctaacccctagtacttcataatgtaactgtatttaaagatgggaccttaaaggacgctacccattttaaaatgaaacatttagtgtgccacacctatagcaaactacgcggtgtgactatcactactcggaactgtgcactcccgatccccccacaaaacgttattccttcgcaaagatcgttatgactaatgtcttataaaatagcaacctgccacgtaccactcctaggcctaaacgagagacccactctctctaccctccgacctgtcctactcatctggcactacacccacacgctggactacaataagacactaattcagaaaacaccctc

SEQ ID NO: 116695 - DNA, 340 bp, Homo sapiens
gctgtacatctggcctcaaaaatgttaaacgtatgaatcaatagattacagcttaatacagaaagagcgtggtatcaaccaaactagcaaagaaatgaagacagcattggtgaataaaacccactaaatggtgagccccaatgtcaccattaggcattcccaattcctttatcgtcatcaagtatgttgccttccaacccagaagcagttgacagatttccattttaccacattttcctccaaacatgactgggggaaaggcaagaccaagaactggtaagagagtgtatagatacagaaaacccaaatcttaacaaagcactgaggcactggtaactgt

SEQ ID NO: 116696 - DNA, 369 bp, Homo sapiens
cttgaatattttccattcccatttggttgaatctgcagatatggaacctgcaggtatggggagggctgatgtacattaatctctggaaattctttacaaccctggtcagattcatggtcataaactgaagcctttggcctctagcctgttagcttgttgctgggattggagcagcgaaggtggtaaggtgcagggcatggttaccagggttgtgaatctgggtggtatttgggtgaatacacatgactgtatacagtcccagctattgttctttccttatttaaggcccctttcctttaccctctctataccttgagtttttacagtctcccagaaagcttgagattgacagttcatgcaaatattcca

SEQ ID NO: 116697 - DNA, 392 bp, Homo sapiens
ttcctctgaggactgcgttttaacctgaacgtttttcttgcctgtctgtttatagaaaacaaagccgattccctgttgcgctgttggagactgtggagttcttagtctctgcttatcagttgggttttcagccaggtaaagagtaggggtagtccagtcggcttcacatttcccacgtgtaataacagttactaggctagggaagtagtagccaccgagcttgggagcgaagtgctgtgtggaggcaggaataccctgtgactgacttctctgcagagtagtgaggatcacatcccctggggacaggcctttggggaggctccacaaatgtcttctcaggaggaagtcttttgacctacatgaagtatatactagggacatagggagatgtt

SEQ ID NO: 116698 - DNA, 485 bp, Homo sapiens
acccacatcttcgaaagtgagggaagaattcattcacagctgttttcttttttcctcgcgtagcgtgtatcatttctttcctaaggaaggagttttacaagtagcctcctgccagcttcagctcatataggataaaagccagctcaaatattttggtagataactccggagactcagaaagccaactgctgaacttgagatacagtttccagtttgagagtggacaggctgcgagtgtttgaggccctgccccctgcctatctgctgcctgccctctctcatccaggtgtccatgcagcagggggtttcacagcagccactgtctgactggcttgctcctgcatttagcccactctgatccattccccgcaaagcaagcagactgcatttcacctctcagtcaggtctcagtccttgcccagaactctctaggattttaggcttaactcagaatatagtccacatccttaccaaggcctgcttag

SEQ ID NO: 116699 - DNA, 344 bp, Homo sapiens
ttttaaaaccatgatgttttaacttgtgatgctttatgaatatctgttgaatatcttctctatgcttataaacagagaaagcctttgaagcttataatgcaatggaagatacttagaagtaaacaaaatagagaggtatatgtagattttcttaggtcattagtttgtgtctttgtctggtaggctgaaactactgtcatatgactctctccctggccagattttaatagtcatactaatactgatgtgaatcctgataattaaactatcttgtcattacatttgtagataaagttttggttagaaatgattttgtatgtgttaggtatggtaatacagtctca

SEQ ID NO: 116700 - DNA, 358 bp, Homo sapiens
ctgcatgtgaatctagcaaactaccgctctgcatttccctctccttgtctagcagcaggactcagggccacacccccgcgggctcgtattccttcattcccacatctcttcaatcggctccaggatgccacctgctgaagtcagaagcccttctgctatcaggtgccattgaggagcatcactccatcctcaacagcaccagctatggacctaaaggtttcagggattctatgaccccaccgtctctcacaaagttgtccaagtttcctactctacatctaccagctccacctggctacctctgctcagtagagttatctatgtctcacttgtttaccaatctttggtcaaaagtgtg

SEQ ID NO: 116701 - DNA, 495 bp, Homo sapiens
tgtcatgactccacatagcccaagtggttcttgctactttcccatagatgcccttcctctccattgcttttcccctgccctgcccgttcctctgttaactctgttgcagtttctcctgaatgaatacctcacgtaattagctataggtttgggtctgtttctctcagcacttgggccgctggatccctggttaataccctgatcccttttgtgggagaatggaggaaagagaaaataaggtcatctgggagagcaagatgaagggctttgaaactagtgaagaagaatgtgtttaccttttctcccttgtgaccagttcttcagccctctcgacaagttcatcgcaggcatcccctggaagattcatcactgccctagtcccgcacatctggtctctcactgagttactgctttttgaaaattcttcagaatgtctactgcatttcaccctttcctctccatcccagtggctgtggctcaagttcactctgcaat

SEQ ID NO: 116702 - DNA, 385 bp, Homo sapiens
ctataaatgccacactaatgtgaagattcagtattttttagttaagacatagttcattcaattggattctaatatgtggtctcttagtttatactctgatctaatgcagtggctttcggactttaggatgcatgagaatcacctggagaacttcttaaaacagactgctgggccctcctcacagagtttctgattggtagatgtgagtaggagccaaaagcctgcatttccaacatggccctacatgataccatgctgctggactgagactgcattttgaaaaccaatgaactaacagacacattaagacttaaaagagaggccaggtgtggtggctcacacctgtaatcccagcactttgggaggccaaggtggatggatcacc

SEQ ID NO: 116703 - DNA, 468 bp, Homo sapiens
ctgcactgcccatacgaagcaaaatccctccacccgaatatttgtgaccacaatgatagatgaaagtaccaaacaggtacaacttcctgaataactagtcctacacctgggcatatgatgcaggcaaagagaaatacacatcacatcaaaagcagttcccacccctacctatgggtccaagaccacaataaagctcattgcttcaattcaaacttcagctcctccacttacttgctacatgaacttgggcaagtcattgagctacctgtgtctgtttcctcatatgcaaaacgtaggtaataatggtacctacctcaaagggttgatatcagaattgaatgggttaatacaggtaatgagacaagtaaaggcaggccgggctcacagtagacatcatgtaagtagtggctagcaccctcatcctgccctcgtcattgtcttgatatgattgtcatcttgttgcttctc

SEQ ID NO: 116704 - DNA, 743 bp, Homo sapiens
cagagatctgctgtgattattccttttcacaaaccacaatgactctggaaaacctggctgtaaacaccagcactgccaccagctaaggatctgtgatcaggagtgccatctcacggtaacaggcagaagacaaaagtgaaaccgggctgatgcgaatcactgggaaactggctttggcacctccagagaatgaactgtttcatagcctagctgaccatccatgaaaatggctgcctggagaggcagtgatcagcccatccctgcagggtgaagataagcttgtgcaggccactggctaacacagttcatcccatgcctcctacataccaagcactgtgccaggcacttttcacgtctggcatcctcagaatcctccaaaaggtcggattcagacaatccggtggagcactctgaaatttagaggaagtggtcaaatagaattttctggaattatggaaatcttctattctgtgcatctagtatagtagaatctagtcacatgtggcttttgagaactggaaatatggctaatgcaacagagaaagtgaatttttacttttgattcatttaaatataaatggtcacatatgacatcactgccatattggacattgcagttctggaagatggcagatgcagccctcagaagaattatcagcctgaatgtctgggcggagcagagcactaccttcccactcactcttcccctcctctcgccccctcccctgcctcacttgcatcag

SEQ ID NO: 116705 - DNA, 477 bp, Homo sapiens
acattttaaagatttaagtagatagacaaagcaactagggtgtatcaaagatctctttcatgttgtattagtttgctggggttgctgtaacaaagtaccacaaactgcatggcttgaacaacaaaatgtattctctcagttctggaggctagaagtccaagatgaaaatgtcaacaaggctgtgctccttcggaaggcattagagacactctcctagcttccagtggcttgctggcagtctttggtgctccttgtcttgtagacgtaccacccttatctccgccttcatattcacatggcattctccctatgtgcatgtttctgtgtctaaatttaccctttttataaagacagcagtcatattgaaaaaaggaacccagtctactcctgtatgatttcatcttaactaattacatctgcagtgatcctgtttccaaatgaagtctcattctgaggtagtggggggttagtacttca

SEQ ID NO: 116706 - DNA, 789 bp, Homo sapiens
cagccgttgctcagctcttccagcccgggggttggggctgtggtggaaacagctgggacttctgaatagacaggtctaggcttcagtccttgactttggcagctgtgtttagagctttgatttctttttacttttcttttcttcttccctgcctcccctccctcccccctccctccattcgttcgttccttccttccttcctcacagcatctctgttgtccaggctggagtgcagcggctcgatttcgtctcactgcagccacgacttcctgggctcaagggatcctctgtcctctcagccttctgagtagctgggactacagacgtgcaccaccacgcctggctagttttttaaattttttgtagaaacggggtcttgctatgatgcccaggttggtctccaactcctgggctcaagcgatccgctggcctcaccttcacaaagtgctgagatttcaggcttgagccactgcacctggcctagagccttatctccctctctgtcaggtgagaatggtaattcttcttgcccactgttgtgaaggattcaagattgaatagttaaatggtctcagtgtggtctgtggcgccagctgcagtgtccctgtgttccccggaccgttcccctagttcattctttcatctattaatttacttggagaacttgtgctgtttcctggtcctcctccctgccccctacttctctgccaattcctgcttgtccttcatgccttagatgtcacttcctctgggaggcctccgctcctcctgggactgacatggacccct

SEQ ID NO: 116707 - DNA, 804 bp, Homo sapiens
gagttttgtggcatcagagacttccttgggaattcaccgaactttgttttggggactttagaattgtcacaaatagcactatctctgaaaatccctaagggggacagacagcccctatcaaatataaacatgaattctggctcacataactgaagtccagcattggttagcttcaggtaacagcttgatctaggtgacacgatgtcctcaggaccctgtcccttttcatcccttggctctgccatctttcacagggtcttggtgtgttagcaggaaggaagccggtgactccaggccttcctccaggttcaaggccagcaaaaagagagaactcttcctcctcctctccgcatttctagccccaaactgcttttcctcctcaccatgagtgggcccatgcctgtcctagaacctgtcattgtggccggagtagggggtgtattgggagtgcgtgaagctgggccctgctttttcctggagctggcacaggggagcccaggggcttttctgcctctctgtcttcagttttgcataataaacttttctctttcacgctagcttgaagtttacaccaggggcatctgatgagtaagaggtacccactgccccctggcaacttgtgcggggtgtattagtttgttgttttgttccctgcagctttgggtgagtgggaaggtggacagtcatcaggagtgcacctgcaggcctgaccgccaggctccctcagcccccgtcctgggaaacccagcaccaggggaagcgctcttggcaatccgggtttgcctcttctttttcagttgaggg

SEQ ID NO: 116708 - DNA, 433 bp, Homo sapiens
taaatcccattcaacctcaccaaataaagatcattgccccaaaaccgaatcctctcttctgcatccccctctaagtgatctctcccagtcctggggctttaaaaactatacacttacaacacccacattttaatctccagacccaacctcttccctgaatgccaaataaaactggcatacaatttaactaatttcctatgaagcaccttcatttggatgtgtcattggcatctcaaacttgacatgttcaccaatcaatacacagtattcctcttattcatggtttcattttccttggttttagttacctgcgattatctgcagtctaaaaatattaaattgaaaattccagaaataattcctaagttttaaattgtgcaccgttatgaatagtgtaatgcagtcttgctccatcctgctacaccccactcag

SEQ ID NO: 116709 - DNA, 501 bp, Homo sapiens
ggtggtacagacaccaccacattgggccatcaggcacaaacctggactctgccactatctgcacatgtcatttggagggggaactcagcctccctgagtttgttttcttacctgaatctggcaaaaagaaaaaaaaaaaatcaatcatacatcagatattgattaaacactgtgacaatccagacagaatcagtttttaaggaaacatagtgtctcttcctctaggagctcatgataaagactggaatatacagcatgccagagtggtatgcgtgggtcagggacgggcattttacagagggcccagggacgacctgaaaaaggaggtgatttgtgattaaagacctgaagcaggggaaggagggagcgctgtggacatctggggaaagagccctccaagggaaggaatgaccctgacaggaacaggctgggtgtgtgggagaaacagtgtgatcagagcagggagaaggagaggcagtaggaggagatgaggtcagagag

SEQ ID NO: 116710 - DNA, 758 bp, Homo sapiens
ctctcaaatgtaaaactgttcagtccccccaggcccaaagacaatcatggaagaggtgggcgtgtgagattataaggaccagattttgagagataaaattaactgagatcctccaaatcaaagacaggcacatagatgcctaaacaaaatgtttgtgttttgtataactaattactacaagccaagattatagcaactcaacacacataagtcagttttataaccttattttttgacttttagttttgactcttatattgcttaaaagaggtttaagagctaataagtgtctgcccaccttcattcctggctggcctaaaacaattaattagctataagtctttttaactctaactcccttgaccataaggatcccaccaaagggacataatggacccggggcagatagcacaccaccccagcatcggggtgagacaagaggaaagcttggctattaatactatttctgtagtgccttgacaaaaagggaaaacgtaaactgaaaaaaaaatccatggcccctctacagactgagtagatcccccacttggccaaagggaatcccctccaaatgctaaaaaatctaattcaagcctgatgagaaataaagggtcagacacacctcactatgctccaaacccctaatgtttaagccaggatcagaggccattccaaattataaaaataaagtattgccctttccgatgcaaaaaagaatactttttctcttcaattgggagacttagccttactgggag

SEQ ID NO: 116711 - DNA, 595 bp, Homo sapiens
ggagagagagagaggaatctagatcctagaacaatgctgtggagtcagaaggctgtgccaacagaacctttagctactacttctttccacagcattgttctaggatctagattcctctctacttaactcggtttcattgcttcctataaattctatgtaaatctcagaccctcagtaacatatcccaagacacatgatgagcaacacttggtattcagttttctccagcgctgtgaaagagtcccaccaggaaacaataaggccttttagcctattaattcatgagcaatttgatgcctcttaggcgataagtgcaagttgagaaatgaatttcctgctgctaaaattccaacgctttagaaactcttcagtgaacaaataaaagtttattctttgcaataatgatggaaacaaagactttcataaaaccaaacaattgaaatgtcttgataaatgcctgcagagttggctaggtttctaaactatcaaataatgagtttacctcttcttacactttttcaagaatccattgaagaatcaagataggaaagagtatgattcttcatttttcctagccatgctccactgctctatg

SEQ ID NO: 116712 - DNA, 702 bp, Homo sapiens
actttaaaaagaaatgcagactgggcgtggtggctcatgcctgtaatcccagcacttcaggaagccaaggctgtagatcacttgaagtcaggagtttgagaccagcctgaccaacatgttgaaaccctgtctctactaaaaatacaaaaaaaattagctaggttttgtggtgcgctcctgtagccccagctacttgggaggctgagacagcagaatcgcttgaacacgggaggaagaggttgcagtgagacgaaatggcatcactccattccagcctgggtgacagagtaagactgtctcaaaaaaaaaaagaaaaagaaaaagaaatgcaattgtactaatgttctgcaaatggcttcttgtaattggagatattatttcctgtgatagcatcatacaaagatttaaaaagtattacatcttaaactgttcagatggaataaagatgatatactgtggtgggcaggataatagcctcccaaagatgtccccagaacctctgattttgctaggttacatggcaaaggggaattagaattatagatggaattaaggttgctaatcagctgattttaagattgggagagtatccggtttatccagttgggctcagtgtaatcacaagaatcattagaagtagaagctaggctagacgcagtggctcacacctgtagtcccagcactttgggaggccaagtcgga

SEQ ID NO: 116713 - DNA, 842 bp, Homo sapiens
ggagaaggtagggtgacatcagctgggtgatgtctgctgccctgtcctggctttgtctctttcctgggagccccctgtcatctctaacacattcgctttccctcaacttgggcattttactgggcagcactggtgctatggcctgaattgtggcctccaatgtttgtatgctgaagccccaacccccaatgtgattatttgtagggaggacctttaaggagacagttaaggttgaatgggttcatacgggtggggccctaagcccatggggaccagtgttcctatacgaagaggaagagaccaggagtgtgcagagaaaaggccatctgcaaaccaaggagagcggcctcaggagagacaaacccactgatgccttgaccttggacttgcagcctccagcactgtgagaaataaatttctgtggtttaaaccgcccagtctgtggtccttggtgatggcagcccagcaagctcatgtaactgggataccctagtgacccttttcatctgatgaactgcgggtgctgactttgtcatcagactgagccagaaacctggagcctgtgtgcaaggcactgttctctggggcattgcccagatctgtgtcagtggagacatgaggtggaggaagtgttgtgtatgtattcatctgggttcctatccttccttacctctatgtcctcggcacaccccccagtggctgatgtatgggaggcaccccaggttatttgtggaatgaacaaatgaatcacacagttgattgtgtctgcattggtcttcatgcagatatgccgtgtggatgtttagaaatccagtaggggagcagggaggctgggtgtggtg

SEQ ID NO: 116714 - DNA, 301 bp, Homo sapiens
gacagggtctcctgtgttgcccaggctggtcttgaacttaagtgatccttccaccttggcctcccaaagtgttggggttacaggcatgagcctggccattgggcctttttaataagggctctaatcccattcaggagggctctgccaccatgatctaatcaccttctaaaggccctatctttcaatataatcactttggggataggatttcaacatatgaatttttttttaattgggcctcactttgtcacccaggctggagtatggtggtacaatcatggctcactgctgcatcaaattc

SEQ ID NO: 116715 - DNA, 981 bp, Homo sapiens
  misc_feature (13)..(13): n is a, c, g, or t
ctagtcactctanaggatctccacactgggttcgagttcagagtgtggatccaattccagtgcagttcttaagagtctctgagaaaagaaaaacaaaatgtccctggccatgtggaaaattaatgtttaaaatttggggcttaggtaggaaggacaaagtaacttaccagcactcgtacggtaatgtggtagataattgaggcacttgtcaaaatgctcatcaaaatcaaatggatcaatgatccacatatctcttaactacagaaaggaaactgtttaattctgtgcccccacacaagaaaggctgaggattctattgcccttgtttgccttttatctcctcagcctcactgttctacctcatctatcttcataggagaatattcccagcctccctcctaaattgagttccaatggtcattggtttggccaggcaatatgtgaacactaccagagcattgcgctgtgtactaggaaggccttttcagaatggcagtacaggaagctagcctcctaccttcacagcttcatcctccctcatgattgccacttcaaacatatactgcttgcaaagcatccagcagttccaggataggacaatttcattcgcctgagccaaacgctgagctaactggacatcactacaacctgcccaatcaccaagaggtactgctgccgctcatctccaacaataacctgggaaatccgacttgcaggtagacctatccagaaaaaaatgagataaatggagaagagtcaaattcaactgggaaactatgcaacaggaggggtctggaatccccacatggctctgtgcatcatgcctatcttgttactgccctcagctgcggaagtcttaggtgagctaacctttaaaaataataccttacggccaggcacggtggctcacgcctgtaatcccagcactttgggaggctgagacgggcagatgacctgaggttgggaactcgaacccagtgt

SEQ ID NO: 116716 - DNA, 457 bp, Homo sapiens
caataatatgtgagatagcttccctagctccacaactttgcctacaatagtgtttatcacagttgattcttctttccaatttcatcattgtttaaggttttcccattgtttcttcccagaaattactttaagactataaacacttctcaaattgtagtttaactgggtatacaaccttccaaagggttattgaaagtgcatatttcttattctagggatgaattgtttgtgtctctttcccatgtgtgccaggaaacatgcaagaatatttacttcagcacttgtattcaaacgaagtaaataaattaaccctctaccagtaagatggtaatttagagatagctcgttctgacaagaaaatactgtctatcagtgaaaataaattcagttgatttacatgtatcgagagggataaatgtaaaaaaagataaggttaagtgggtggcatcgataaaca

SEQ ID NO: 116717 - DNA, 797 bp, Homo sapiens
agcggattctgaagtcagctacctgcttagcaagatgtgtgggcagaaattcatcccgaaagtgacgtggacagacagtcctccgatctatgctggaaatgtcaagggctctggagcttgaccacctgggttcaaatgccaccttcactcatgttaacagtgtggcttgggcaaccgactttacctctctgcacctgtttcttcaatgtgcaaatggaaagaacatcacctgcctcttaggttgttctaaggataaattatatgcaatgcacttagaatacggccagactaaaaggtcatttccagcatttacttttgaactatcaaggcctgattttgaaagactccggactccatgcaaagtgtcttagctacgagctgaattgtgtccctacccctacctttaaattcctatgttgaagtcaaccctcagtacctcagaatgtgactatatgtggagctagggtctttaaagaggtataattaagttaaaataggtcactggggtgggccctaatccagtgtgactggtatccttataagaagagaaaattagggcatagacatatacagaattgaagatgatgtggggatgcaagaagacagtggtcatctataagcaaaggagagaagcctggaagaaccagtcctgcaacatcttgatcttgaacttctagccgcagaactggaaaaaaaagataagttcctgtcatttaagcttttttctggcaggcctagcaaactaaaaccatctgcattagtcaaggttctccagaaaaactgaaataataagatga

SEQ ID NO: 116718 - DNA, 590 bp, Homo sapiens
gaaccagcagtgtcaaaggaatgcatagacaagctttataaattctataatgtttaaactgaaaaggactcctggaggtctgttttctaggctagtcttcatttagagacctgatttcccagaactttctggaggagccttgggaaacctcagctcaaatttcctgaaattggcaaatgccctcagagtcaaaatggcttcagccctccatttacatttatgggttctaattttcactttgatttttgcctcgcaattccttacagctcttcctgtcagctcttccatgacatttacctggagcagaacaccattcattcttagggtgggggtggggatggggtagcgttttctattataaacaattcaaacacgaaaagattatagaaaataataagatacacatctgtatccctaccagcatcagatacatgctaaattcttgccagattagattccagtatctccctcagtcaaggtaaacagttaattatttctactgtttcaacaatgtcacactacacatccctgtgcatgtcgccttgaaccacctatgcaagatgggcagctgaggaagggatgagcaatgg

SEQ ID NO: 116719 - DNA, 303 bp, Homo sapiens
ctggtacaggggcaggtggggagagaccaagacagaagataaggaagtcaagtcaaagcctgtatgtggaatggagagaattcccaattcctttttctttcaagcttctagaatgcctgcaaccaggcctttcccacaaaggaattcttggaagggtgctcattggggaagttaagcagcccctactggcccttgggtttacccaaccaaccagcctgaataaactccaacagtcaggactcccgccaggcatccgacgtctgtcagctttttggagcctcatttcaaacacaggcagctgag

SEQ ID NO: 116720 - DNA, 267 bp, Homo sapiens
agaaaaacacatttgtttttaatcattcctgagaactatattaaaatagcattcacaggccaggtgtggtggctcacacctgtaatcccagaactttgggaagcccaggtgggcagatcacttgaggtcaggagttcgagaccagcctggccaacatggcgaaacccaatctctactaaaaatacaaaaatcagctgggtgtggtggcacgcacctgtagtcccagctacttgggaggctaaggaaggagaatcacttgaacccagg

SEQ ID NO: 116721 - DNA, 669 bp, Homo sapiens
gcaacaaagtggcctaccactcccttttaaaattaacatctgataactaataagaacagagaaggggtctttggcaaattctaaaaaatctgccaaggagctccctccacccgccagatgagagaaggagcaaatgacttaaaaatcctctgtagagctcaaccctaagaatccacttaaaatacagcacttccttttcactctgaatatgtccttagtgctatatctgcttaagaatctggatctgcttaagaatctggatctgcttaagaatcatgaacgaggatctggaattttctctaagctggcacctcacctctcacactgcaggagccatggagaaaacagctctccatctattacagggcaagttgctacccaacaccatatctcctccaaccctggcccctaaaaacagcccatggaaagcagtatatggtttagcaacacattcaggatcctgggaccactggctataccaactcatagcctcctcaccagccaagagcaaacagaatcacaaccagccccaattccagggttactcgacagctttcctacgctaatcttattcctgaatctgagtcaacaatagtgatctcagtggtttggcaatttacccacttcctattggacaaggaaaagctattactaactccaccccactga

SEQ ID NO: 116722 - DNA, 144 bp, Homo sapiens
tttagaggatccaaggaatcgtgcatgtgctaaggatatgaagaaatatggaaggatacaaagatgattaagacatggcttagtgctggaaaaatgcagctgaactttcagttcattagccatgagtaattaagccttagactc

SEQ ID NO: 116723 - DNA, 616 bp, Homo sapiens
gaaggaggtcacagtggcctgctaggtcatggctctgtcctttttcgcttttcgtgtgttcatgattattgcagctgtatacaacaaatcttacgtacctttacaaaaccagtcttacacctgtatccctaggtaaaagtacagactggagcttgtatgcctagattgaaatcctgtctttgctacttaccatctatgcaactcgggacagcctgattaactgcgttgtactctagtttccctatctgtaaaatggataataacaacactgtctacctgatagcatggcagtgaggattacatgagttaattcacgaaaagctgatttgtaatagtgcctgttcctagcacgcagtaaatattgattattttcattattattattaaacgttccaccttgttattttacattcctttgtctttatagattattattcatttgaatgtctaattgtacatagttgcaatcatagtttatacaatctctggtgtttgtttgtttgttcttgagacagagtctccatgcgatgcccaggctggagtgcaatggcacaatctcagctcactgcaatctccacttcccgggttcaagtgattctcctgccccagcctcctg

SEQ ID NO: 116724 - DNA, 365 bp, Homo sapiens
cataggacacaacaatattgaaatttggccagctaataaccctacaatggcctctacatgttcaagtgaaagaaagagtgccatatttcactttaaatcaacaactagaaatgattaagcttagtaaaggaggtttgttgaaagccaaaatgggctattagccaaattgtgaatgcaaaagaaaagttcttgaaggaaattaaaagtgttattccagtgaacacacgaatgataaagcagaacagccttattgcctgagacgcaggaagtttcactggtctggatagaagatcaaaccagccataacattcccttaagctaaaacctaatccagagcaagttcctaactctattcaattctccga

SEQ ID NO: 116725 - DNA, 310 bp, Homo sapiens
ctcagcctcccgagtagcttggactacaggtacgagccaccatgcccggctaattttttgtatttttaggagagatggggtttcaccatgtaggccatctattgaaaaaacctggccaggctggtctcaaacttgtgagctcaagtggtctgcccaccttggcctcccaaggtactggtattacaggcgtgagccaccacgcccggccctttcccacttttggaatccacagtatcttattttcatctttatgtctatatttacctattgtttagaccccacttacaagtgagagaaggtgtgatatttg

SEQ ID NO: 116726 - DNA, 618 bp, Homo sapiens
  misc_feature (47)..(47): n is a, c, g, or t
attgagatgtagttatgaaagattagaattgccttaaaaaggggtcntgatagcagctatcaaagcaatattcaagcatgatttcaaggatgctttcaggtttagaattagccttccttgtcaaaaatctgcacaacttcatcaaaaacctgtaaaggaaaaagatgataataattttaaaagcaggtactgttaaaataccatacagctaagttcttattaaaaataatcgaatttggcggggcgcggtggctcacatctgtaatcccagcactttgggaggtcgaggtgggaggactgcttgagcccaggagttcaagaccagccggggcaacatggtgaaacctcatctctacaaaacttagctgagtgtggtggtatgcacctgtagttccagccattctggaggctgaggtgagcccaggaggtccaggctgcagtgaaccatgattgcaccgctgcgctccagagcaacagaccctgtgtcacaaaatagatagactcttactgcctgctagattgattgattaattagatagatagtgtcttactgcgcgccagggggaagcttgcaaagcttgtgccagtcagctgacagctgctgacttcaaaatgttc

SEQ ID NO: 116727 - DNA, 178 bp, Homo sapiens
caaccgaggataacatcataagtatttcaagccaaagacccttctacgtggaagctgcctgagctaaagcgaaggatggaaggagggtttggtcgtttcacctcctacattatcacttccattcagttgccaccatgtccttttaattccccctgacactgtgatagactgtctccag

SEQ ID NO: 116728 - DNA, 877 bp, Homo sapiens
gaaagtactgggattacaggcatgaaccaccattcctggccaggaaactgtatttgtaatgaacaccttaggtcagaatcagaggcgcctggagggctccttaagacacagaggagtgggctccattcttagagtctctaactgaataggtctgggtgaggtctgaaaagctgcgtttctaacaagttctcaggtgatgctcatgctgctggtctccaggacacactcggagaactgctgctccaggagagtcttatgaataccaaaatttgaaaatcagccgctgaaggaagatgtgacagaaaagtcctgtccccagaaaactgtccttttggggcggcttggagcaccctgtctgatctctttcaaaccacaacccagagagttggcattgtggaaactgcctctgcttaggaggcaggaacagaagcagggagctccccctccacaaatgtggccagctcttcagtgcttggtgtggtgcccacttcagactcctccctccactcagcagccatagatcacctgggctctgtggagctccttgccacacttccctgagctggtaccattatctggcccttggtatatgtgtttcaggagcaacacaaagtaggcccattggcctccttggtggattgggaactccttcctcccttcttgccctgtgcaactcatagtcattctttgggaacccgtaaccatcatcacttcctccatgaagccttcaaaagcagagttggttgatcccgctctggattctcattctgggcctcattacccgtgttagagctactgcattgtagaatataccattaacagctgggaggcctcccctctagactgcggcttccaggaggatggagcttgtgtgaaa

SEQ ID NO: 116729 - DNA, 639 bp, Homo sapiens
tccagaaaaattaagtccagattcacgtgtgcaaaatgtataaagctaatccgtagagttgaatgagctagagttctgtgtgttactgtgaatatacagggaaaaaaaaggctcagcaaatatggagaatttaaagaaatcttcacatctttaaaatttcatattttttcccacttaaatatgacatttaataataaaaatgacatactactcatatattcaacagcataatcagttctacaccacttaaaaataggttgtgagtaggtgtggccactaatctatcatcaaatatcagttgcaaagaaagaaatgaagagatatttgcccttttccctttatgatttatatttggcataaaagaattgttgaatttcttaggaagttatgataattgatgctaaataaacacatggattgcaaaatcattccaaatgtcaaataaaacatggtttaacaattttcatagaaacaagaccattttatatcatctattttgctaagtttaatcttccgggttacaccaattggaacagtaagggagtatcttttaagcgaaacaactgttccaaatatatcaactgtcatcatagaacgcatggtaaaggactcaattgtactggctgctaattcatcata

SEQ ID NO: 116730 - DNA, 485 bp, Homo sapiens
ttctccattagtttaagctaccctggataagtgactctgtttatgtcctccctatatttcttactcattttcacactaacataacacgtaacaaaattaaacataagctaaattgaagaagcaagtgagacagctaagagttttgtgtacttggacaacaaagctcaaagccactgtggttatctgtcctgttgggagcccctttcaaccatttttttagttgcctgtaagatttatttttaatgtttgcctgcataatgcaaaatacataagtgggaatccctacgccctttacagttaagtggattatggaaataataaggaaagtttatcaactaaggtaggaaatatcttctcatgtctgtatctggccttcagggacttaatgtgggtgaatatatgtcattagacaagatcctaatatagatggctgtatcctgcagatagccaattcaacattaaaattttatgtttccatacctcaa

SEQ ID NO: 116731 - DNA, 154 bp, Homo sapiens
ttttcacggcctaaagctgaccttgaccacaaagggggcgctcacctgggatgagaatggtgaccgcggcctgcaccgctcggcggatgatgttgtccatcgcgaacatccagtggggcctaattaagtggttcctcaaaattttatttaccta

SEQ ID NO: 116732 - DNA, 487 bp, Homo sapiens
acccgcaagcgcagcgcgcagccgcggttcccagccgtgcctccccttccacacctccccgcaggctgagggagccggctccggcctcggccatcccaggaaggggctcccacagtgcagcggcgggctgaagggctcctcaagcgcagccagagtgggcgccgaggccaagggggcgccgaggccgaggaggcgcctagagcgagcgagggctgccagggctgccagcatgctgtcacctctcacaacgatgctgaggaccagtttgagccatcatatgtcagggagaaaagaggaacctctggcaaggctatgcctgctacctgccttatgattgggcagaaactcccacccatggaagctgaaactagtttttagagaaaattttctttgaactggaggatacattgtgattttggcatctgtagctgatactctgcattgccatgaaccaagatgacagcctgttaaggcaactgtgcatgat

SEQ ID NO: 116733 - DNA, 258 bp, Homo sapiens
cctgtccccagaatcctctgttccttcagccagccaaacagtccccccagactccagcccaaggtgattaaagcaaagacatcagggggtccacagggtcagaaacatagatgagacctactagttccccaaacagaccctgaatcccagtttgggtccatttaactgcaggcaagagtgacacctgcagctaaactctgtgtcctgagtccctttcctacagctgtcttgtgcttgaccccttcctttactatatga

SEQ ID NO: 116734 - DNA, 443 bp, Homo sapiens
ggaggcagggcatctctggggatgatcgaccgcatctgctcaggttcttgcagggcagggcaggcagagatgtgtgtttggagccagaaagccttcctgcccaacctgccatgcctcagtttccctatctgaaccaccttcataaaaacaacttatggctctcagagcagcacatttgtaaaaacctgaaaaatataaagaaaaacgtcactcacatttctcccatgaacattttcctattttatgtatcttttatgtaactgaatcacattgcatatacaattatgtgttccatttttaaacaataagcttcccttgttttaaaagtaataatccatgtttattatgtgttattgcatagaaatttcagacacaaaaaaagaaaggaaaaatgactccttattgctccattgagaaataataaatatgaatattattctgat

SEQ ID NO: 116735 - DNA, 630 bp, Homo sapiens
gcacaaggggtcctgcctcccaagggacctccgggcggaagggcagacacggcagggaaagatgacagcggacagggcagaggaggcagccagcagacttcaggccccaggcaaaccacctcagctgtaccccctgcacagatggagagcagagaatgggctgggccaaggggcagccctgccctcaccagtgcggcctgtcttcagcctccaacccactgagagagagaatggagaggtcgtgggtggcaataaggcgcacacaacccaactcacatgggcaggacaggcccgggcaggccggtgatcaaactgaaccgcagcggctgaaattcccacagaaaaggccaaacaaacccagcaccccgcggtttccagagctgagcctcaaagaacccggcctgaaaaggttagagacaagcggatggagaaatatttgttagccaaaagaaaccaagggtagaaatacctcatgaaacactataagctctcggtcaaagaaacattaaacaaagagaaatatattatattttgataagagacctgatctaccaaaagaacagtcattaatttttaagctttaaaaaaaaacactgaactatataaagcaaaaaatggttattaatgtaa

SEQ ID NO: 116736 - DNA, 879 bp, Homo sapiens
atcatgtttcaacatagaaaaagtgcaaaaggtaagaattaaataagaaatgattccttttctcaagaaccagaagttagcatggagtcatggactcagcttgaatcagtctaaggacttaactaaagccagccctctacagttttatggagatatcaacctaccatttttcatgatttttctagcaatacttagctatctggtggtccaaggccaagaactagccatatactagccaaatacatcactagccatgtaccctgcattccacctgaaagagcttcagttttctcatctggtgggtagaaaatctttgctttctgagaaggtttgtgatggcacaaaaaataatcttacttttctacaacaggggaggaaggggttaacaaaggagatgtctgagtactgaaagaatagaaatttttcagatgggaactttggaaaacgtatttagggttgaagaaaaggtacatgcaaaggcactgtccagggaactggctttgctttgaggaactgtgggtagtctggaatggaagcagcagagggcacatgtgggggtacagaaaaaagtgagggtggagattaggctcaggccagatcaggcacagccctcaatgtcttttttcctttttctttctttttttttttgagatggagtcttgctctgtcacccaggctggagtgcagtggtgtgatctcggctcattgcaacctctgcttcctgggttcaagcagttctctgcctcagcctcccaagtagctgggattacaggcacccgccaccaggcccactaattttttcgtatttttagtagagacggggtttcaccatgttgaccaggctggtcttgaacttctgacctcatgatccacccacct

SEQ ID NO: 116737 - DNA, 228 bp, Homo sapiens
aagatcaggagcaagtcccttagacttaagaattcttaaaattttattgcctgtcacaaaacgtacttgtgcacaccatgtgaatctctcaggattacaccgatctgtgaaggagtaaggcccttcttggccagtttgtaaatctgctccttcacgtcgtcagatgtcaacttcaaccaagtggggacgctgcgtcgatagggtaaagccgactgggacaggcccttc

SEQ ID NO: 116738 - DNA, 652 bp, Homo sapiens
agcgggttagccaggatggtctctatctcctgacctcgtgatctgcctgcctcggcctcccgaagtgccggaattacaagcgtgagccaccattcccggcccaaagaggagaagaagtattaagtgcttgcttggacctttctactgtgcttattattctgtcttctcctcatggcaagtttccagcacaatgagaattgtactgattaggtccatgggcagaaacgcagccatgaaatgtggagcagaaagatttcttttttattttcatttattaaatacagaagaaatatttcgctgaagacacaggaaaccctattttgtataaacgagggattgcaagagattgttggaagatcaaagatgggtgaattggaggtaggtcaatgtttccttcccttcttagactccagttctctttaaaaatggcaactgaaaacctaaatactgacaaaggcataaaaataaccatataatatcaaatatagctatatactaaactttatgaggtcaaagactttgtccatccactcagtactgtatactcaatatctaagacaattcctgacacatagtaggcattcttgagcatttgctgattgaacgaaggattattcatacttttaatctttggctgaaattatttttatga

SEQ ID NO: 116739 - DNA, 1659 bp, Homo sapiens
ctcgacccccagagaccacttctcagagtctctatctgttcgtctctggtgttagccacgttcctttactttccctcatttctgtggccactcctgtggcttcctctctttcaacctgcaggctgctgctgccctgcctcagacccttgtaggcttctgtagagatgctactcagatgggggtggagctagatgcagagctgaaacccacctaggagatctagcttggagagcttgtgaatcttaggagagctaggcatagaatgactaaagtttgtcaccgcatgagataaaataaatgaaaagccacttctggagggaatgaggcagtctgcctttattggagagatacatattgttgaacagctctgggcagttgattgtgtgcctgggagagctaaccatgtttactctacacttgacctgtgatggtctgtattgattgtatcacacgcttagctttctaaggctaaccaggtcatcgtcctcagtccctgcctgcaactaggttgccaactggcccttgatttcccacccaacttgttcagtttgccctcaatcctggggcctcactaatttcccaaaaagatatggttggtaccacctgtagtttgctgttgcatgttaacctgacttttgggaaactcaaataaacacttttcaaacgcattgaccatttttactctatgacttctgctttgcatgatcgctagcttggtcacccatcatgctgctttctggtgagctgaaaggaaaataaatggtctaaattgagcaacaagaaagtaaacttttaagcaggtactttccaagtgaaatgagaaccggagattgggtccaaaagagaggatgcccagccagactgaactttcaagtgttttccaactggaaagctccaatgtcctctgatctcagtgaatttccaatctaatttcaaggaagtccctcaggagccccattgcaagggtggttatagaaccatttacaactgctttaataaaactaatgcttataaagaaagaaaacttgttttttagtcatccataacacaaaaaagtgaggtttgatgcacagtaaaaggaatcattatttaagttagtctgagttatattgtattttggaaatgctccacattcaatatttatgccacatactctaaaaccaaagtatgtagattaaaaaaaaactatttccagaaataagcttgctgaatcaccacaggcttaatttatttattttaactaccagtttcctgaatgtttttgtctaattggcctatctgcagttgcccttggtccacccttgagcccactctttaagcctgtctgtcacttagagaagtacaagtacttcctgctgagaataaagccttgatcgcaatttcagtgaattatcagggaagtgtgagaataagtaggaataaatgtctaaacatttgggaaaaacttgtttgcaataaatgtggttaacagagagtgaataggcttactacataaaattgttactcatcaattaaaaaaactgtacaatcctcctccgggggaaaatgatcagatattttaagtctgctgatatttttctctggatgtcagacctgtatactttgtcctgcattattggagtataattggcaaataaaagttttatgtatttaaggcaa

SEQ ID NO: 116740 - DNA, 1605 bp, Homo sapiens
ctcgacccccagagaccacttctcagagtctctatctgttcgtctctggtgttagccacgttcctttactttccctcatttctgtggccactcctgtggcttcctctctttcaacctgcaggctgctgctgccctgcctcagacccttgtaggcttctgtagagatgctactcagatgggggtggagctagatgcagagctgaaacccacctaggagatctagcttggagagcttgtgaatcttaggagagctaggcatagaatgactaaagtttgtcaccgcatgagataaaataaatgaaaagccacttctggagggaatgaggcagtctgcctttattggagagatacatattgttgaacagctctgggcagttgattgtgtgcctgggagagctaaccatgtttactctacacttgacctgtgatggtctgtattgattgtatcacacgcttagctttctaaggctaaccaggtcatcgtcctcagtccctgcctgcaactaggttgccaactggcccttgatttcccacccaacttgttcagtttgccctcaatcctggggcctcactaatttcccaaaaagatatggttggtaccacctgtagtttgctgttgcatgttaacctgacttttgggaaactcaaataaacacttttcaaacgcattgaccatttttactctatgacttctgctttgcatgatcgctagcttggtcacccatcatgctgctttctggtgagctgaaaggaaaataaatggtctaaattgagcaacaagaaagtaaacttttaagcaggtactttccaagtgaaatgagaaccggagattgggtccaaaagagaggatgcccagccagactgaactttcaagtgttttccaactggaaagctccaatgtcctctgatctcagtgaatttccaatctaatttcaaggaagtccctcaggagccccattgcaagggtggttatagaaccatttacaactgctttaataaaactaatgcttataaagaaagaaaacttgttttttagtcatccataacacaaaaaagtgaggtttgatgcacagtaaaaggaatcattatttaagttagtctgagttatattgtattttggaaatgctccacattcaatatttatgccacatactctaaaaccaaagtatgtagattaaaaatttaactaccagtttcctgaatgtttttgtctaattggcctatctgcagttgcccttggtccacccttgagcccactctttaagcctgtctgtcacttagagaagtacaagtacttcctgctgagaataaagccttgatcgcaatttcagtgaattatcagggaagtgtgagaataagtaggaataaatgtctaaacatttgggaaaaacttgtttgcaataaatgtggttaacagagagtgaataggcttactacataaaattgttactcatcaattaaaaaaactgtacaatcctcctccgggggaaaatgatcagatattttaagtctgctgatatttttctctggatgtcagacctgtatactttgtcctgcattattggagtataattggcaaataaaagttttatgtatttaaggcaa

SEQ ID NO: 116741 - DNA, 292 bp, Homo sapiens
gtactcagaaattagggtaagcctgagtccctgactctggacttgagtctttccaccagcccacagcacttttgatctgttccatccatatctttgagccatcttcccactggccttttcctacctatgccaacttagggctgaaacctgtgcacagaggacatactcagttgggccctgccttggaacatcttcccctgagtctgataaccctcattcactagtctcatcttcatagcttcttcttcgtcctcctcctcctcctttctcgttattttctaactccctgtaa

SEQ ID NO: 116742 - DNA, 397 bp, Homo sapiens
acctcaagtgatccgcctgccttggcctcccaaattgctgggattgcaggcgtgagtcaccgcgcccagccattattttgctcattcttagttaaggagatccttggtgctggatgctggaaaaagattgtgtttttcagcatctgcagcctgggctgttttccacaggaataaatacagttttttccagctccaagaagactgaattcattcaacagcaagtctctcatgtgctttactttttagtgatatgcaaataaaaaaaagtaagtggaccctcaatagtatcaaaacattgtccccacgcccttaacatttagaaagatgacccaaaccccagtccctagacagttgtcctaggcaagattttgttcttgggaccttatttaaatttgcc

SEQ ID NO: 116743 - DNA, 249 bp, Homo sapiens
aatgcagggctaatgcctgggtgggtcattgaacaccctggccacatgagttcctgcgtaggcactacagaaagagagatgaattagtgtagaccatgtcctcccagaaagagggtcagggacagggatatggtgacacaatggtgggtgagtgtgcacagttacaacagaatacagaaaagctgtcaggtgcctggtggggacacagaagactcccacaggaagggatgcttacttggggatttgaaa

SEQ ID NO: 116744 - DNA, 760 bp, Homo sapiens
atgagctatttaaatatatacacaagtctgttctggattctgctctacatgggcaccaggacagcaaaaaggctactgggaccacagcaatgtgagcaagaagggtaacaggaggtgagatcagagagggatgttctgtgtgtgtgggttggggggatatcacatacaacctttaaatgctcaatgagatgggagccactgtagggggttgatcagaggggtgacatgacttgatgagtattaacagaatcgcacagctgctgtgttgttctagggagaacagatggtgggggcaagagtagaagcaggagagtgtggaaataatccagagcagagaggacagctgcctgtactagggtgttggagacgaaagtgatgcgaagtggtcagaatctggatatcttctgagggtagaaccaatgagacttcctaatggcctggagtgtgaacaaaagggtgaggtcaagaatgagtgtaagggtttttgtctgagtaaatagaaggatggaatgactgttgcctaatgtggggaagagtatgggaggagcaggttttagggacaagaccaaattttagacatgtttaatttgagatttctctatggtatttgagtagagacatcaagtaggtagcacaagacacaagccttgcgtttaagagagacaccaaggccacggactatttgggtgtctttagggtagaaacagtatttaatgccatgtgattacagtagatcactgatggagggagcacagaaggg

SEQ ID NO: 116745 - DNA, 1523 bp, Homo sapiens
aaaagttatttttttactaaaccatttaaaccttaaattttatatttgttatactctgtgtaacttctaatcaagtaggtattttagatgaaacacattttcattatataaaagcctatataaggatgatcagaaaagacaaaaaagggaaaagatgaagaggcaaacaaattttagcaagaaacgataactgcaaaatcaatcccaaatcaaaaaactggcaggtttcctgtagttgtgctaaccatttttcaaagcaaatttctgttccttcaactttactcactttttatcaaaaaagtacagcagttaaggtttctgggctcactctaatctagtggtgaagcatactatcttttaagctctgcttatagttagcctactcttgtcagatggctattctatcagtaggtcattgggctaatattaggtccatggtagttcctgtagaccacatcctgttaatattttttctttttttggtagagacagggtctcactttgttgcagcaggctggtcttgaactcctgagctcaagcgatcctccagcctcaacctcccaaagtgctgggattacaggtgtaagccactgtatctcagcactacaatctatttccaaacatttttatcacccacactctgtaaccattaaggaatcactccccatttttccttcctcatcccattttctatccctaatcaatgacccattttttatacatcaagtcagatgacaacttctttgttaagctgaccctgacagaataaatcacctctatagtacttcttaatcctgtacatatattgatgattaaatttttacctcattctataactgggtttacattctttttgtctgaactatttgagggcaggatccaggaagcacaaacaatatgccaactatggttaaaaatctttatatccttcccagctagcacagtgcctaacactgagtaagcactcactacatttctgtccagttataatgaaaattattaattgtggtttggtataggcataatttggcaggtgttggggataacatctttctgctaaaaacactctttacctggaatgtttaaataaaaatttcataatttatttatgtttatgtatcctaagctctgaacaaaaacttttgtgatgtaaataaagcctggtaggaataatatgtatatcagaattggtcatcaaaacctctagtgtaaactaatttatcagattctttctccaaagacaggaatgaacaatttaattttgaaggtggagatggaaagagagaaggaataattttgtttaaaaagtagtacttccatgtacatattatgctactacttgggcagatagggagagattgggagctactcacaaagaattcttctcactttataattttctaggacttgtaatgaaccttataaatgttgtaataatcttcttcttatagtcaaaggcaaatgaatctccccattcacctacacataactcttaattatatcactactttcaataattgctc

SEQ ID NO: 116746 - DNA, 957 bp, Homo sapiens
  misc_feature (137)..(137): n is a, c, g, or t
  misc_feature (258)..(258): n is a, c, g, or t
agcgaggcgttctagaggatccctatcgccaaacaggactctcctaacatgtaggaagagtgagagcaaatctgacagcatggactcatcaggtatgaagatggttgggtgtttgtttgttttgttttgtttttttngagataggatctcgctgtgttatccaggctggtctcgaactcctgggctcaagggatcctcccacttcagcctcccgagtagctgggacaacaggcatgagccaccccacctggctggttnggggtttttttgttgggtttacattctttttgtctgaactatttgagggcaggatccaggaagcacaaacaatatgccaactatggttaaaaatctttatatccttcccagctagcacagtgcctaacactgagtaagcactcactacatttctgtccagttataatgaaaattattaattgtggtttggtataggcataatttggcaggtgttggggataacatctttctgctaaaaacactctttacctggaatgtttaaataaaaatttcataatttatttatgtttatgtatcctaagctctgaacaaaaacttttgtgatgtaaataaagcctggtaggaataatatgtatatcagaattggtcatcaaaacctctagtgtaaactaatttatcagattctttctccaaagacaggaatgaacaatttaattttgaaggtggagatggaaagagagaaggaataattttgtttaaaaagtagtacttccatgtacatattatgctactacttgggcagatagggagagattgggagctactcacaaagaattcttctcactttataattttctaggacttgtaatgaaccttataaatgttgtaataatcttcttcttatagtcaaaggcaaatgaatctccccattcacctacacataactcttaattatatcactactttcaataattgctc

SEQ ID NO: 116747 - DNA, 194 bp, Homo sapiens
tgtgtacggatgtggtggcaagaggactggacattcctcaagtcaactggattgttcactatgaccatccggatgaccctaaggaatatattcatcgtgtaggtagaacagccagaggcctaaatgggagaagacatgccttgcccattttgggcccagaataattgggttttcttctacttgaaacaatccaa

SEQ ID NO: 116748 - DNA, 467 bp, Homo sapiens
ctctagcagatctcttccttaagcccatggactcacaaatattttccactccaagtggtgaggttccattccactgcaccttaactgcaccccgtttcagcaggaagtacctagatggagcacatcaccccctttccatagaaatgaaatggaacttgacagtggggagttgtaaccaagagtgtcagctttaaaatgtattttaaagccttcccactagccttaaagtgtatttaaaaggtttttttcctttttttttctctccttccccctggacactgccttataccatgaccttatgaccaacttatacatgcttatctaactgtatgcttgcttagaaattccaggggctggccgggcgcggtgactcacgcctataatcctagcactttgggaggccgaggtgggcagatcactggagatcaagaccatcctggctaacaccgtgaaaccctgtctctact

SEQ ID NO: 116749 - DNA, 479 bp, Homo sapiens
actatgtcgatcgttaagatttacagattataaaacaagacaatttggccaggtgcagtggctcacgcctgtaatggaggccaaggcaggtggatcgcctgaggtcaggagtttgagaccagcctgaccaacatggtgaaaccccatctctactaaaaatacagaattacccaggcatggtggtgcatgcctgtaatcccaactacttgggaggctgaggcaggagaactgcttgaacccaggagatggagaccgcagtgagctgagatcgcgccattgtactccagcctgggcaaaaagagcaaaactctgtctcaaaaaacaacaacaacaacaaaaaagaatttaagccagagtgaaggtcaggggcaaggaaggaggtgggcaaggcaaccaggactgtgttcaaaggcatcgtgagctatggggcggcattgctgtcttaccctaagatgaggtctgtggcctgtgggagcagc

SEQ ID NO: 116750 - DNA, 386 bp, Homo sapiens
gggtctgacccagagaactgtattccagtcttggctcccagctgccatccgctctgcagcttcccctagtggagatttcagcacttgctgggcctgggccagaaccccaagtatataaaatcagagcatgaacatgactttgataaattaagaaggcttcattttaataccacagtaagaggaaccagttaatattcttaccatttcacatccacaaaaaccacatcaggggcattaacaatctctcagttttgtacaaataaaccatgtttctcttaaaaagacttgcacacgtggttcacgcctgtaatcgcagcactttgggaggctgaggcaggtggaggctgaggtcaggagttcgagaccagcctggccaacatagtgaa

SEQ ID NO: 116751 - DNA, 512 bp, Homo sapiens
agacagagaacaataggtgtttgtgttaaaaagtaatactaagctatggagaggtacaaaacaagtttttgttttttgtttgtttttaagacggagtctcgctctgtcgcccaggctggagtgcagtggcgcaatctcggctcactgcaacctctgcaacctccgcctcctgggttcacgccattctcctgcctcagcctccgagtagctgggaatacaggcgcttgccaccaggcccagctaactttttgtatttttagtggagacggggtttcaccatgttagccaggatggtctcgatttcctgaccttgtgatccgcccgcctcggcctcccaaagattacaggcgcaagccaccgcggctggccaagttttttttgtctgggggtgtgttgtagaaaaattgaattcagattacagttttttgttttttgagacagcgtctcactctctcgcccggactggagtgcagtggtccgatctcggctcaccgcaacctccgcctctcagg

SEQ ID NO: 116752 - DNA, 642 bp, Homo sapiens
gctcggtacccatccttccctctctcacgcagtcacttctgatcaccccaagtccagtaatcagtggttactcagaacttctgctgctctgacctcatattcttagcaacttgattttttgcagccccagagcctcatattaacagtctcttgaacacagcaggcactcaactatcttaactgagtgattttgctattttcatattattttctatgggtaaaattatgtatcaggtaagataacttcagtaactgaataaaatcagtttcaataataagggcacatctatggtctcctaaactaagaacagagggcagggctaattcaacggcttacagatatcaaagacccaatcgctctccattttttcactacactatcctcgggccatttgcttctgctcacatggaagcaagagagctactgtagttccagaaatcacgtgtagacagtttctggctatagatgaggatacttatcttctttcatattttattaggaaggaaaacattttccagaagctcctcaggggtccctttggccggggctgagtcccatgtccatgccctagttgcaagggaggctggggaggcagcagataacattttcggcctccactccaggaacaggctctgccagcc

SEQ ID NO: 116753 - DNA, 503 bp, Homo sapiens
tacttttcagagtactttaatttttagatatgactttggaaaaaatgaatagttcagaataaagagtaaagcaatgctcagagtgcttgtgtgggtaaacggataacaaaaatatctggaaaccttgtgaagacaatatttagtttttggaatgaaagaagtccatcagatgaggaattgaacacaacacacttggtttcaatcatacctataaaatgtgtacattaaataggagacctttcaagtctgttccgaaacacactgctcttacaaagaatttattataactgcagtgaacacttctttctagggaatacaataaagtattatgcctacattaaagcatttgttccatttaatgttcactaaagaatataacacaaggtagtgcagcaaacagggcaaagaacatggacaagactacatctatgaaatattaaactaattcatgagaaacattattcaatgtatgcagaatgtctcagggttccctgtgtgatata

SEQ ID NO: 116754 - DNA, 111 bp, Homo sapiens
tctccatgcaagcggaatgatccttgtaaaaacaaatccaatcaactcaggacctcctcctgctcaaaattcttcacacacgtccatcataatcatgatggaacccaaatt

SEQ ID NO: 116755 - DNA, 571 bp, Homo sapiens
tttggaggtgatgcagtgatgtatttaattagcagatacagaggaggaaggaatgaagagagtttggagaagaaaaaagaagcaaggataagtaaatattcaaagtctcagaaaatacaaaattaagcataaatgcaaggttatttttgtaacagtagaacccttttcatcaaaataaaagatagataaaaatggctgaaacattctaagagactgcagaaaattgagggagtttttgaaaaagtatttggtacttttatcctgatggttaaaacagatgaaaagctaaaaactccttcatgggaaaaatcattaaagtatcctcttggttaaaacagatgaaaagctaaaaactccttcacgtgaaaaatcattaaagtattattctagcatatgtaattatgcaaatggtcaattttgtggcaaatgaagcttacttactcttgaaaccaaagaagttttattaatttatgccaccattgatttctcaccaccttcttaacatagcccccattagttggcttcatctatgtaaataccatctgaagagtataaggatctattgaaataa

SEQ ID NO: 116756 - DNA, 317 bp, Homo sapiens
gccgtaaatcaaaagacagtcactactcattacctacttagaattccccgagttcttcctgggaagccatttctcatctgtttgatctcggagccaccagcactatctccaggcacgccacccatcacggcagccgccagacacttttttcttctgggctcctttctcagcacctagatgaatttctacctttctccagctttaagaagagctggagacaagggtagaggccgagaggacaaggttagaagccggaggagacaaggtagaggccggaagaaaaggtagaaggcggaggaggacaggtagaggcgggg

SEQ ID NO: 116757 - DNA, 4312 bp, Homo sapiens
  misc_feature (1129)..(1129): n is a, c, g, or t
  misc_feature (1539)..(1539): n is a, c, g, or t
  misc_feature (1900)..(1900): n is a, c, g, or t
  misc_feature (1947)..(1947): n is a, c, g, or t
  misc_feature (2372)..(2372): n is a, c, g, or t
  misc_feature (2799)..(2799): n is a, c, g, or t
  misc_feature (2844)..(2844): n is a, c, g, or t
  misc_feature (3035)..(3035): n is a, c, g, or t
  misc_feature (3481)..(3481): n is a, c, g, or t
  misc_feature (3754)..(3754): n is a, c, g, or t
gacagagtaataagtagaagaaggaaatcagatttttctaaagcctactccttcctcactttgaaggccttctgggaaagacagcaaagttgagctcatataaaccaaaagctctggtcccagttctccctgtatggtggggagaattgcccattctttcttacttctgacaactggctcttcaagtacacttcaaatacctgagaacctattcatatccattctctgaatgggaagaaaattgctcctccttggcaaacatctttggcctgggcaaaactttccacttttttcatttttgtggtcactgttctcttctatatccttttatgtattagtccataagcactaagttttgaaagcactaagacattctagagtccttgattgttcacccatacttccatttctttattcaataaacatgtattaagttcctattatgtcagatgtgcaaattcttatggtaataaaaagatgtatgagacatagacactttatttagtcaaacactcaacaatatttgaacatctactgtgtacaaggtgctaaggatcaataaaggagtagtgcagtttaagacaacacaacaaaaacaaactcttcactccactggctgtaacacatttctactctgagatcttcatggcacaacttcttgaacaagtgttttcaatagtcactctcttcacatttttcttctattcctcaacatacagaagaaacgtgtgttggactttccagttgaactttcaacccaactatttgtggaaattgctattaccaaattacttatgatgttgccaaaacaaatgatcaattctcttcctgttacatttcatgcatcagaagcatccaacatagtggaccacattctttttgaaatactttcttcacttgacttttacaacgccatccgctcctaattttcctcctgccggccaccgactcctactcagtatctttagctggcccctcctcctctgttcaacctctaaatgtcgatatgtctattccaggattcagtctagaaacttttccttttatccttgaatattcttaccctagcttatttcatctagtcctgggcttttaaaaatcactttacgctactcatgtccaagttganctctctaggactatagcacaaggggtataattattctaaagtaacccagaagtttaataagctggccaagaagagggattttctttttcccagcatgagggactctacctagtatatgtctctatagaatgggtggctttctctcctaagaaaaggaaaaccctttgcacgagccccaaaaactctaggttctgggcagttgattttcccagataatgttgtgaacagctggcacctaaatctagactgtttcacaccaaaagcctgtgtgttcctccattgataaagctgtgtcctcatgctaacatgataaaaaattatagtaagggaaactagtcttcctacactgaaacacagactcatattgtgagcccagtaatttcctgaccatttatgcatcagtgtaaganaggaggatggggaaatcatgcaatctattcttttgctgattagtaatctttgtgagttttcctaatacagcattttttttttggctgaacgcagaagaatttattgatggtacacaacaaggtggggctccctaggcctctccctcttcagagggtctgcatggaaactgtgaggaggggagattctcattgtggtggggcactgagtgtggcagggactccccagaagctgagggcctctgttttcctctcatgctctcgctggggctggtggtccagggatcttactctttgaaggccctgtgggcaatgaggtcgatcacccttttgctatagccaaattcattgtcataccagaaantgagcttgagaaagtggtcattgagggcaatgccagtcccaggatcnaaggtggaagagtgggtgtcgcagttaaagtcagaggagacaagctggttctcagtgcagcccaagatgccctcgaaggggaactccgatgctgcttcaacactttcttgatgtcatcatttttggcaggatttacataggcaagtcaggtccacaaataacatgttggcagtgaggacatgaaacgtcatgccagtaagcctcctgttcaactcagggatgacatttcccatagccttgacagtgccaggagatgcaggaatggcattatggagagccccgcgactctcatggcatagtttcctggaggggctatccacagtcttctgggtggcagcgatgtgtggactgtcgccataagtccttccatgacaccaaagttgtcatggatgaacttggccaggggtgctaagcagttagtggtncaggtgacattgctgatgatcttgaggttgttgtcatacttctcatggttcatgcgcgtctcagatatgggggcgtcagcagaggggcagagataatgacccttttggatccctcctgcaagcgagccccagccttctctatggtggtgaagatgtcggtggactctatgatgtactcaaggccagcatcaccctatttgattttggtgggatctagcttttggaaaatggtggttaaatttgtattcatgacaagcttcccgttttcagctttgacggtgtcatggaatttgccatggatggaatcatactggaacatgtagaccacgtagtcgaggtcaatgatggggtcattgatggcaacagtatccactttaacagagttaaaagcagccctggaggccaggcacccaatatagccaaaccnattgactccaggcttcaccttcactgtggtgccttgggaatgccnctggcgctgcacaagaaaatgtggctgtctgtcgaacgggagaagcagaaatctacagcatattatttaacccataattatcatattgagaaattctttgcgaaatctggtaccaataggtggtgactcagatgggcatcacttgacatagcatgctgaccttccccgagcatcatgtggacaattcagtngtctcagtattacttgtttaaaagactatccttttgctccaatgaattacttttgtgaaaatcaattgaccctatgattttggccgttaactaacacataagcaataatttcctcaaaatggattataggcctaaatttaaaggccaaattatacacctcttaggagaaaacatagattaacatactcatgaacttgagttcgacaaaatcccgatgtttcctggtagaagaaaaaagttgaaatattgagtcatgatcaaaactaaaactgtttgcattttaaaagacatcaataagataatggaaatataatccagagactgagaaaaaaatttcaagtcatacatttgataaaagatttgtatccaaaatataaaatacactgacaactaaatagcaaaaagataaataagccaattttaagttgggcaaaatatttgaatanccattgcaccaaaaggtgtaggaatagctaataaagcacatgaaaagatggtcagtatcatcagtcagcagggaaatgcaaatcaaaactacaatgacacaccacttcttacccactagaatgctatgataaaaatgaaggacaataacaattgaggaagtgaaataacaatgatgtggaaaaattgaaatactcatgcattgttgatgggacatgcagccatgttggaaagcagtttggcagtttcttaaaacgttgaagatacatttaccntattacctagcactttcattccttgttgtctactccaaaggaaaaaaacctatgtccacacaacacatgaatgtgaatattagtagcagctttatccataatagtccataaagtagaaacacatcaaatatctatcagctgatgaaagaataaacaaatgggagtgatccatacaatttaatagaatttagcacctaaaaaaataaaatattgatacgtgctacaacacaggtgaaccacaaaagcacattaatctaagtgaaagaagacagatacaaaaaaccacatgttgtatgactctatttttatgatatccagaaaagacaaatctgtagtgtcagtaagtcaattaggggttgtctggagctggggagtgggaataaggggtggtattgatgagcatgagggatttcttaggaattatagaaatgttccaaaacaagattgtgatgatggtcaaacaagtctaaaattttactaaaaataattaaactgtacacttaaaataggtgaatgttatgatatgtcaattatacctcagtaaagctgtttaaaaac

SEQ ID NO: 116758 - DNA, 862 bp, Homo sapiens
tcctggaaatttcagtattgtgatgttaaagaacatctctaaactgtgtctacgttgaaaaatcagagtcctgatttttggtttagaaaacatggtcacctggttcttcagttgtaaatataattccttcctagacctctctaatgcttaagtctaaattcattcttaaatgaataaacttaatattaaaataagatcaggaagtaaatcccaagccaagcatttcagaccagttgtgaacctcttttgacatgtttttggtaaatgagaagaactgatgacatatttccctatcaaataaaatagacaatttagatttaataaggcagttatcttcaggtaataaaaattcaactaacttgccataactatcttgtttaaagtcaattaagagcctcatatttctcacttgctgggtaaaatttaatagaacttcagttaagcatttattgcttatttaattcaaaattaagttaatcaccacagttggtaacaaccactgagtatttaattaacattcagcaaactatcttattaagtctaaattagatacagacaagtcttgtttatccccatcagtttgcaaacaccacctcccccacctcccatcccaaggggcctttggttttcctacagttttccttttttgattcatcatctgatctatcaggaaaatttagtatatacttatagcatgggtatagcttctagcaccggttgaataatacattaattctggggatcgaaagacacgtggagtatggactggttcagatcacgctacttcccatgtcatttcaacttcccaagtttctgactgcttaataagtctatggcagggaggtagaagaagcgcagatcg

SEQ ID NO: 116759 - DNA, 408 bp, Homo sapiens
atggagaatgaagatacaagaaaagcataaacttaaacttagtggccaagactttagcagatattgcatggatcaaatgtaagtgctcaaggctactaagttataactcttcttttggttataaatattcacttcagtaaactttaggtgggatctgaatagagaacacaagttactttcttcataacggatatatagagtcgcaaagaataagcattaattgagcattaattaattataccttcaggtaccaagagaaccaaccggaacagaaattaagtcattccttctttatctctacagaagcgacaaggtgagggcacgaaggatgccaagattagaggctctagaagatctcgccttcttttccagagaagatgctcaaagatctgtctgctaactgggccc

SEQ ID NO: 116760 - DNA, 420 bp, Homo sapiens
cattactgagtgcttgctctgatctcacggtaccagggccacacagagatcccaaggcatggtccttggaggcttgtagagaggccaatgtgtgaacattcgtaattatatgacttttgctgccataatagaggcagaaaaacatacattaagaatgaagaagaaagaatgctgaatccagaagaggctgacactttaagaaagttgtcggtaggggaacaacacagtgaggcctgtcggaggagggtggtggggagggagagcatcaggaagaaaagctaatggatgctgggcttcaaacctgggtgatgggacgatctgtgcagcaaaccaccgtggcacatgtttacctttgtaacaaacctgcacgtgctgcacatgtactcctgagcttaaaagttgcagaagaaaaaaaaagtt

SEQ ID NO: 116761 - DNA, 324 bp, Homo sapiens
ctagtattgaccttggtaccccagagaccatgtggactgtcagttgaaggaaagcccgatacctctcttctctcaaggtataattagataaagcattagggttcaaacacatttttaaaaactaaaaagaaggtattgtattagaagttccaattagagtgtgcaatagatgttcagcaaaaagaactattcctaaaatgttcctatctttggtttaatcacaaggtgtttgtttggttggttggttggttgtagtaattggccaaggtatctgattggcttggggatgtctttcctgaagaattatacagggaatcctctcag

SEQ ID NO: 116762 - DNA, 337 bp, Homo sapiens
aatcattaaaaatatgttgtctggccacaatggaattaaattagaaattaataaggaaaaggtatctaggctgggcgcagtggctcaagcctgtaatcccagcactttgggaggcagaggctgttggatcacctgaggtcaggagttcaagaccagcctgaccaacaaggcagcctgaccatctgtactaaaaatataaaattagctaggtatggtggcacatgcctataaatcccagctacttgagaggctgaggcaggagaattgcttgaacccaggcagcggagattgcagtgagccgagattgtaccatttcactacagcctagggaacaaga

SEQ ID NO: 116763 - DNA, 731 bp, Homo sapiens
cacacctgtaatcccaacactttgggaggccaaagagcaaggatcgcttgagcccaggagttcgaaaccagctggggcaacagagggagaacttgtctctacaaaaaatttaaaaatcagctgggcatggtggtgcacgcctgtagcccaagctatatgggaagctgaggtgggaggattgcttgagcccgagagtttgaggctgctgtgagctgagatcacgccactgcattccagcctgggcaacaaagcaagaccctgtctgaggtcaactctgcccccaggaaggtatgggaccttgcaatcttatctaggttgcgtctttttcattgaaatcacgaaatcattaaggtaagtagggaagggtcaagatagctaagatgagtgaggggacacagacaccaataaaagttctaactttgaggactcctccagtattcttttcatcctaaagcttctggcctatcagctagttcagacacagcctaggagtctcaagccagtacaggaacaaggaggcaggttgccctcttggggcaaagctgtggccccacccttgatgaagaacgcctgtaggaacccaggacctgtgagcaggtagagtcctgaaggtttaagattctgtggagcaggtatgtgcagtgccagtgcgcaaccagcaactgatggacaggaataggtagagctgctctgagtgcattcctttggcaagcctgggccagaggcacaca

SEQ ID NO: 116764 - DNA, 390 bp, Homo sapiens
ccatcagctctcctgagatgtattcactaccacagagcattgtggggaaaaccaccccatgattcaattatctcccactgggtccctcccacaacacgtgggaattatgggagctacagttcaacatgagatttgggtggggacacagccaaaccatatcaagcagacagcagtggtattttctgctatgcagctgtttctggcttccttctccatctgttgtgcacctgcgcaggcctgagagccgctggaggcatctctgccctccctttcaggctagggacttgttgcctgagccctctgcagaccgaggaggatctgggccatggtgggggctggctaacaaagggctgcgcacgttgcctcacacctgtaatcccagcacttggg

SEQ ID NO: 116765 - DNA, 372 bp, Homo sapiens
cagttctggagctagaagctcgagatcgaggtgttggcagggccttgctccctctgatggccccaggggagggacgggagtgtttgtgccaggactcctagcgtgtggtgggtgcttggcttgtgccggcacaactcgtgttcacatgggattcccctgtgtgtctgtgtccaaatgtccacttttcataaagaaacccatcagattagattggggacccatcctagtccagtatgacctcatcttaactaattacattcgcaacaaccctgtatctagataaggtcacattttgaggtattgaaggttagaatttcaatatatgaatggcggggagggcaggactcataatcatgggtaagtttttctgag

SEQ ID NO: 116766 - DNA, 312 bp, Homo sapiens
cctttgggtcaaattgtgtgtaacaatcccagtaaagaagttataatatagtataaaaagtacagtaaaatatgtaaaatgtatagaaatgatacagagaaaaggatcccctactccttggggtggaagagaaagtttccaggaagaaatgacataaagtgaggtttgtaagagaataggctttcagagaaaggataattcaggcaggcataggaacacacatgtgaaaacagaggaggcttgacctagtatagcttattatggaaatgtccatatgttgatattatagaagcttaacatgccaaagggggt

SEQ ID NO: 116767 - DNA, 447 bp, Homo sapiens
tctggtattgtcagccttccttctgtctattgcctctttcatcagcatacagacaccacaaaacataatgagccccatctctttgaccatctccttctctatccactgctcctctatttacagtagactttgggaaacagcaatctgtgctttccccacctcctgctgttccacttaaaatccctgtgttaattgaattttgaccccaccactcttcagtaatcgtctttgccaaaatcaatagatatttctctgctattaacatacttgacttctccgcagcaacggaaactactgactttcctccaaactccctctcatcctcggtttaccagatgagcccagcttctattgactaggatctctgtggccttccagctttccttacacgctctttccctctaccctcaaattttccagtaaccaagtatctgctttgccctcctc

SEQ ID NO: 116768 - DNA, 455 bp, Homo sapiens
aatcacagttactcgggaggctgaggtgggagaatcacctgagtccaggaggccgatgttgcagtgggccaagactgcactactgctctccagtgtgggcaatgaagtgagacactttctaaaaaaaataaagaaatgggcaaatgatctgaaatcttcaaaagaagacatataaatgaccaacaggtacatgaaaaaatgttcagcatcactaatcatcagagaaaggcaaatcaatactataatgagttaaaatctcacccattatatcgaaaagcaggcagactgggcacagtggcacatacctgtaatcccagcaccttcagaggccaaggcaggtggatcacaaggtcaggagttcaagaccagcctgggcaacatggtgaaaccccgcctctactaaaaatataaaaattagccgggcatggtggcatgtgcctgtaatccaagctagt

SEQ ID NO: 116769 - DNA, 555 bp, Homo sapiens
tctgcctcctgggttcaagtgattcttgtgcctcagcctcccaagatttaacatttctttggatattttgtgtgtgaaacagtgtaaatattatttaaatgtagactatgattaattaaatatgtatattgtaagccttaagtcaaccacgaaattttcttaaaaataatgaagtcaatataggtaataaaagggtctcataagtattgcccaattaatctaaaagagaaacagaaaaaagagaagagaacaatatttttaaaagaacacatggaagaaatagaaaacaactgtcacaatggtaaattttgaccaaccaccagtaatattaaatgtgaatggcctaagttcaccaattaaaagatggagattgttagattgaattaaaattaaaacaaattaaactatgtgctatctacaagaaacctttttcaaatatgaagttaaggaaaggatgcaagcgaaaaggaaggcaaaagatattgtatgtgttatacctgaattgtgtctctcaaaattatgtatgttgagaccctaattcccaatatgactgta

SEQ ID NO: 116770 - DNA, 181 bp, Homo sapiens
tagatttttgcctctaagaatctcagaatgtatttgaacagcaaagtgaataatgaagtattaataatactcaggatttcaaaaatttaaatgagtagtggaaaaattaaaatctaaaccaaattttgcaggatagacaggagttttaagtggattgtcattcttctaacctctttacggg

SEQ ID NO: 116771 - DNA, 608 bp, Homo sapiens
gttctggagttaagtacctgattttgaattctggctttgccagttaaaaactgtgtgatccgtgctagttacttaattctcctaagcctcaagttcctcaactgtgaaatatgaataaagaccatactcacctcacagtgcctaccacacagtatgtctatgattattatcaggtgaagtcaaaccagatctccaatgccaggctccagtgcccctcatattttcccctgagccttcattcccaaccctgacatgacaggactggtccatcccagacttgcatatgttctggagcatttcctgaagtttgttactgttgacaggagttctgtgattcattaagtttcagaaatgctaaattaaacaaagttcaccaagtgtcttaacttcaggcctttcagagcctctaccatatgctaagctgcttattagactggtggcatgcagagctttcccaaaccaaatgagtcaagggccaccttattctcccaggattatttcctggaacgagcaagaaggagccgtgaccatggcggtggatcctggtagcaccctgggaagcatgcttgatctcctgcagcccctctcctgggccagagcccagaggc

SEQ ID NO: 116772 - DNA, 218 bp, Homo sapiens
aaatacaatcattttgtaaacacatcatgggttcactattttttaacaaattaataaaagtatttagatttttttcttcattttcattcctaagataataaatattgatagtggggtcctgagatcacaaagtttgagaacgccagccaagcaagtgtcagagctaactccaagcctatgaaccttagtgcccacaacactgaccactacatgaaacc

SEQ ID NO: 116773 - DNA, 559 bp, Homo sapiens
aggggaaggtgtgcgagatctgaggacctctgggagtgatgcctcactctggagagagaagcctggggagggtgagcagctgggcctgttacaggcctagggacgaagctgccacaaagaggacagcagaggtgaacaggggtggagagaccaagccagaaccactgcggcaggacaaccctgtcctcctcctcatgaatcgaattcagtccaacacagttctgcatcctttgaagctgtttggattggaaattctgttacccacgaccaacagtatgttcgcattggtaacaatcagtgttagtaaattacccattacagcagtcctctgagataagtaccgttaagtctccgtttatagatgaggaagcagaggctttgtggggttagttaacttttccagatcacaggactaagtagcagagctgggttgcaaacccagttctgtctgattcccaagcctgcctcttctgcccagcggtatctgtctgttcccacatcctcagcagcttatcgggaaggcgctcactttctgggaagcaggaggaaacccactctg

SEQ ID NO: 116774 - DNA, 445 bp, Homo sapiens
tgagctattcatttctcatctattctatcaagtaggctcttgaaaccccaaagtcttaccctgtagagctcattggacattagccagcaaacgtggtcgacgccaaactagccaggaagtctctgcatttcagttctaatatgtctaacactggagcttctttctccaaagccaagggtgaaaagactgcagctggccaccatgggtcttctgttgtctaagaatctgtagatgcagagagactggagaccagaagacaaagacagcctcatgtgcatgaacttagccaagttgcacactggcttgctgactaatctgtcttatctccttatctctgtgaatgcagatccctgaaacactgttgtagaaactggttgtcagaaacagaactaaggagtcaattgaaacaatcataggaccagtagccaggaaaggaagagaggta

SEQ ID NO: 116775 - DNA, 354 bp, Homo sapiens
gataatgcaattgagaataatctctcagatctcgggatcctttaacccctaggctttttgggagaagactccaaaatattgctaaacacatacctccatgctaacttccccactctcttttaaactactgacattttaaaattacaagtgaacaaagtctcatccatcagctctatcagttttagcaccataatactacccaaaagaatgccactactaaagaattatttgtaactctttcctgagaaaggacagcttgaaacctggaagataatggtagagttgaatataattcaaattcatgtacctaaatataattcaaatacatatgaatatatatattagagtatacag

SEQ ID NO: 116776 - DNA, 564 bp, Homo sapiens
cctgccacctactcaagtcctttgcaaacgattccatacccactgcattatcttcgcagcatctttttggaacacaaaatattgagacagcctgctaaattgcatatggaagtttccaccaaacatcagactttcgacttactggtggtatccatttttaaattcctaatcaatttaaggcatacaaacaaagatttttaggaaatgttagaggtactgatggatttacatgagcaaccaggtacttacagaaaacacctgaagacaccacaaaaaactaaaatgtcatctggtctctatatcatcatggctagatattatcaaaatgatagatttttaaaagcaagtaacagaatgaaacacacagtgtatcatttatgttaatgaacatgtaacactgtataggtccttaaggaaatattcatatatagtaaaagtaaatttagaaaaagataaaaggatatatacaaattcatattaactacttctgagaagagagggaaataaaactggaaaggggaacaaagtatatttcaaacgttatccgtaacatttcatttattc

SEQ ID NO: 116777 - DNA, 646 bp, Homo sapiens
agggcaatggggaattgcagaaccaagatctgggttggtggggtgagtaagaagtggtagaaaactcagagaggtgaactctgcttttgagttttatcttcttgagaaaaatttcagttcaaaaagtagaggctaaaagattaagaaacttagcagagctttcaacaagttcatgggcttgagggtgtggtaattgtatttaggtcctgtgaaaaggcagaagccctagtaaacaacctaggctttcattgagaaccctgagtctaggtgaatcagaaataaaacataggtagtgaagccaaaactcaaataatttcagattagtgcccctagcctagatgtctgcctgaagccagaataaaaattctctttggaggaagatgcttttcccagaaactcaggttatcactgtagtttttcatgtactatatctgtcagtcagtagaaataatagacacatcacatgagaagaccagatatgattaaaaaaaacaataaaaaataaacaaattggatatacctacaagagatccagataatagataatcaaatatggtccctaccataactgtgattaatatgtttcaaggattaaaagataagattgaaaactctgccagagaactgaaaattgtaaataagacca

SEQ ID NO: 116778 - DNA, 213 bp, Homo sapiens
gagacacgagtgaacccaaagccagtgtgtctgaaatccatttggcaagcatttgtgccatgtcctataatatatatatgtccatatatatattataacatataatattatataatatatgtccaatgcctgtgtggggaagtcacttcaccattttgctcaatggcaatgaagaaatggcattcatgtaaacactttctcagtctctaaaaa

SEQ ID NO: 116779 - DNA, 143 bp, Homo sapiens
gcttcttcccctctctcagtcttcatagaactgaagagaagagaggggccttgctctggattaaactctgacctaatagaatgcttgtggctggtctgatcttctatcctgaacactaaagcttactcctatcagcaataagg

SEQ ID NO: 116780 - DNA, 132 bp, Homo sapiens
cctaaaagagcctcacacttataggggccccagcgcagtccacggtgacactggccagccacgtcggggaaaaacaactctcccatttgaaaacatggtggttccaatgtaccaagacaaggttcagggtgt

SEQ ID NO: 116781 - DNA, 198 bp, Homo sapiens
tagtctgagatttttccatttgccatagattccttcacccttttgctctgtgctgtctctggtatgggtgaaagaaagagaatgagctctaatatttatagtacccaccacggttgttaggccctgtacactcttacttcttttcaattcctcgcaaactacttcctcaccttattataccacttaaactacttatag

SEQ ID NO: 116782 - DNA, 441 bp, Homo sapiens
tacaatcagccagttctgcataatcttgtggttcacgagaggggaaggaccacagcttctccttgagtccacctgggaagggcatctgtggacaccttctctctgcctccctttccttcctcccagttccttcctagagggatggtgtttgatttctgaggccctggacatttcttccagctcatcattcaggttgttcagagcatttggaagacgagcttttctcttgccaacactgaccgcctcttgcgggaagatgtcgcagcattattatttaataacccgtgtctttcttcagctcatcaaagaccttccagctccagataaggagtcggggtagggagtaaggaaacaaagggatgagggtactggaaaatcccagctgccccttatcacacaatcaatatattcaatcaatatagttaatagcaatgtgccaat

SEQ ID NO: 116783 - DNA, 426 bp, Homo sapiens
acatacaatgagctctttcaaggaaaggacacctcgaatggtgttttaatgataaatatgaatacataatatcaatatttagcatctaactctgtaataagggctttatgtacattatttcatttaacccttatgatagctgcaatgaagcaagtactgttgctatctgcacttcacagatgaggcaactaaattaaagctcagggaagctaggtaacttgaccctggtggatctagaattcactaccaggctgtcctacagtgggccatggtgacctgcaggcccaggtcacctgattgctcttgaggtccaggtcatctgattgtaagtgaagacctgattgctcttgaactctgagcctagcagggtggtgcacaaatctgtcctgttcccctttgtggagacctagggccacagctctgctc

SEQ ID NO: 116784 - DNA, 396 bp, Homo sapiens
atggtagtacatggatatcatgttacttatggtgttggggtcaagtgcacaggttctgaaatgatccagaactgagtacaaattctgccagcagtcaatactgtcaagatggtaggtttggccaggagcattggctcacacctgtaatctcagtaccttgggaggctgaggcaggcagattgcttgagcccaggagttcgagaccagcctgggcaacatggttaaaccccatctccactaaaaatacaaaaattatcctcgcatgatggcacacacatgtagtcccagctactcggaaggctgaagttggagggtcagttgagcccaggaggtcaaggctgtaataagccaagattgctccactgcactccagcctgggtgacagaaaaaaaaaaa

SEQ ID NO: 116785 - DNA, 322 bp, Homo sapiens
cgcctgtgagtgctgggtgccatgtggagaggccaggagggccgcccgtgagtgtcgggcaccatgtggggaggcattgctttctctgtgggagcgaggtggctgggctgcagagttactgtgtggcgttggggtgacagcagtgtctgaccatggaccatgacatgaatagggtttttccttacacaagggtaacagattaagttttcaggaatatatctgacagtgcaattgaggagtgaaggggccagtggtagttctgtaagttttcctccataatattgtaacatttataaagacagcacagtcgtcccttggtatc

SEQ ID NO: 116786 - DNA, 737 bp, Homo sapiens
agcggggagtcacgcgaagtcggaagtaccagctgcgggaaggagctgcccactgtgcgtcttctcaacttgttgggacaaccttcctgcggaaaggagagacaaccttcctgcagaaaggagctacctgcttcaggtctactgagagctgttctgccactcaataaagctcttctccatcttgctaagcctccatttgtccgcaatacctcatctccctggacgcaggacaagaactcaggacccgcctggaggactgacattcagacgtggagcaagttggactgcatagggacccaccagtgagatggacgctgtctgtaaacggggaaatttatggaaagatgtcctcctgcaactgctgaaaatgcaacatgctgcccaggtcctgctcagaccactgacaactcagaagttaatactcagagtggaaagccttctggaggtgagacccgggaacaccaggcagaaaaagcaggaagatcattcttcagggagcttgtgtgcctgcctgaaaagctggctaggcattcatcaattgacaggtttctgcagttggagcgtaatctccctggaatgctctgaatcttatccttcacgtgaccttgtaagaaaccagagtatgcacagattcaatatgggaagtgctcagcaacctgtttcaaagctctcggtaaaagtttgcagggatcaacaaggagtgggtgacttcagtttaaatccacccttggaacctg

SEQ ID NO: 116787 - DNA, 300 bp, Homo sapiens
gcatgcaaacacaggcactttattcacccaactactttgcataatgtttaagaagcagcaatgaaatagatcaaggagggtaaacttcccatttcccttttagcatcactgccaagcaactaccatgtgtccctatcagaaatatggctcagggccgggagtggtggctcatgcctgtaatcccagcactttgggaggccaaggcaggtggatcacctgaggtcaggagttcgagaccagcctggccaacatggcaaaaccccatttctattataaatacaaaaattagccatgtgtggt

SEQ ID NO: 116788 - DNA, 241 bp, Homo sapiens
aacggtatgcggttgaagcgtgcatacagcagattgctgaggcctcactgccagggatgccagccgcagcctccaggagggcatcagggaaggaaagagagctgctgaggagggactttgaagctgaaaagcagtgtgactgcttcatttgctcccatgccaagtgacagccacaaagttagttattcttctctacaggcttttaattgtctgtaatctaattaccactcaacctgcttcc

SEQ ID NO: 116789 - DNA, 563 bp, Homo sapiens
ccgtgggccgcactggcgcactctgtaacactagggggaaaattgtctgtagctcatggccccttcccccatgtggtggctcatgcctgtaatcccagcactttgagaggccaaggccaggagttcaagaccagcctggccaacatggtgaaaccccacctctgctaaaaatacaaaaattagccaggcgtggtggcgtgggcctgtactccagcttcttgggaggctgaggcacaagaattgcttgaacctgggaggcggaggttgcagtcagccgagatcgcgccaccacactccagtttgagtgacagcaagactgtcaaaaagaaaaaagggcaaccatgccatgtgacacaatcatatcacaggattggtagcgtaactgcccagtgggttcacctttcctgctgcctggacacagctgattttctcaagacgggggaattacagtagagaaagggtaattcacgcagagccagctgtgcgggagacaagggttttgttatcactcagatcagtctccctgagcattcagggagcagagtttttaaggacaacttggt

SEQ ID NO: 116790 - DNA, 542 bp, Homo sapiens
gatccatatacacttagccaacattgccttctaacattgcaatgataagttcttttaattgagattttggaatggtatagctatctggaaaatatttcaaatgtcattgtggagcttttggttaaatgtgagttttaaaagtttgataaatagaataaagagcggaaaggaaaaatagttatgaatttgttgaattgtttgggctatgagttatctttttaaaaagaggttttatgtttgtgtagaaaatgccactaaatataagaaaatggaagtttaatagttgaacaaggtaagaattgcagatatcatgagattgtaatttaactggagtatgcattaaatgaattgtatatttcactagcttggtgaccatgaatggttttgtttgtcattttatctttcttttcttttctttcttttttttttgagatggagtctctttcacccagcaccgagattgcgccactgcactccagcctgggcaacagagcaagactccatctcaaacaaaacaaaacaaaacaacaaaaaaacaaaaa

SEQ ID NO: 116791 - DNA, 1117 bp, Homo sapiens
gtggaagattgggttttatttattgtttaatggttttacaatacccacatatataaggctgtttactttattcttgaactctcaagaaacactcattggccttcgaatcgtcaagtgattttacaaacacaaattttataaagttctatttttctgcctattgttagttatttgattcgtttgtagtatttataggcctcccagactccatgcttgtaaccacacttatgttaatgcctcataattgaaacttggactgatggttttgcatttgaagattcaccaaccatggatggaaatattcaagaagaaaaccatagtacaaaccatgctatgcaaatactatgccattttatgtaaaggacttgaggatcctccggttgggtatcctgagggtggcggtcttgtaaccaccactcctcaccctgaacatagggagggatgactgtactctatacagtcttttcttcgttacttttcaggagtcagtagagagggccctaaggcctaagaccaaacttggttccctagaagtaaagaatgacatgggtcaaataggatctgtatgctgaatcacaaaatgttagcacttagagcttatataagccactggttctcagccctagctgcaaaatgaaatcacctgagagtttttaaacgtactaatgccaaacacctagaaagtctatgctaatatgcatcatatattgagagtccccaacctgttccaattcctttatttcataaattgtggcccttaaacaaaattaatgattttgttaatgtctttaggaacacatccattatgcctagaaattttatacactaatataatttataatgatgatctcttctgtctcagcccattctggttgttatgataaaataccatgcacaggtggcttaaacaacagaaatgtatttttcacagttcgagaggctggcattcccaagatcaaggtgccggaagattcggtgtctgtgagggcctgcttcctaagtcatagatggcagtctttgctgctttttcaaatggcagaaggggcaagggagctccctggggtctcttttgtaagaccactaatcccattcatgaggagagaggcttcatgaccta

SEQ ID NO: 116792 - DNA, 287 bp, Homo sapiens
tctccacctcctaccctacccccacttccaaccaataagcttatatcaataaatatttgttggctagtaactatatgcctcagatactgctctcatctttgggggatacaaaaataaaagctggagacgtaagcattttctcaaaaatactcataatctggatgggaagacacactgtgcacactgtggtctgcagagtactggtatctgctgtgatagtcatatgatcaatatcctgtgggagtttgaagaagggcctcgagacttagcctaggaatattagggaa

SEQ ID NO: 116793 - DNA, 218 bp, Homo sapiens
ccaaaggctgtgttctcagtctacccagttcagagtcagtaagtccgttgactctagcccctcattctcccctgcctccatctatttatgcatgacatttgtccacccatccatccatccatccatccatcagtccattcatctatttgtctaagcatccatccatccatctatccgtccattcatccatcctctgtccattcatccatccatctgtc

SEQ ID NO: 116794 - DNA, 639 bp, Homo sapiens
tagctctcacatgtgcacaaagatacatggaaatgtcatattaacactatgaacacagtgttcatttttcacaaagaaaaataggaaatgaatatccagaagacaatggataactgcaatgaagtattttcttataatgaatttccaagtagcacaaaaactttgaaaataaaactaaaggaatgtgtcaatttggttgaatctcacaacactagaagaacacgtccaacaaaagagcagctctttcaacttaagtttaatatgtatctatcttaaaatgtaaaagaaattatcctcacttgtaaaaaccaatttgccttcaagaccataaatatcaagatctcaagtcttttttttttaagagacagggtctctgtcacccatgctgaaatacagtgacacaataatgactcactgcagcctcaactcctgtgctcaagcaatcctgcctcagccgcctgaatacctgggactacagctgggcatcacaatgcctggctaatttttttttttttttttttttttttttacttttttttttttttaaaaggagcttgcataacttttgaaaggaaaaaaaataagtattcttccaaaaaaagctttaaaccccccttaaaaaaatgattgttaatttta

SEQ ID NO: 116795 - DNA, 539 bp, Homo sapiens
tttgtttgtttgtttgttttgtagagacacggttttgccatgttgcccaggttggtctcaaacttccggagctcaagcaatccacctgcctcggccttccaaagtcctgggattacaggtgtgagccaccatgcccggcgattacatctgcttaagtaaatcattggtcccatgtctcaactctgctggctagaaatacaaattctaggaggagaagaaggccaggggaatagaatgacgaggaaaaatctttaatgacatgctgagctgtcatgttataaagaaaccaaaaaatactttctgggagacaggcttgaagtggagacagagagacgtcatttccagcctaggggctctagggtgaatttgtcatactgatttttggtgggttgttttggggcagattgcttttcaataaattgtctgcctgcagcacggtatgaaaggtatgaaaggtgtcctttggaagggtcgcggctcccacttccctccagcacttttaagacatagtgggccaggcacagtggctcatgcctgta

SEQ ID NO: 116796 - DNA, 680 bp, Homo sapiens
atggaacaaccctgggaattgtatttgtgattatgatagcagaatgttcttttataactcaaaggttctctttcatcagaataagcaatatctctgaatactgagtaagctaatgtcagaaatgagttaattagactttttactttttatattgtttacatcagttctaaaagacttgtgtttcaaagtagcagaaatgcaatttcatggtattctgcttaagtgacttagagatatatactaactgcctaaagttgattattttaatgattttaagtgtaccgaaactgaaatacagatttgtgattttctaaccaatatacttgttccagaatgaagactctaatctgaatgttaaattataaattttctcatcaaaactaatgtgcagaccacaaagaagatgatcttagtaaaaggagctaaaactctataaaagttttatacataatttatgactggtaaatcaggcatagaataaactatcacagaatctaaacacaattaccaaataacctgaggttattggtaaagctaatttagccttttaatcaaatattcagtaaaatagatttagatcattgacagaataattagttaattgaaatttctgttttgccaagtgctatttgtcattatataaacacaagcactatttttatatcctgatagatgctgaa

SEQ ID NO: 116797 - DNA, 300 bp, Homo sapiens
tttttttaagtttttaaatatttgggattaattagcaataatattaactataaaaattaaaataaggcattatgccgtgtgttcctgcgtgtctaaatttctttttattcagacatttaaagcacatgataaactaactcctcaggaactgtgcctgccccagaaggttagcatgtaattacagcactgtattctaaattgaatagaggtgtggacagagactgcgactaactcttacacactggatagaggctgcagctaactcttacacacccaggagtcaccacagaaaagcttgct

SEQ ID NO: 116798 - DNA, 751 bp, Homo sapiens
aggctaggtcaggtttggggcccgggcagtccaggagaagtgcatttatgtcagcttggggaggtcgcaaatccgtgctgtgtccaagcccaccaggaatggattcaggtgtttatgggtgtggggattcaccaggtttaacccaggcccgtgtgagcaccactggccctagaattagcctcacctggcgccggcctttttgtgatggctcctgattaaatacccactaattctggatctgctggtgaccacagagttcacctgatgggtcccctacaggcagcattcaatccaggaagtgccagcatcacatggtgacttctggtagctgtaacgtttagtgactctctccatgtcatgcagaggggtgacattgagaccctcttatgcctgggaagttcctgctgtcaatgcagaatattctttaaaaaaaaattagagatgggatctcactgtgttgcccaggctggtctcaaactcctatcctcaagtgattctcccaccttggcctcctaaaatgctgggattacaggcacgagccattgtgcccagcctagaatattccttttttttttttttgagacggagtttcactcttgttgcccaggctggagtgcaatggcgcgatcttggctcactacaacctctgcctcccaggttcaagcaattctcctgcctcagcctcccgagtagctgggattacaggcatgcaccaccacgcctggctaattttgtatttttagtagagaca

SEQ ID NO: 116799 - DNA, 346 bp, Homo sapiens
tgtggaaatagaggtattaaaactgatcttttaaacagagactaaaaagaaagactaaagaatcaaatttcttactgaatgtaaaccctgttccaatctgacccccaagaagaatggccataaaatatactctgttcttctacaatatgtttctttaatgggaataactaactcagaagcaattggtgagaatggagactggggactatgttagtataacacagaattcatgttgatggttcataatgtttcccaacacattgttctgcactgagcacaaagtgtaataatgcagccaacaaggcagcaagggaccagtgccatgaagcctgttcactccacgtgc

SEQ ID NO: 116800 - DNA, 378 bp, Homo sapiens
aagcaccagcatcttcctggagaggaagaacctcttccacaccctgactttctcaagtgtattcatttgctgtggacttgctggacgttcatctgctaacctcagcaggaaattgcggaactaacacattagggcgtaagtgtaggccatttttccccagtcacatgtctcagtgcctaggtgtaggtccctggatatagttacctgtgtgccactatcacaaagttccaggatggctagatataggagggtcccaagaattgcacttgagaaggctgaggaactctccagctccgtgtcctggtacttccgttaggatcacccgtgttcctgccctagccaggtgcctttgaagcctgaagacaggtctggagagta

SEQ ID NO: 116801 - DNA, 874 bp, Homo sapiens
gaaaccatgcgcgtaaccccatgtgcatgccgagcaggcctcacgccagtttagggtctctggtatctcccgctgagctgctctgttcccggcttagaggaccaggagaagggggagttggaggctggagcctgtaacaccgtggctcgtctcgctctggatggtggtggcaacagagatggcagcgcagctggagtgttaggagggcggcctgagcggtaggagtggggctggagcagtaagatggcggccggagcagtaagatggcggctggagtggtttttctggcattgtctgcccagctgctccaagccaggctgatgaaggaggagtcccctgtggtgagctggaggttggagcctgaagatggcacagctctagatggagtttcaccacgttgcccaggctggtttcgaactcctgagctcaaatgatccacctgcctcagcctccgaaagtgctggagttaaaagcgtgagccaccatgcccggccaagagctgtttactttatccctccttcccaaatgttaattagctttgtaattgttacttatgtattatatattacttattatattattaatattttaacttgcttgatttcttttatgtgtagtgtataagagtgttgacatttgagaagttccctgtagaaatctattctttgatattgtctatgattttacaagtcctttttatttggtttaggaagatacattccagactgtgtatatatagtaaacgttttcttttaatgccgagtgctcttcattagctatttaattgtaacatatgggtttgaagcgttcccctaaatgtagtgttttattttccttcttttattcactgatacctttatatgatattgtaaat

SEQ ID NO: 116802 - DNA, 320 bp, Homo sapiens
gcagaggacaagttaggtgacagaattgagacagaggggaaggaagagctctgtactggaaagaagagagggggttgactcagaagtgaattagggccacgcccggtagctcacgcctgtaatcccagcgctttgagaggccaaggcaggcagatcacttgaggccaggagtttgagaccagcctggccaacatagcgagactccatctctactaaaaatacaaaattacctaggcatggtagtgcacgcctgtaatctcagcctcttgggaagccgaggcatgagaattgctttaacctgggaggtggaggtttcagtg

SEQ ID NO: 116803 - DNA, 236 bp, Homo sapiens
atgcagtctgggatgaaaacaattggtttaggatgagggatggattcactgtgtgtgattatcatgagtgctgctgagatttgtcccatggctgcttctgactttgggattttgaaaagcagcgctgccattgtaaaaatcaaaagacagcttcaagatgtactcaaatactttgctaaactgcaacagaataaaatgtcttcttagcagctcggtctatagtcactttaattcaa

SEQ ID NO: 116804 - DNA, 483 bp, Homo sapiens
gtggtagccacgatcatgatgacaacataataaacagtaagaaaatcattgcttactgagtgttgtctatgggccaggcagtgcagctaaacattttgcatgcatttttacttaactcttataatcctcagatgagggaggcactattatccccattttacagaggaggaaacaagggcccatcttttgaagtttaccctgaaggagggtggtgaggaagtcctggagacgctcaggcagtggaaggacacagtcagccacggtgaggagacagcagaggctcacagattttctgggacgtatccacatcctgccagcatcagggctggtgctgggagtccccaggagtcaggatgtgtggtgcaaagccagcccttccccaaacaccggggggctcttcctgttccatcttcccctcccccgtcaagcacaggcctgatctgcctatggggtgacccagtcatggggaacagtgtgtgctca

SEQ ID NO: 116805 - DNA, 505 bp, Homo sapiens
aaattagccaggcgtggtggtgcatgcatgtgattccagctactagggaggctggctggtttcctggcactgattgctccttttccagatcactggttcacgcatcagctgtaagtagtgctctcttcctaataaggctgactggttttgcgcaccactccttaatgacctcccgtaactccccatccccagacttcaagtttgggtacagtcacttcaaaccaggttgctatttcttgacttgggaccagatacagtagcagttgataagagccgagggactgtgttgtaagacaaatatttatcttgaaaatctagacccgtcttatgcctggtgtgatgctgacactctgagaagctcgagggaactagatggagacaggaaggagcagactgaatatctcttgactcatttccatgggatgcagggaagatgaacttgaaaaataattttttgcttttcccagtcgaagctgagcctgtctgcacatagatcagtacctgt

SEQ ID NO: 116806 - DNA, 326 bp, Homo sapiens
gagcagtcaaggctgcagtgagctgtgattccacaaatgcactccagcctaggcaacagagtgagaccctgtctcaaacaaatgaaaagcagaatcttatcatgtcattgttctgcctacaggccttttcttctatggcatgccactgtatttaggaataaagtcaagatccttatcaggacacacaacccctgtatggcctggcttcctctgtctctctccttcttggtcatcagtacaaagaccttctagaatctgagaagctggacatttacttctgctcttctttctctctctacctcctgccctccttgactgggctcttc

SEQ ID NO: 116807 - DNA, 317 bp, Homo sapiens
tcaatattttctttactgtttgatatgttgaatattgaaatagcatagtgagagaggggctaagatctctgtccttgcaaatcaaacaatgaaacagaggaaagagtctactctagcccacttggttttgactcaatcatgcccagcatgattaaagtacacaagtcagcatcgactgcagtgtaaaccttttattttctcatcttgcaccttatttggattctgagcaccttggggcaggaccatgtcacttatgtagatagtaaggcccatagtgccagtaaatcaaagttgtcaactaagtacagtaaatggta

SEQ ID NO: 116808 - DNA, 539 bp, Homo sapiens
acccaggaccaatttcttactctctctgctttagtgagtgtcttcatctgtccagtaggaataataatactatctacctcatgagagagatgtcattaggatcattggagtttataagtgaagtgtttagaatagcatttgacatacagtaggcactatatgagatttttactattgttatttttgctatcacctttatcctcaggaaatgttttggcaaggtggtttggaaaaaacatgtatatatttttagcccaggattcaaattggctgcctgtaaccacattgaatccaccaccaagttttgtttgttcatccaaactgaaagtttattttttaacagtggagaaacccagacatttttcttttaaaagctccagatttctcacttctcttgaaaaattaaaagatctggaaatgataagcctaaatatatacctaatgataagcctaaatttggagttgtcaagaagctgccccccttggatgaacagtctctctggtttggatctgcctatgtctagtgctcttcactcatg

SEQ ID NO: 116809 - DNA, 375 bp, Homo sapiens
aggctctacctcacaagcagtgtgtcggcctgtcttcctcatgccttccaaaacatgaggagacagagtgggcagcagcgtgtactgatgcaggctcgcaggaagaaaagccacctctaggggtgggccaagggctgcagcccaggagtgggagacacgatgtcaggaagttatatgcataaaaggtaggggcaccatatcacccagccgaggtccggagggttagcccaggagcggctctgatctgaaaacaagcagggctgctgagctctgtcttaacttggagaagaatcaaaggtcctatcaggctggaaagctagccagtgctgcaaacctccaagagctgccataagctgtacctagctgacttttgcc

SEQ ID NO: 116810 - DNA, 606 bp, Homo sapiens
cgtggtagctcacacctataatcccagcactctggaaggccaaggcaggaggacggcatccggccaggcccaatgcaatgaggccctatctctattaaattttatacaaatatgggctgggcgccgtggctcacgcctgtaatcccagcacattgggaggccgaggcgggcggatcaccaggtcaggagatcgaaaccatcctggctaacacattgaaaccctgtctctactagaaatacaaaaaattagccaggtgtggtggcaggcgcctgtagccccagctactcgggaggctgaggcagcagaatagcgtgaacccaaacaaattagctgggcatggtggtgcacgcctgtaatccagctacctgggaagctgaggcaggagaatcacttgaacacgggaggtggaggttgcagcgagccgagatcatgccactgcactccaggcctgggtgacagagcaagactccatcccaaaaaacaaaacaactcacacacaaaaaaaaacaacatttttgggcgcccttgggccctctggaaaggctttttaaaacccattccgtttgggggccggggccccaatggtgtcccgtggcaccctgtgg

SEQ ID NO: 116811 - DNA, 456 bp, Homo sapiens
tccagcaatgcacctcctgctctctgcagcatagatgaaatttcatctcatccccttcaaaagcttctttagactgagtcagcagatatgaccaaataatcctatttgcatcacagatccactcctttcctggcacacatgaagatgaacaactttagggtttcagtggggagcagaggggtactgtacactttctggagcagagggatgtgtgtcagcgctctgctatgcccttttcttacccaaggcggggtgagggaagagtttcctgccatttaaaccataccactcagtgactcactccatgagttcccccacccttgatacatacacatggataaccaagcacattaagtgctgggtgttcagaatacagctaaactgtctgattacaacccaaagcctggaaaaccttaatctctgttcccttttccttcatgtattccttcaagatat

SEQ ID NO: 116812 - DNA, 414 bp, Homo sapiens
taacggcaactgaactgtacactttaaaatagttaaatgtatgttatctgaattttgcctcaaagaaattaaatcctaaaattaatctaaccatatgcttgaaaatattatttctgagctaaaatagagttattctgagttattcttcccaactagcctccaagctccttaggggctaactaattttgagaaatgtgtgcaaattccgtcttcccaacctcaacaaacagcaccactctccacccaactgcccaacctgcataactagagaaacgctggtacctctttcattcctcactttccctcggccggtctggcatcacacccttcctgatccctcaaatctgtcttctcactaactctacttctaccaccagagtccaagctacttttttgttttttagatggagtttc

SEQ ID NO: 116813 - DNA, 115 bp, Homo sapiens
acctttagtgcctttgtaacattaaaatctaaattctccctatatgatctggcttttgcctactccttcaaactcattttgtctcactccccttcatacattattccacaaacta

SEQ ID NO: 116814 - DNA, 299 bp, Homo sapiens
cattctccttgcatcacttccagcgcaacagaaggatcaatcccagtggatgatgcctaggccctgcctctcagtgggccacatgcagctctgtgaccttggatgaatcgctcttcctctgtgatcctcattctcctcattttaaagcaggggtcaaaatgcagctagcaagtctcaggaagattaaatgacataaccttttatttgtaacaatctactatgtgccaggctcttttctggaaccatagagaccctgcccctaccccagggacaatgacagtgacaaccaatggtggaca

SEQ ID NO: 116815 - DNA, 117 bp, Homo sapiens
ggcctgtaatcccccaacctttctacgtccatgcagactgcttacacatgagcaaaggaggaaggctggagacacaagagccagagggaattacagtttgccatcccaaatgtacca

SEQ ID NO: 116816 - DNA, 570 bp, Homo sapiens
gacctagaggaccccccctggtatccccacccattattatccttacatagcttacattttatgacctgcttaaagatgcaaggagcataaatcttgggaaggatggtcttatttacttgttcgtcttttctgcagatgggatgctcacattagagccgggctggcttcagatgtctgctccaggatattttagctgaactgtatgagtccattaaacaaatgtaagagtttttgggaaagaagagcagtgtctcaaaccaaatgttttacatggagaacatctggggaatattggtatttgtgtgtacagtacatcagaaagcagcttggcggggttccgcagggatgtttctggcctgtggttgctggatttgacagttttgttgtaagggaatggttcttataaagtattgccatcaaagcaacgcttgatccaggaaggagtgtccttgcttagccgcacattcaaattgttctgattagctccccgaccagaccttccacgacatttgagcaatctgctatctgagctagtttcccccaaggctttacattccagagaaaggaagc

SEQ ID NO: 116817 - DNA, 863 bp, Homo sapiens
tggctggtaccgccccgggagattatgggatggcctgaatgcctatcaagagggcactgcttaaagaaacgattgtccctccaaacaacagaattctgtgcagcagacggcgcctgagcgatctttgagaactactgcagatgcctggcccagctctggccccggtgctgcctgcatgccaagcgcttcattagccgggaaagaagactcttgccctccttcgtctaatcctcgccagtgaccttcaggaaccaggcaccttctgacgttgggagcctgggatggtgcaatcatcaattacgccgtggcctccgcagctgttcctgaatggatttcttgctcagagaagcgtgtttgaaaagcatctaatggaacggatcatcaatttgtttgaatacacatctaatctgattaggggggcactggccaccagggcagctagtgcaactgagccttgacatggccccagggaatcataagtggggtggcggggccagtctagggaaggagggctgtgtgccctgggcctgccaccgagccctccttgagctcagcccatggtacgtccagccaaaaaagtcacagagaaaagcagaacacatcacacagatgccaggagagctgggcccaagactcctgtttttctatagccctggcactgggcacagagcctgagacaaagaagatgcttgggaaatatgtggcaaatgaatgacagtaaggcccaacatggaagccaagggatgtttaataaagtcatctgtgggacaagactaggtgatgcctgtattgggttgaatatgtctcccccaaattcatgtccttcccaaaacctcagaatgtgacctgatttggaaatcgag

SEQ ID NO: 116818 - DNA, 690 bp, Homo sapiens
ggcactcagctagctcagatgaactgaagacccttcagtaactgcgttctctatacctgaactggaacgcaactgggacatttctttttatagaaattctaatcttttcatgtggccacttgagaattctaaattagctggaaggtgtttcagtcaccaagatgtaaacaggttttatttcactggaaaagtggttacataaagcttgcctttcatccccttcaactaattcaaaagctctaaagagaaatattttaaccttgaattttgcaactttgaaatagactcatatgatattttatcagtgctttacttttatcttctgactgttcttccattacaactgttgtattacattgctttttaaatagctttggcaacctgaaatatgaattcccaggccctcaaactttccttctgtgattaattataattaatcctctcgcttgtcatttcgtctagtatcctgtcatacaacccagaagacactttgcaaaatttcaagcaggaaatctcctgcacatggtttaatgttgatgctgtttccaggtgtcatttatcttccttaagtaatccatacacaacccctccaagaaaggccctctctgtgctcagcaccagacatgctcagcaccacacatctttatgttggatggataagaaagattgcaaacttaaggttgccagatt

SEQ ID NO: 116819 - DNA, 325 bp, Homo sapiens
agcatttgggtgggtttctgggttttgtttttgctgccttctaagtagctgacttttcacccccaagctatgcttcttgaggcagagaagtgccagtttattttgttttctgtctctaaatccagttccttaatgcaccactgagactcagtttagaagtacagtgaaactttgtgagcatttttctccctgagtttgaatggatccctctctcattctttgagttcttgggcacttgtctcttagacactttcaagttacctactggacaggagagacctcttctctataaagtatcacacttggaggcttttcaggcacagga

SEQ ID NO: 116820 - DNA, 313 bp, Homo sapiens
aataaacaaaatttgtattttactttggagaagccatgccctggctaaaagcattcataatcacaaattgtaaatgctgatctgaatgtgtttgcacatacgtagattttggtactagctatgtttggtgcagttggtcatggactatgagcctgcaacctccatttctagtccagctggttttgtgtatgttttgaacagtctgtgcctctgtgtaataatgatggattgttgtgttttttcctcagctcccccttttcctgtaccactgcttaattagaagtatgtcaaggactttgaacacagcgggagc

SEQ ID NO: 116821 - DNA, 282 bp, Homo sapiens
acaaaaccatcaagtcaacgtgatggtattcatttgtaatgatcaccactgaatttttaacaactgcttttgatccaactgtctcccttgggaatattgggcaacactaggaataatctggacaacatgttgaaagctttggatgcagtttagaaacttctatgggggctgtactttccctatagccaaggaaagagaaaaaaacaagtctgagggtggcagatgggaaagaatagtggccttggcaactggaagccagtttcaatctgagctgaagcaatt

SEQ ID NO: 116822 - DNA, 723 bp, Homo sapiens
aatgatgaagtattgaaagcagtgcctctgcagaactattttttaggcaggagcaaagcaaacgagaatgtttggaggcatctagtttctaggaaaatgaatggagcccaattcttttttttcttttattttgctgctttttctcactggaaaatagagcccaattttatagtccgttcttctccagaaattgaattatggtgatgagtacttgtttctggattgtttggcctaggatgaactattgacaaataccttgttaacctgaattgtatgcacttgaatatgggcttttagatgttgtctccagttgtggaggatcctgtcgagagtggatcatttatgaatcgagaatccctgggaaattatctttgtttgcagcagaatgggcatcatcagtgcttgggttcaacctgttaaactactactgttactactaaaaatctcagggttttatctgatgtttgggggtagtggttttcctatgtgtagtgttggtattatatcaaagcctttttctcgatatttttatgtattaaggatgctttgaaatgcctaaatccttagtggctgtgggtgtcttccaatagttgtcctgtgaaaaaggattggttagacagataccatcaggcactgtactgagagtgaccactagcttgtttttctaatgcgtttacttacagctttgtaatgattggaatttcttagtaaaccagtataaag

SEQ ID NO: 116823 - DNA, 250 bp, Homo sapiens
  misc_feature (1)..(1): n is a, c, g, or t
ngctctagaggaccccgaaggcgctggctgggtctgctgtgcccacagtggctggcactgggtcaaccctcaagagacatgtgggcagggaacaaatgggcacccactgtatgcacaccatgtcttcagactctcaaaacaattcttcaaggtagatgtgagtatccccatcctacagatgaggaaactgaggctcagatatgtagaggaacatgcactgactcgcacagccaataagaggcagaagagg

SEQ ID NO: 116824 - DNA, 214 bp, Homo sapiens
catttttttaatgcctatcaagcttggatttgggatggcctctcagaggcagacacaaggcccaggccaattgcacattttgatgctcacagggttaaaaaagaaaaaaataataaagttgaaaaaactctggaatatactaaacgtttgcattggaaacatctgaactttaaacaactacataaatatcgtaattgtgctgctcatttgcata

SEQ ID NO: 116825 - DNA, 568 bp, Homo sapiens
ggtctgtaaacttgcttaatctagtgcagaagccttagatctttcctagaaagtcagtgattttgactttcttgcctcatttcaaagtcatctgtcatgtgttcccactctgttgggttcagagggctctgtggacagtttggcttgaagatttcctctccatccagccttctggagggtgaaagtggacgtgctacacttgcttacaaaaaggaaagatgaccataatgtagcattttctggctgggtgcagtggctcacacctgtaatcccagcactttgggaggctgagatagatcacttgaggtcagtagttcaagaccagcctggccaacatgacaaaagcccatctctactaaaaataaaaaaatcagctggcatggtggcgcatgcctgtagtcccagctacttgggaggccaagacagcagaatcgcttgaaccttggaggctgaggttacagtgagtcgagatcatgccactgcattccagcctgggtgacaaagagagacaatttctcaaaaaaaaaaataataaaataagtaaagcaagcagtagaagtgggtttgg

SEQ ID NO: 116826 - DNA, 416 bp, Homo sapiens
agccaatgaattaacgttttaattttcttttttcttccagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttgtatcatggggctagggatatagatacataatttttagagttaaaatgattgtgtgtgtgtgtgtgtgtgtgtgtgtgtgtatttacctgaacaccaaaggtcagtaaaatgaaacagccagttaaccagattgctttgggaatattctagcatctaatttgtaaattatatctgtatt

SEQ ID NO: 116827 - DNA, 1068 bp, Homo sapiens
cagagacgactaccaaaccccaagccacatctgccccgtcccccgcccccaagcaaagcttcctgtttggaacacagaacacctcaccttccagccctgccgcccctgctgcatcttcagcatctcccatgttcaagcccattttcacggctccacccaagagtgagaaggaaggcctcacaccgcctggcccttcagtctcagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcccactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccagcccttacccccagctttggcagctctttcacttttggaaactctgcagcccggccggtatggaccaaacctgactggttccgatcagatcgtggctggcagtgcgacccatcagctacttgggggcccgcaccggttggtgaagccgatcgctcggggcgcg

SEQ ID NO: 116828 - DNA, 855 bp, Homo sapiens
caggtcatttaacttttcagccagtttctccagctgtgaaatatagataataatgttcccactccacatggcagtcatgagaatttgatgaaatcatacatgtaaaatgcaggcatagcaaatggtccatgaatgtgagctgctgttaagattaattttattctctcctgtttaattatttattttgtccattcctttctctctcatgcattcatccaacaaatatttactgagggctcactgtgagctaaacaatttctgccactccctgaggcttcagagagctgcctcctgtgtatcctgtagcttccagttccttctgctatccggccctaggcccaggaattctggttcatggtgtggacagcacatacatatgtgataaggggaacaccatgtccagtcctgggatacaacaaatgcaggtttagcatagggacagctacagaaaccatttggcttggtttcactttgtcagagggcctcaggatgaaattattgctactacctgcagacgaggttatatatccaatatacagacatgagatgtaagcattcaccgggtaactttatcaggtaattcacatcccatagctagacttccctgcctgtaaaaccctatgaatatgtgtttgcaatcttgtggaaagcataattgttcactatactttcacgtacatgtgaaaagcattattgtgttacatttctgtaaaaatgttttagcatttgtaataatcataagagccttaagagtggctcagggttctttctacctctgagaggccccgggaagcattcaaccatgaagcagtcatggagttgaggagcgcaaactccagtgaggtgtttgcggaa

SEQ ID NO: 116829 - DNA, 785 bp, Homo sapiens
ggcttcatcatcttactgttttgcaggtcagaagccctaaaagaaggtgacggcagggttggttcctcccaaaagctctgggaagaatctggtccttgccttttccagattctagaaacctccctcatattttgcctcgtgatcccctcctcacacttcagagcccgtcggcacaacctctgcttctgttatctttccttcacattgacccttctgccttcctcataaatagaaccttgtgattacgtttggccaacccagataatccagtctatctttccatctctagacccttattttaatcatacctgcaaactcctttttgccatgtaaggtaacatagtcccagattctggggactgggatgtagacatctttggaggcccttattctgcctaccacagtcatgatgagttggggcaatgttgctgactgacgacacacagaacctctaaaacattcttttactttccctgttcgtctccattgtaaatagggattctttgtctagggtttggggtttaagcctgttaatttagtagaacctcatttttctcttctacccctggaagatttttttccactgaggctgtgattcctagagtcagccagtatttcttgagttctatttattgtgcacctgggtacacaaaatgagtaagatacgaccctggaccttatggactgctagaggagaaagatgttactgcagtagagtacatgttgtgttgatttcattttctagatatctttaggttccgtccctttgtttctgtcttctctca

SEQ ID NO: 116830 - DNA, 322 bp, Homo sapiens
ttggttaatcctggactttgtttttattttaatacttggtgacttaatcagaatttagtggggattgactgcactgccattagatacaagtaagaaatgatatgtgtgggatgaaaaccacaagttctcctctgcttgtgcctatcctctgaatttctttaaaagagaaattaatgtaacaataaatttgttgggggagggggcattgattcttattgccctctttgatctttctcttatttcccacagatttgttaccatttcccttttttccctctctcatctcctgccatctcacattgctactggttctacacctctt

SEQ ID NO: 116831 - DNA, 760 bp, Homo sapiens
cggaggggagccaagatggccgaataggaacagctccggtctacagctcccagcgtgagcgacccagaagacgggtgatttctgcatttccatctgaggtaccgggttcatctcactagggagtgtcagacagtgggcgcagtttggagttgttgctacctgtgtctacccagccaaggactttatgcctcaggccttcatattcaggacatgtttctcatgaaaattttggaaatgtgaaattacagaaaagcccaaaggaaaacaatgaaaatctcttgcaactacagtacttagaaaaatgcctattatcattttgttttatatccctgctgtctttatatgtacaacttgcattttgcaagagtttagaaagttgtaaccttattttttaaatcagtgcataactaatattttttatgctattaaaatattattttaagatgtaatatctaatcacatgtctgcatcataatctacttaatctccccttgttcacaattaagtagtttccaatttttcactatcaaagtaatgctacaacaagaaggatatcctggtatataaataattttacacaacacagttatttccttgacataaatacctagaatagaattagtcaaacataagaaattaatatttaatacctccgatacatcctgccatgctgcccacaaaaagaccataccaagttacaccaccaccgaaaatgtgttaaaggatcagtttgctcaaaacttaaataaaatagagtaag

SEQ ID NO: 116832 - DNA, 187 bp, Homo sapiens
tggagggtttgagttgggcagtggagtggacaggatccaccctgccttttaacagacttgccctgggtcctgtgtggagaaagtgaaggccagccagggtggaagagggagacaagttaggaggctgttgccatcatccaggggaaagatgcatccagggtgtactctgaagtacagccagtaggct

SEQ ID NO: 116833 - DNA, 426 bp, Homo sapiens
gcccattttgatgttgtctacttaacaaagcagaacagatgaggcaaacctaatataagaaaaatccagatttatcaggaggtaattaatcatattacaaaaggcttcactgttgggtttctttaaatagcttaccttcctaatgcttttaaaatataatttgatgtagaaaatacatttgttgcataaatgaggtatatttgtgcttatatggctgcaatgggcctactcatctctaatccatctaatatcattctgggttcctggttttcagcaaacctgtcctggacttattaaagacaaggtcccagattagtatcttctttctgataaaaacacactcaaagacaaagagaacggtttctgcaaccccaaagcatttccaccaatattcttcagacgtcctcaaatttgccctgggtatcc

SEQ ID NO: 116834 - DNA, 890 bp, Homo sapiens
cgaccccaccccgcgggccactcagcggcccgagctggaagcgcggggcagcggaggctgccgggctgtgtccttcgcggggccgccaccgcccctcctgaaaggccgcggagccctcagggcatgcggatgttccgaggatggagaagctgagactcacagcgaggacgggccagggtctccccaagcctcagttcccagagcccttccatccccgggttctccaccaggatcctctgccagcccagccccaagggcgcactttcccaccaggtttctagagagtggctgggaaactcgtcgccaaaccctgcccagctcagctctgctgggaccccagaccccagaacggcgcagcgggagtccctgagccccaacagcggccccagctcccgtggcctcagcctctggctttccctaaaggactgtgggcctcagccccctgttcccctagcccaccaggtccccaggctctttcccccagtctttgcctatctgtgatctgctccttcccccatgctccgaagttccaacgggctctgccgtgtctggtaataaataggactgttgggctcaaccaacaaacacacaaacgacacacaccagacacaccacacacaccaacaacaacaacaccacacgcacccaacccacaacacacaccacaagcaggccacccacacagaggaccacccggggcaggccgccccagccacccccgctgcgggccgacacaggagcacccctgagaggacagaccgcatcaagagacccggacggcgcgggcaagctcctaccacgcgcgacgaaggaacaccggagggggcctgcgcgcaccgcgaaggagagcctacgaaagagcgggcgggaacaccactacgcgcccggac

SEQ ID NO: 116835 - DNA, 379 bp, Homo sapiens
gaaacgacaaatcttttgcattagactcagagttgactaaaactatggcagcttttcataaagtcaggctatagatgtccctaattcccccacagagcccacagccctttgaaagtgatgatagaatactggggatggatcagagagtgctgagaggagagtggaagggaagaagggacaaagggaaaggaatccagagtgggaagagttggattcgtagagccagcagatggtgttggtgataaagaagattacgtgactcatttctgtaacccatgagtgtcaaagttctccactcagtgccatgtctccatcccattacccccacctaaataagttatctgttctaacacccatctgtccccacaccaaaccatca

SEQ ID NO: 116836 - DNA, 332 bp, Homo sapiens
tcccttgggtggtccttatgtccacccaaggtcaagagccattttccaaagaaggaactgggggccgggtgaagtggctcctgcctgtaatcccagcactttgggaggccgaggtgggtggatcatctgaggtcaggagttcgagaccagcctggccaacatggtgaaaccccatctctactaaaaatacaaaaattagctgggcatggtggcgcatgcctgtaatcccagctactcaggaggctgaggcagaagaatcacttgacccaggaggcggaggttgcagtgagccgagatcataccactgtactccagcctaggtgacagatcta

SEQ ID NO: 116837 - DNA, 505 bp, Homo sapiens
aagggtttcttggattactctacaaagctagtaggcagctttggttcagttatgactcagtgaaggttagagaattatatctacaaagtaggatctttttctttctttctttcgttttttgatacggagtttcgctcttgttgcccaggctggaatgtaatagcgcgatctcggctcactgcaacctctgcctcccgggttcaagcgattctcctgcctcagcctcttgatgcctggcgaattttttttgtatttttagtagtgacggggtttcaccatgttggccaggctggtctggaactcctgacctcaagtgattcacctgtatcggccttccgaagtgctggggtggtgtgagccaccgcgccctgccagatctttcttgtttgactttcattgctaagaatttgggtgagtgttgttgaatcaaagacatctttattctctgcctcctcaccatgcacatacgtacaaatgtctgctgacagatatctgcccttcctat

SEQ ID NO: 116838 - DNA, 315 bp, Homo sapiens
ttacctggaagtagaatgcgcctttaataaatacctaaaaacatggaagtggctttggaactgggcaggggacagaggctagaattttaagaagcataatttctgaaggctggacacagtggctcacgcctgcaatcccagcactttgggaggccaaggcgggtgaactgcttgaggtcaggagttcgagaccagcctgaccagcatggtgaaaccctgtttctattaaaaatacaaaaattagcctggcatggtggtgggcacctgtaaaccccagctatttgggaggctgaggcaggagaatcacttgaaccc

SEQ ID NO: 116839 - DNA, 482 bp, Homo sapiens
tccgtttgcagatgacatgattgtatatttagaaaacctcatcttctcagcccgaaatctccttaggctgataagcaacttcagcaaagtctcgggatacaaaatcagtgtgcaaaaatcacaagcattcttacacacccagccccattttcgacgccctctacttggcagccggtgagcccccggcccctgcgtttctggctccagccccaggtggcggcgctgtaggctggagcccctggaaagcgctggcctggcagccctggggagtgttccaggcccttggaccgcagggagggcaaccaaatggcagaggcggtaacggagagcatccctgaacggtaaaaagtcgtctaaaggatcgaagaaacggagtgtgagcgagtccgtgggcgggacagcaccttcgggtgccggtcagaggagcgagcggcggaagaggcgggtccagggcggtgtaattaaggcgcggagcccagacc

SEQ ID NO: 116840 - DNA, 407 bp, Homo sapiens
catccctaccacttaagaattgaggcttcacttcacagaagaagctccccctcctcaaaagaagcacaaaaaggaatggaagaaggatacaggaaataaactccaatgctacgaatcacactaagtttccatttccctccactaataatagctgtaacaatcccttggggagtcacaaaagggtgggatctacctaacttaaccttagagggcattccttaattgaaatcctaagtaagttcttctactgcaacctctggattagattttgtgtgtgtgtgtgtgtgtgtgtgtgtgtgtgtgtgtgtctcatctccaattattttccttggccttagagtgctgactagcttgtggtcttccgcagtagggcgcgcgcaactgatacggcggggggtaccgagctc

SEQ ID NO: 116841 - DNA, 343 bp, Homo sapiens
ggattggaatgcagttcgtaaggaggccttttgtccctgggtttttcagatgggaatctgagccattatgtcaaaaattttacctccaatttattccttactgaaggtgagatatatgggccttctaggctggtttttcctggtggtaggggcagacctctgtgtcagaagccacctgggttgcttatttaaaatgtaggttgggacttagagggtgcagcagttcccatcctagacctactgaatcagactctcaggggatagaggtctggactctgcatttgtaacaggtatagctcaagtaattatgatttatgttagtgattaagatcactgcctatat

SEQ ID NO: 116842 - DNA, 406 bp, Homo sapiens
tgttgctaatgctactcataataggaagctcagttttaaccctgggggttggggaagagcagcaagcctggggttagagaaacagacacgtataaaaagcatcatccagccgagtgcggcggctcacgcctgtaatgccaacactttgagaggccgaggagagcagattgtatgagctcaggagttggacaccagcctgggcaatatggcaaaacctcatctctacaaaaaatacaaaaattagctgggtgtggtggtgtgcgcctatagtccctgctactcaggaggctgaggtaggaggatcacttgagcccaagaggttgaggctgcaggatctcgccactgcactccagcctgggcgacagagcaagaccctgtctcaaaaaaaaaaagaaagcaaagaaag

SEQ ID NO: 116843 - DNA, 500 bp, Homo sapiens
ttattcatttattgacatataaacaaaatgtcatttgtttattcaataaacatttattaaatccctagtaaatttcagacatgatgccagtcacagggatgacaatgacgataagatgtggtctctgccctcaaggagctgatagcccaggagactgacaagtagacagatgattatgtgcaatgtaacaaaggctgtgatgtcatacaagaagacaagtgagagtatgtgataggagtatggttttgaccagttcctcctcttagatttatcccttttactttggctataaagcaaaagaattggtcctattttttttttccttaactgtgcaaattaaaccataaaatttaaaaactttatgaagataaaaggcaagcagtcaggtgcagtggctcacgcctgcaatcccaacactttggtaggccaagggggatggatcacctgaggctaggagtccgagaccagcctgtccaacatgacaaaaccccgtctgcacc

SEQ ID NO: 116844 - DNA, 413 bp, Homo sapiens
actggatgtgggtggaactccagcccctgcccttcgctcactctgctccagccacgtcacctcctccgggctcctacatgccccaatcacattcccacctcagggtctttgcaaatgctattccctctgcctagaagcctctcttcccaggtcctcctcattcctgggcacctgggaagcctccacctcctagttcagatctttgctgcaaggccacctcctcagagagccctttcctgaccaccttggttcattctgtattaacatgttttcttgttcactcacaaagactgaaacccacgacagcagcaactttgttttttttcccatttggtttccccagcccctagagcatcctggcacatggcacctaatcaataaatattccttggtgatcgtggggttgtaagggg

SEQ ID NO: 116845 - DNA, 447 bp, Homo sapiens
ctgatactggcataaagacggacacgtagctgcatcgaacagaacagagagcccagaaataaatccacgcacgtatggtttgaccttggtactttttgacgaagtaccaagaatatacaatggagaatggatagtctctaacaaatagtgccgggaacactgtaattaatatattcaccctgttttatagttgtttgaaatgaaagagctaatctgatgctaattattccatcatggcttaagagtttttagtttttaatcataaatgtgttttaaattttattgaatgcattcttttttacctataaaggttatcttgtgacctttaaaaaataaatgaataaaaaataaaattgaaccatcactttatactacacacaaaaagcaactcaaaatgttttaaagacttaaatgcaagacctgaaactgtaaaatttaaaaaaagaa

SEQ ID NO: 116846 - DNA, 594 bp, Homo sapiens
tttgactgaggacggtcagttgggccatttttccaagtgatgtcccattaagagtggctgcccagagaaagggcctagggctcttactgctgagattcccgaactagtccaaagcctgggtgttgagcttttactttgaccctagaagcttttccatgccaggacaaataaagccctgttgttattctttcacctaatattcctttggagcgttgatcagtatggtccacagtcagctaggagtgttttttagaggaaaaaaaaaaaatcagtggaggattagaaaagtcctgttcacagctttgtggggctgcttcctcaatccattttactcctcctcctcctggttctgggacaaatgagatgggccatccgccctgttgtgctttaggaatgcctctttgaaactgtcctctgaaaccctcaagatggatcagggcaggaccttaatcacgcttacccaagcccacattattcactaaactgagcatttacccctctgctgtgtcccttcctgaactgtacttagcaagctcatcaggttgtgaatggtaagtaaatgggtggccatgggctatacagtggcacctgaaa

SEQ ID NO: 116847 - DNA, 587 bp, Homo sapiens
ctgttctctgaaggttagtataaaagagatcattgttctggatagctctcttgttttcatattctcttaactcataagaaggagtaaaggctaagctccagaaacaccctggaaaggttttatgaagacctcaaataaaagttaaaggatctggttgataagtataagatttcttactgcttagaaggtttcaagccatttaggagtgacttatgccccccaaaggacatatgctgagcctggcagttagggagcactaatccctgagatgttagaatagctgttagaaatagatttggccaagactaagaggaaaacagagaatgtatactttgggtcaagtatgcaaggagaatattcatgcttgagaaacattacatacctagctttggacttgtgaggcatttaattgttttgttttagatgattgttttcataatctgattgtattaagaatgtgctacaaacacaaggtacaattctcttaaagtctcttaggaaagattgatcctcacttcattactcagttgctcatcagaccttcttctctgaataagaaggagtattttattttctgatagagcact

SEQ ID NO: 116848 - DNA, 767 bp, Homo sapiens
tatatttccaattgcttatattacatataattgatttttgcatactgacctagcatcttagaattcgctaagattatactagatttgagcttagcaaatctcatatttggtaggttccttaggattttctgcatacttgatcatatcctcaaatcaaataaaggaggtttattgctttgtttcaatctgcattctctctttctctatctgtctctctcattgcattgtctaggatcatagtataacattaggtagaaatgagaagaagtttagatgtttacccttgccttgttcttgattttcagagaaaagcattttatatttattgttaaacataatattagctctagattctttgcttgttttatttaagctcctttttatgtggttaagggaattcttttcttgtcctagtttgaagaaaacttttatctagataatgttggattttattaggtgatttatttgcatttagagaaatgataactttttctcacttatttggttaatatgatggagtgaattgattttcaaagtgaaattgttattgaatttatgggataaagtctacttggtcatgatgtgctatcatttttatgcattggtgaatcctaattgtattttataaaaagtttatacatgcagtatgtacatatatagatacatataaatatacacacatatgaacaaactcatattagactgtagtttacttgtaatatcataatctggttttgttattttaattaataaagacagtactatta

SEQ ID NO: 116849 - DNA, 429 bp, Homo sapiens
tgaggtgactctacaggatcttaatcggaaccaatgagccaaaatgggtctgtgagttggaggatccagtggtaacacagagtgggcgatgatgaggtctggagtgtgacccagggactgggcacctgagagtaaggaggaaagtaagtttgtcagaaacctgagaggccaaggtgttggctaggtcgttggctggacatttccgtgtggtccttcagctacactgtgcatccttctcagccctgctctgtgccccagaggctgacctttaattaccatctcagtgccctttccctcagactgagagatacacagcctggaccagggaagacatggagacagagcatccattcctccagcccctcccctcaaggtccctgcaggtaggccgtgtctctactgaaacccaccgctcatttccctacaatt

SEQ ID NO: 116850 - DNA, 255 bp, Homo sapiens
gatttgtctgcctcaaggagaagagttggatcccagctgccaggggccctggggctgatgggagcagagtcctttccctgtggagtgacagatggtttcagacatcccccagttcttgtgtctgcgccactcatttgcctgtattaatgtagcaatgtcagtttcacccctcagtaccttacctttctctccctggggttgctatgatgctctctctgaggcaggagaatcactttaacccgggaggcagaggat

SEQ ID NO: 116851 - DNA, 911 bp, Homo sapiens
gctggaggctgaattaagaaagagcttgagcatctggagcatagatgttgtgttgcttgtgtattttttcgtctctctattgaactggatgatctgaatgtatttatatctaagaaacatctgcagcccttgattaatagtcatgagggttttttctttaactttttatagatgaacaggatgttgcaaagatagtaaaggggttctgtgtacccttcatctggttttccccagtggttacatcttacgtaactacagtacagcatgatgaaaccaggaaattggcattggtaccatctgctcatacagctctgtgcccctttatcacatttgtggattgtgtaaccattattatctcagtgaagatcctgaactattccgcccacctcagcctcccaaagtgctgggattacaggcatgagccaacacacccgggctatatttcggataagcttatctagtaggtttttgcaaaatagaaattttttttaatggtgctactagattctggtagtacatatctaggagtttatctgatacaaagagattattcactatagatttcgaataggtactagtcgtacaggtaatcaataattgggggagttgaacagtgtctatgaaggttgaaccacaatcgcccaccaccaacacagcactttttcgcgcgccgcctcgcgcctccaacaagaactttcaacagaaccaacgtcgctagggggcacgcggcccccggtaggcagaccgagacacgggggccaacacgcggggagtcacaaaggaagagaccgggcacagcaacacagcgcgtccagatgcccccgcgattacaaaaaccccccgggggacaccaggacgttgtcggacaaaacccacagaggggggttagagcgcgaagacgcggcgcacca

SEQ ID NO: 116852 - DNA, 273 bp, Homo sapiens
gacgctcttctccagccggagctgggactgttcagtcactgggagaagggatgtgggtctgaagagcttggttgcagaaacttcggggtctacaaaggccggcgggagctgagccaaaagagcttgtttgctgggaggcgggagatgcagccaggaggaacagctgggccatgcgggaggcagaggccgggcctcctcaagtcggcctctcagacccacttggcagcctcccggcgtcctctccgggcccagctcttcctcccggctgcgtct

SEQ ID NO: 116853 - DNA, 126 bp, Homo sapiens
tgatacttgcctaacatgcatgtgctgtaaaaatagttaacagggaaataacttgagatgatggctagctttgtttaatgtcttatgaaattttcatgaacaatccaagcataattgttaagaaca

SEQ ID NO: 116854 - DNA, 481 bp, Homo sapiens
tagtagaaacggggtttcactgtgttagccaagatggtcttgatctgaccttgtgatctgcccgccttggctcccaaagtgctgggattacaggtgtgagccactgcacccggccatttttgttttttttttttgagatggagtctcgctctgttgccaggctggagtgagatcctgtctttaaataaataaataaataaaatggcagtagcataacaagaatgaagctttccacatcttggtaagatctcctcttgtgtgccctactagggatctgcaagccaagggattgggttaagatatttgcttctgataagatttatatccttgaccattagattgggatcttaatgtagcctctcatgtgtgtgagatttctttttgtacatctgtagctcactagaaacatttctgtataagacgtctgaatcataactcaaacttgggtgtggcattaaggatgggcttgtttcttttaata

SEQ ID NO: 116855 - DNA, 349 bp, Homo sapiens
agaagctcttctgtcatgaacagaaaaattctcctgtcaccccatcacttagaaatttacatgagtttgctgggcgcggtatctcacgcctgtaatcccagcactttgggaggccgacacaggcggatcatgaggtcaggagatcgagaccatcctggctaacacggtgaaaccccgtctctactaaaaatacaaaaaaattagccgggcgtggtggcgggagcctgtagtcccagctactcatgaggctgaggcaggagaatggtgtgaacccgggaggcggagcttgcagtgagccgagattgcgccactgcactccagcctgggtgagagagtgagactccgtctc

SEQ ID NO: 116856 - DNA, 641 bp, Homo sapiens
ccccccccacaatgggacagcctgcctggcagctctttcctggtctcaggatgatgtgcaggcagaggcccctggcaaagcagaggcaaatctggatgcttcggttcattgtgctcagctttgataggaggatgccagccccgcctgccgtgcgccccaaggcccgtctacatgactgtgaccaaaacataatgactttcgtctaaattcactctctaaaaggaacaccctcctgaatcagcgtgttctcctcaaaggcgttatgggaacctgagctcactccgaagacattcccagttgctcaaggcaggggtgaggcccctccatggaacttggagctacacagagcttgagctccggtgtgggaggcctcgcaggaaggcatcgcggccttgatgggtgggcctcacattccagcgtgtgtgtgtcctgtgcccagaccctctgtgtgtcttctccatctcacacagacagtcccataggactcacgtgttttctttttgtcgcattgatggtttcctcagagggtgggtgtgttggggggtgtatgtgtggtgtgtgcatgtgcgtatatgcatgtgtgtggagggtgtgtgcatgtgtgtgtgtgtgcatgtgtgcgtgtgtgtgcatgtttgtga

SEQ ID NO: 116857 - DNA, 725 bp, Homo sapiens
gttgaccaggctgcagtgtagtagcatgatcttgactcactgcagccttgacctcctgagcgcaagggatcatcccacctcatcctgctgagtagctgggaccacatcatgcgccaccattcctggctaattttttgtattttttgtagagatggggtttctccatgttgtgcaggctggtcttgaactcctgagctcaagtgatccgcccaccttggcctcccaaagccttgggattacaggtgttagccagcgtgcccagcctaatattcttaaagtttattttgtttttctaattttgaattgaattattaatatatttaatttttttaagagactttgtctcaccttattgcccaggctggagtgcagtggtgcacttatagctcacagctttgaacttctgagctcaagcgatcctcccacccaagcctaagttgctgggaccacagtcgtgtaccaccatgcccagataatttttaaacattttgtcaaggtaatgtcttgctatgttgctcaggctggtcttgaactcctggcctaaagcttcctcccaccttggcctcttaaaatgttgggattataggagtgagccaccacacctggctttcagttaattcttacttagaaatggagcatttgagtctttatatatttatttgagtcaactttgactacattcccttgattttgatatatgtttcttttatataactttctagata

SEQ ID NO: 116858 - DNA, 345 bp, Homo sapiens
agtgaagcaaaggactagggacagtggggaatctatttctgtgactggctcctgcagtttccaggccaacagttccctgtggcagcatcaaccatccagtgctggtggtggtgccgccaggatatccacgactcagctgtgcagcagtcttctcaccaggtagtcccattggtgtgattatggttgtggctctcacttccttgcctccatttgttcctagtcattttctgaccctgattctctaagccctcccagtgagtcagtgagctacctgatatctctttggttctcttttccctgtttatatcagcaagaatcaatttctgatgttgtagctaagaaatc

SEQ ID NO: 116859 - DNA, 191 bp, Homo sapiens
tatagaatgtggaactttgcggggaggaaggcaagagtcaggctgtttttatggcactgcttggaagatggagttcgctgcatttgtcctgagcctttatctctgttgcagctccataaaggatttgaaaattcagcccaacaaaggaaatcttcttaatctggcttttctctgcttccccaccaccatct

SEQ ID NO: 116860 - DNA, 818 bp, Homo sapiens
tcagacatctgcttaacctgctctccttaggaaggcctctccagtgggttaggactatacagaggtgccccggcactaatgccccatttaaggttgaaagctcagctgagagaaaaagtgtggtgtcatcgggtacccatcctagtaatagttgccttccataaggaggattaacctgcatctcaggctccactaggccaacacaaattccccttcagaaaccagatcctcatctctcaccttacacaaaaatcaactcaagatggtcaaaggctgaaagctaaaacctgaaaccaatacaagttctagaagataacatcggaaaaactcttccagacattggcttaggcaaagaattcatgactaagaccccaaaagcaaatgcaacaaaaacataaataaatgggacctaattaaactaaaaggcttctgcacagcaagagaaatagcagtgtaaacagacaacccacagagtgggagaaaatcttcgcaaactatgattccgacaaaggactaacacccagagtctacaaggaactcaaacaatcggcaagaaacaaacaaacaaacaaaaaaccaaataatcccatcaaaaaatgggcaaaggacatgaatagacaatctgaaaaagaagatacacagccaacaaacatgaaaaaatgctcaacatcactaattatcagagaaatgcaaattaaaaccacaatgtgataccaccttactcctgcaagaatggccataattaaaaagcaaaaaaattacagatgttggtgtggatgtggtgaaaagggaacacttttacaatgctggtgggaata

SEQ ID NO: 116861 - DNA, 207 bp, Homo sapiens
agtattcccacacaatcatgctctctcaggcttctgggtctgttaaaaaatgttcccactgtgcactgcatcctcccttcctctggctatcctttcactgtgcttaatagtccaccaaaagatcccttcctctgggaagtcttccttgactaatctctaccacatccgtggtagagtctcctctgatgcacttcctttggcactcta

SEQ ID NO: 116862 - DNA, 275 bp, Homo sapiens
aagattaataaataataggaaagcgggagtagagaagcaggagaaaggagatgggagaagctggcaaagatgaaacacagctctgctgagaagcatatatccaagaacaatcaacactataaatttcatggatgctgcatcagttacctattgctgtgaaacgacaactcccagatttagggacttaaaataacacatattcataatctcaccatttctgtggggcagaagtcagagtgcaccttagctcagggtctctcacaaggctgcaacca

SEQ ID NO: 116863 - DNA, 321 bp, Homo sapiens
  misc_feature (150)..(151): n is a, c, g, or t
  misc_feature (191)..(191): n is a, c, g, or t
  misc_feature (216)..(216): n is a, c, g, or t
  misc_feature (226)..(226): n is a, c, g, or t
  misc_feature (237)..(237): n is a, c, g, or t
  misc_feature (239)..(240): n is a, c, g, or t
ttgccacaggtcccatattttacatattctactcttacagaactctaagggatagatactatgtctccctttaaaaaatctgtttccggagccaggctgggtggttcacatctataatcctagcactagtgggcagcatctcagctactnnagccccgcctcccgtgctcaagcgatcctcccacgtcagnctcccaagaaggtggtattattggncacgcctggncagtttttgtntnntttgtagagaggaggtctcactgtgttgcccaggctgatcttgtactcctgagctccagcaatccacccgccttgggctct

SEQ ID NO: 116864 - DNA, 126 bp, Homo sapiens
ctactgtgcattttcattattgacagttgcgttgcagaagaatttttcttgcaaatgcaggccaatttttccatgaattttaggtgatctcctatttataaataaagccactgaaagggtttttgt

SEQ ID NO: 116865 - DNA, 318 bp, Homo sapiens
tgggatagagggggcaccctgctggcctcatcacagctgcttggcctcaggtgggacgctctgggtgacctctggatcctgtgctctgtggaggagacctgggagatgcctttctgtgacctatggattccttgggaaaagactttgagcaaattcggtccccaggaggaattgttcattcagtgtcttgtgtatttatctctctttactgctctgaagttagggattcaatttcaactgctttcaagattagttacccttgaaattttgccatgcatacttaacttagcaaagtctaaagttaatcaataacttaac

SEQ ID NO: 116866 - DNA, 762 bp, Homo sapiens
tgcacttgccggcccctaactctgtagctgcacacagggcctgggcacttgagacctcagactcgccaccggctcctcagagcccctgcccaggtcacctgtgtaaggagaacacagtgccaatgcagcacagcatagtgacacccggcctgccgggatttagcccccaccctacctagcggttctggagctgccactgtgacccatgcagggtcgagcatcccaggctcataggaggaatggacttgccttgtctcagctcgaattctctctcctgccaccctgagaagaggtgccttccaccatgattgcactccctccaagacagacttctctgtggaagcagcatattggaggcctgctaggacagttcacaggaatggctgtggagggctgcaggcatgtctctaatcagaacctgcttgtctttttgattgacagctgcactttctccaccaagaagtgggtactgtgcaagttatggtcatagtgaaggtgggggacatggagatgatcccgaatgagctgcataggcctcatcgaatcagtggaaagccttgagaacagagccaaagtttctctgaggaaggggaaattctacctgtagacagcagcttcagttcctgctgcagtttccagcctgcccttcctgatggccttccctgtggattccagatttgccagccagtcctcatagccacataagccaattgcttgtaataaatctcctagtgttaatgatcctttaataatatacatata

SEQ ID NO: 116867 - DNA, 478 bp, Homo sapiens
aagcatccagcacaggagaaagatgaaggctgggaggctaggccagtctagtcttttcacatttttctgcctgtattatatactagcctcactggcagctgatgagatggtgaccacccagattaagggtgggtctgcctttcccagcccactgactcaaatgttaatctcctttggcaacaccctcacagacacacccaggatcaatactttgcatccttgaatccaatcaagttgacactcagtattaactatcacagctaagaaggaaaaaggaaaagcaattttatgcgcctttcctctccactccctctttcttttttgtacagacaaccacatttaaattgggtagtggtctcttttggtatttggtattcatacttctgtatcttttttttttcccctcagatattatccatgaacttcttactgcagaaaatgagaatttagctgttttaaaccacttctttcaccattc

SEQ ID NO: 116868 - DNA, 141 bp, Homo sapiens
cagaaaatttctttgtgcaccaccaagtcaagaatcctcattcagagtgaaccattcttctcatttttattagcatgaccttttttctttctatttttgaattaagtataaataaataaatggaatgatacagaatgtatt

SEQ ID NO: 116869 - DNA, 589 bp, Homo sapiens
gggagtgtgttctctgtccacagggaaggtcattcattctgagatttgtgttttaggtagatcttcatggctgtgtttggatttgagggtcacaagtctggacacatggagacaattagaaagcttttgagactgggcatggtggctaatgcaatacaaattcaaaattacagggctacaaagacattctgacctcaaatctgctgacaaattcattctttccaccgcataactgacaatctgcacaatcaaaggtaacatcggttagtagaaaaaaaatttttttctttgtttttttgagacggagtctcgctctgttgccctgaagagcagtggcacgatctcggctcactgcaacctccaccttccgggttcaagcaatccttctgcctcagcttcctgagtagctgggattacaggcacccgccactatgctaggctaatttatgtattttgggtagagactaggtttaactatgtaggttagactggtctcgatctcccgacctcgtgatccgcctccctctgcctcccaaagtgctgggagtacgggttagagccaccgtacttggcccaagaatttttttta

SEQ ID NO: 116870 - DNA, 245 bp, Homo sapiens
tcaggcttcataacgtagtgtcccaggaaactcactcatccctgccgctcccagctgggggtacataggctgcttctctggagctaccaccgtgccacgcttttctctccagttcttttcttctctgtggctcagaggaacacagagaaatcagcaacctactgccttagcagatgagcagccagtgaaagtgatgttggtcttcccctctttaggcccgcccccctggtctctgtgtgattccg

SEQ ID NO: 116871 - DNA, 160 bp, Homo sapiens
ggcgggtgtgggagtacacttcgtctaagctgaggaagggggccctggccagaacagcccagcagggccagccctgagttcctggctttggcagcactcctcccaaacccaccagtcaagtctgccctcgccccctccagcggccccatgtgtggcggag

SEQ ID NO: 116872 - DNA, 500 bp, Homo sapiens
cgagtagctgggattacaggtgcccgccacccagatgatttttgtatttttagtagagatggggtttcaccatgttggccaggctcatctcgaactcctgaactcaagtgatctgcctgcctcagcctcccaaaatgcagggattacagacatgagctaccactccgggcctccatttcttttttgtagtctttaataaacagctgctatcgttgcagacttgctatttaggcacttaggaatttttcactagaaggcgtgtaaagaaagaccacggacctttgtaaggaatttagcattcattctttgactacatgactgtccccagagctataactttactaatgaattttttagaagccacttagctagcaactgagcctaatcagccactcaccctcgttattcagtgctctttttttattgtctatttctcctccaacttggctatactcacaaagtaataaaaacttgcatttgttttctttccttttcagaga

SEQ ID NO: 116873 - DNA, 264 bp, Homo sapiens
cacttaaatttaggctcccttaaaggagtagttttagaggttggtgtttgagagttgttctgaacccaggagtgaccttcttagctgtttccctgattctctctggtatactagttggcctgtggtttagcttgtgtctcatgaagctaccagcttcctcttaattacttaccaacagaacctcctccaccattttcgagcatgcccttaggcttgagctctcccacgctgtttcaagtcaagtcagttctttggggagagact

SEQ ID NO: 116874 - DNA, 659 bp, Homo sapiens
tatagtggctaacccctgtaatcccaacactttggaaggacaaggcaggaggatcacttgaggccaggagctcaagaccagctcaggcaacatggcaagacctcattgtctctacaaaaaataaaaaaattagctagatgtggtgacgatgtgaatgatcttaagcaaagtcaagacacacatgacggaatccactaaaagactcttaggactaacacctaggttacaggagacaaactcaatacatgaaacacatctgtcagggtaaactggtgggaaaaaaaaatcaattgtatttctatacatagcaataaacaatccaaaaatttaatttaaaatatccaattggagggctgggcgtggtggcatgcctgtcatcccagcactttgggaggctgaggcaggcggatcacgaggtcaagagatcgagaccgtcctggccaacacggtgaaactctttctctactaaaaacacaaaaatcagctgagtgtggtggtgcgtgcctgtggtcccagctactcgggaggctgaggcaggagaatcgcttgaacctgggaaacagaggttgcagtaagctgagaccgcaccactgcacgccagcctggtgacagagtgagactccatctaaaaaaaaataataataatagaataaaaataa

SEQ ID NO: 116875 - DNA, 611 bp, Homo sapiens
  misc_feature (564)..(564): n is a, c, g, or t
  misc_feature (601)..(601): n is a, c, g, or t
  misc_feature (608)..(608): n is a, c, g, or t
caaacatttattggcttactttttatacataaagcatttagcaaagaatttgacacattgccccatttattcccacaacagccctatgaggtagttatattattgtccctatcttacaaatgtgggaactgagagcagagattgattaactgtagcctgtgggccaaatccagccactgcccgttgttactggaacatagccttgttcattcattcatgtgttgtctatggctgctgccatttacattgagtagttgcttgcagcagaaaccatatatggcctgcatagcctaaaatattcagtgtctaaccctttataggaagagtttactgacttctactctagaaggttaatttataaggtgacaaaactagttatggtggaggcatgagtccaactccgttcagtttgattccaaagctcaggctcttggttgtcacatactcccactggaggcggtggattttcattaagtggtcgttagacaagttctggtgggtggggaaagtccaagatcaaagcgccagcaggtttgtagtctaatgagggctgctctctgcttncaagatggcccttgaatgctgagtcctccaaagtganaaacctntag

SEQ ID NO: 116876 - DNA, 3526 bp, Homo sapiens
aggtcctgggagcctggcaagcccacacagcgacggttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggctaaagaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaa

SEQ ID NO: 116877 - DNA, 972 bp, Homo sapiens
gcaacaagaggaatgaaaaacgaaacagcctgaatgaaccccgtgtcgtatggaaaaactcaaaagagaggctaaagaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaaaaaaaaaaaaggcctcttggcttacggtgaactttcggccgtccctttaaggggttattatgaccttgtcatgactctggctcggcgtcggtggggagcgatcat

SEQ ID NO: 116878 - DNA, 700 bp, Homo sapiens
tctaggcatctttttcctggattgcctatttatgtcctcaaatctcttcttacaaaattcaggaaaaactcaaaagagaggctaaagaaacacagctactcttaaagaaaaaaaagacaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaa

SEQ ID NO: 116879 - DNA, 397 bp, Homo sapiens
tgtttatttttgctaataagcaaaatgggatgaacttttctgttttataaattagtttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaattgcctgctatgtcatgaaatcttctagatgctgatgaaaaacagcagtgaacaaagtctctactcttacaagagtgtatattccatggtgtatatgtgccacattttctttatccagtctgtcattgatgggcatttgggttggttccaagtctttgctgttgtaaatagtgctgcaataaacatacgtgtgcatgtgtc

SEQ ID NO: 116880 - DNA, 1179 bp, Homo sapiens
gcaacaagaggaatgaaaaacgaaacagcctgaatgaaccccgtgtcgtatggaaaaactcaaaagagaggctaaagaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaaaaaaaaacaaaaatgcctcgttggccttaacggcggactcttgcgcccgttcccttagggagggtaattcagatcctcgtcactgactcctgcctgggcgttcggtgcgcaagcggataccctactcaagggggaatagggatccacaaaaagcgggatacccgataagaatgtagaaaaaggcccaaaaggcccaaaccgaaaaggccgtgttggggtgttcctaggcccgcccccagaagttcgaaaaggcgttatgcatgggcgaacccaaggcttaagaaccgggttccccggaggcctcgcgctctt

SEQ ID NO: 116881 - DNA, 3205 bp, Homo sapiens
aggtcctgggagcctggcaagcccacacagcgacggttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggctaaagaaacacagctactcttaaagaaaaaaaagacaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaa

SEQ ID NO: 116882 - DNA, 866 bp, Homo sapiens
taattatatatcggacatatgtacatgaaagaaaagaggggggcagcttaggaaaaactcaaaagagaggctaaagaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaa

SEQ ID NO: 116883 - DNA, 3517 bp, Homo sapiens
aggtcctgggagcctggcaagcccacacagcgacggttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggctaaagaaacacagctactcttaaagaaaaaaaagacaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaaaaaaaaacaaaaatgcctcgttggccttaacggcggactcttgcgcccgttcccttagggagggtaattcagatcctcgtcactgactcctgcctgggcgttcggtgcgcaagcggataccctactcaagggggaatagggatccacaaaaagcgggatacccgataagaatgtagaaaaaggcccaaaaggcccaaaccgaaaaggccgtgttggggtgttcctaggcccgcccccagaagttcgaaaaggcgttatgcatgggcgaacccaaggcttaagaaccgggttccccggaggcctcgcgctctt

SEQ ID NO: 116884 - DNA, 872 bp, Homo sapiens
tccttcaacatctcgcaatattcattcccgcgcccctcggttcctttttcacctcaggaaaaactcaaaagagaggctaaagaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaa

SEQ ID NO: 116885 - DNA, 1120 bp, Homo sapiens
aggtcctgggagcctggcaagcccacacagcgacggttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggttttttaaaaaaccaactctttgtattctttatatttgctaattcattaaaaacttaaaatttcaaaagaagt

SEQ ID NO: 116886 - DNA, 826 bp, Homo sapiens
  misc_feature (1)..(1): n is a, c, g, or t
nctaggagaactctcacgtacaggcatgagagccactacctactcttaaagcgtcaaaagacgagatttcaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaa

SEQ ID NO: 116887 - DNA, 1043 bp, Homo sapiens
aggtcctgggagcctggcaagcccacacagcgacggttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaattgcctgctatgtcatgaaatcttctagatgctgatgaaaaacagcagtgaacaaagtctctactcttacaagagtgtatattccatggtgtatatgtgccacattttctttatccagtctgtcattgatgggcatttgggttggttccaagtctttgctgttgtaaatagtgctgcaataaacatacgtgtgcatgtgtc

SEQ ID NO: 116888 - DNA, 867 bp, Homo sapiens
gcaacaagaggaatgaaaaacgaaacagcctgaatgaaccccgtgtcgtatggaaaaactcaaaagagaggctaaagaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaa

SEQ ID NO: 116889 - DNA, 3457 bp, Homo sapiens
gcgcaggaacttaagacagttcctcctggcgatgtgatggaatttaatgggacaggagaagggaacgggctttcttttcaggccagcgtggcagcgggcggtagggcgaaagggagaaggaaacgagggtttattccgttgcccactccgcgatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggctaaagaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaa

SEQ ID NO: 116890 - DNA, 691 bp, Homo sapiens
atctatacctaatcattccctgtctttcacttcccttcctcttcgctcctcaggaaaaactcaaaagagaggctaaagaaacacagctactcttaaagaaaaaaaagacaagagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattggtgttactttttcttgtattcatgaaaactgtttttactaagttttcaaatttgtaaagttagcctttgaatgctaggaatgcattattgagggtcattctttattctttactattaaaatattttggatgcaaa

SEQ ID NO: 116891 - DNA, 355 bp, Homo sapiens
tgagagagtcccactcttgcccaggccagagtgctgtggtgccttcacagctcaccacagcctcaatctcctgggctcaagcaatcctgcctcccaagccaagcagctggtactgcaagcatgtgccaccgtgcctggctcctgaagactgaggttggtttagattaatgagttgcccaaattcagacagttcttaagtggcaaagttaggattccaacccaggtcaacataactaaagcccaaaccccatctcacccctctaggccatcaaatattggctgggtgcggtggtttatgtctgcctccccggagtgttgggattgcaggggtgggccaccacgcccgggctattta

SEQ ID NO: 116892 - DNA, 989 bp, Homo sapiens
tgagagagtcccactcttgcccaggccagagtgctgtggtgccttcacagctcaccacagcctcaatctcctgggctcaagcaatcctgcctcccaagccaagcagctggtactgcaagcatgtgccaccgtgcctggctcctgaagactgaggttggtttagattaatgagttgcccaaattcagacagttcttaagtggcaaagttaggattccaacccaggtcaacataactaaagcccaaaccccatctcacccctctaggccatcaaatattggctgggtgcggtggtttatgtctgtagtcccagcactttgggaggcggaggcgggaggactgtttgagctcaggagtttgagaccagcctgggcaacataacaagaccctgtctctacaaaaatatataaattagccgggtgtactggctcacacctgtagctacttgggaggctgaggtgggaggatcgcttgagcctgggaggtcaaggctgcggtgacctgtgattgcaccaccaggagaccctgtcttaaaaatgtatatataaaaataaaaagaacatcagacatcaccatcacctcgcttagaatccatggggccttctcctcaaattcaatcttcccaggcatttcatgaacttgcgtctagtttctgttccctctcaaattgcccaggctgtcctgtgagtgacagcagctatttcgtgggcctcctctggaatcatgagaagtcacccaaacaatctcagttttctagctcactccgtcttgacatttctacactgtcatccttggttttcttggaaattaatttgcttttcttcattgtctttctttggagctgctttccttttgttggttactattttatttttagcttctcacaccataccgacatatgttggttattcttttagacatgttttttgttgttgttgtcacctggaacttttgtatcttgaataaatttggggatcaaatacaaattttc

SEQ ID NO: 116893 - DNA, 602 bp, Homo sapiens
tgcctcccaaaatgttgggattacaggcgtgagccaccacgcccagcctatttatttatttttttagaatcaagatcttgctatgttgcccaggctgaactcgaactcctgggctcaagcaatcctgcctcccaagccaagcagctggtactgcaagcatgtgccaccgtgcctggctcctgaagactgaggttggtttagattaatgagttgcccaaattcagacagttcttaagtggcaaagttaggattccaacccaggtcaacataactaaagcccaaaccccatctcacccctctaggccatcaaatattggctgggtgcggtggtttatgtctgtagtcccagcactttgggaggcggaggcgggaggactgtttgagctcaggagtttgagaccagcctgggcaacataacaagaccctgtctctacaaaaatatataaattagccgggtgtactggctcacacctgtagctacttgggaggctgaggtgggaggatcgcttgagcctgggaggtcaaggctgcggtgacctgtgattgcaccaccaggagaccctgtcttaaaaatgtatatataaaaataaaaagaacatcag

SEQ ID NO: 116894 - DNA, 851 bp, Homo sapiens
agcgggtgaggccagagcagcggggccgggcgcgcagggcctggccggagcccccactcccaggagtttcctctgcagagccccgcgccccccgcgcggggatttcagcccgatcccctcctctccctgcgcccagcctctccccagcatgtaaagtcttctgtctctcctcggagttggcggaggcggcaactttccattctcgccgccgggggccaggcagcagcgggcgcgcgggtcagcgctcagcacggcgggcagcgccgcgctgcgcaccgccgccgaccatgagcgaggacagccgcggaggccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcggggattcgttggtgccccgagactcactgagttgcgggggccttggagacctccaggtctgaaaagttagctctagagaagagagctccagtccagggaatcccggctgccctatcttccctcacttttcttttacccgcctccccagtctgctcaagtgcactgtgtaattgattttccttcttgttctttcctggagactttgttttaaagctttggttttgtgattaaaggtccagtcggctacatc

SEQ ID NO: 116895 - DNA, 569 bp, Homo sapiens
gtagtttttggcttcaggtggctgctgcattatttggtgcataggtattcataactgttatatatcactgaagaattgcaggttttagcattaatacctagtgttcgccattaatacctttttgcttgaactctgctttgtctgatatcagcataacaatcactgctttccgttttcattaagctagtacaactttttagcttttctctgtttttggtgtctcttgtatgtagtgtatatttgggccttgttttatgagacaaatttaaaatcttttttgtttaagcctgaaatgtatttgagttgagaaataaaggcagattttgatttggcatttggttgacagcgggtgtttaccataaattaaatgagctgtttgcagctctaccatttgggtaaaatatatttgaagtgtatgataagatcaaaacattttataaaacaaatgttatttcagcaaaaggatattggaattaacaatattttgatgttttctacccttttggactatataaaattaaactgctaagggaaacaatagcaggtataattcataatcatttgataag

SEQ ID NO: 116896 - DNA, 554 bp, Homo sapiens
atggggcttgtcatgcgtggatgcatcgggcgttctgatagaagctgtatatggatgtctcattcagtcccatgaggcagatggatcagtccccattttatacatgagaagctgaggcattgaactcaggcagtgactctggagcctctccttttaatccctgcagcagtctttgtgatagggtcaagtgggtatttattggaaaggtcccctgctctgtcccccttacccagtgcaggggttaagaagggcctgtttgttaggaaaagtcttcagcacaaccgatcctgcttgcttactgagctgctgacattctcagttttgagaacgaggtaggagagttgcagaatcagagggcaggagcgctgtgtttccagggtgccctgaaatggcagaggatccaggggccagaccagaatgacgaggaactcgccacaggcctggctcctcgcggggaggaaaacggaagatcagataacaagactaagcacgtgaactccagatgcataaccttggatcaaaattggggtgccagaccagagtgggtggacaga

SEQ ID NO: 116897 - DNA, 234 bp, Homo sapiens
atcaaacgacttacatcataaattatcaagataactgatactatctatattgtacaatgacagaacatatgcatttttactttatactcctaaattattgaatattagcaaagaaaggagggtcaacagtcatctaaatatataactttttattttacagagaattacccaaataggtgaaatggcttagataaattcacattgttttaggtatagagccaggacctcagtttt

SEQ ID NO: 116898 - DNA, 737 bp, Homo sapiens
aaaaagagcagttagatctcagattttctgagcaatccagtgccaagaggtgactgcccgcccccactcagctgtaagactggagttgtatgtattctctgagaataaaagggagccctttataatggggactctggccctttcttggtggaatatcttagagaacaggaaggttgggtgaacatcagtgtgcagaccagttccttaggccccagtctctatccacatttggtttccaagccccagcagtcaggagtagcccccaggaaggaaactgatgaattttctccagtaaatttctccagaggttctccagtaaaatggcggaggtggaccctcctgtgtatgccctccccatcctccgacgccacccagtcagctccatagagaaccattctcaagtgggagtgataggcctggttcagcagacatttgaggaaacactctcatttgaggaaccaagacaaaaagaggaagaaaacaaaaagcaagttgcaggcagcagatactgtgcagggggaagaaaactgttatacaaaactactgtaatatcctcagagagaatctctaaatacggaagagtcagaggaggaaccgatccccagaagtcagaaataagatatcatgaataaaaaactccaaagaagggttggatgaaaacttgacacttctaggaagaagaggacaataagagagacaacccaatgtccgaatagaaggagttttagaaaaagaga

SEQ ID NO: 116899 - DNA, 664 bp, Homo sapiens
agaactgccctggggttccgcccagcccaaacgggctagatgaaggtggagtccagaggcctccccgtcctgctggctgagggcctgggcctcaaacagctgcttcattatgagcgccgacttctgctccagctgcatgacgcgcccactcttctcggtcacctcctgggtgaggcgtcggttctgctccttcagcataaggatagtctgctgctgccaccccgggaaggaggtgaacgtcagggcagggcagaggggcccggaggaggacgtaggtagggcccggctggcaccggccgcagccagcaactcccccacgcaccgggccacctcctgtaccttaggcagtagccgccccagtgggtgggggctccccgcaggcccaaagtcggcgctggctctgctctggcccaggcggcactggcggtcctgcactggttgcagccgctgctggtaccagtcgcgaccccgccatcatctccaaaccctgcagcagcaccaccttctcctgctccagctccttcatctgcttcagcaggccgcagtccacgccgctggtgatggtgagcctccgacttcccttcgggcacggggggccagtcggacatcccgagtccacctccagggccctgcaggccaatgaacctgcgtccgcgcttgcgct

SEQ ID NO: 116900 - DNA, 683 bp, Homo sapiens
tgcagtttgcaatggaatatgacaaacagacatgctaaagaggttcaacaaaatttaaagggcaatgaaaaaattaaaatttgattttttattatgaaagtcacacgtgttccttgtagaaaattgggacaaaaagaaaggtagaaaaaagttaaaaatcagtcataatacaatcattattattttcttccagttgtttttcctgcattctttctacaagtggaggtgaataccctcagggaactatgaaataccaattacattttatccctattgtttgagtagtaattacaatagctaaattgtctcgaatgcttacatataccaggcgttctactaagcatatcacatacaaacttcagtcctctctggcaatgccatcaattctaaagaaatgttttgtagttccaagccatagttgaagacaccagatagagtcacaactaatttggatcacttgtgactatggagcccttagtcacaagtgatccaaatattatagaaaataagtatttaaatgacaaattaaagattaaaacattggtttaaggaatttgttttgttttgtaagagaagtaagaattttaagcatggtaaacttgtatattgctgttgcccaaatatactctttgccatcattttgatttactgagacctaatctgggtatgagaaaaacgaagta

SEQ ID NO: 116901 - DNA, 2014 bp, Homo sapiens
tttgctccccccttgattttcccaattgacagggatttctaaacctcttccattgaatggaaaggacagctgtagctgaagctggtggcttcattccattcatttggaaaacacagagataaaaacaagccaggcacgttgcactcttcctgaaaaagtgtcatcccttggagaagggctcagatgctgaatacacaactctctctttcagaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaattaatcctttggctcaagggcaataaaattttgtcttaaagtagcagatcctgctccatcaaagcacaactcaattgggagtaaatgcaaacatgtatctatattgagagatagattttactctgattagaaagatgaaggagggatttggggataaacaatatgaaaattgctgagcagagctgagccagccagaagaaaaagcgatagcaagagaaactgtaggcagatgcaacggcaggataaaatagctatgccaggggtgtgatggggcctgaggagagcatggcatggagacagacacgtgcagggaaccaagtggtgggaggacaagcccactcagagtgttgccgaactgtagcaaatcagtaactataattagcatagcctcagcaatgacaataatgatcatattctgaaaaaaatattggtctctgcttaaaatggcttgaagtcctgatgagggtgacattccatttcataacaaatacttttggaatggacttgaccaacaacctagagattttctttcagttgaccaactttgatttccaaaggtggagttacttttgtgaacccccaaaatctgagacaggtctcagttaatttagaaagtttattttgccagggttgaggatgtgcacccgtgacacagcctcaggtggtcctgatgacatgtgcccaaagcggtcagaacagtttggttttatgcattgtaggaagacatgagacatcgatcaacatatgtaagataaacattggttcagtctggaaaagccagagatgactcaaagtggggagggggcttccgggtcataggtaggtaagagacaaatggttgcattcttctgggtttctgattagtctctccaaaggaggcaatcagatatgcatttatctcagtgaacggagcaatgactttaatagaatgggaggcatgtatgccgtaagcagttcccaacttgacttttccctttagcttagtgattttggggacccaagatattttcctttcacactttggataagtaagatgtgtgaccctgcaaggaataacaaaaattattctgcttatatattcttagaggatacattaatgtctcagtgattgtcattcatctttcacagcgcccagcaaaatactcaataaatttgtgctaaaaacaaaatcaccagctcttcttgctctacttgtcctctttcaatctcttgctttagtgtttgcaccaaataaaccctcactctgcatatttgctttctgcttagaagctaagaaaggacttgctagcacaatttgatccatgcttctgaataaaaaataaccagagataaagttattctttggtcaagtgacagagattgaagccaatatataaatgagatcattttttaaaattgcactatatgtctcaagaatataactgttagacaattgatatggaatatgtgagaataggctacagcaagtctttaagcataaagccaagacagatcaagtttatctattaacttcatccaataagatttaactggccaggcacagtggcacatagctgtaatcccagcactttgggaggccaaggtgggcagatcacttgagcc

SEQ ID NO: 116902 - DNA, 2008 bp, Homo sapiens
gagagggctgactcagagtctgcacatggggtctgcttccaagttcttccaactgggcatatgcctccgccactctctgactgtcctttgcctgtgccaaggtttctgggaagaacaggaagttcagggatggcggaaaatgtttggcagattccctgagtccaaagccggagcacctgctcctgcctgagggcagagaggactgaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaattaatcctttggctcaagggcaataaaattttgtcttaaagtagcagatcctgctccatcaaagcacaactcaattgggagtaaatgcaaacatgtatctatattgagagatagattttactctgattagaaagatgaaggagggatttggggataaacaatatgaaaattgctgagcagagctgagccagccagaagaaaaagcgatagcaagagaaactgtaggcagatgcaacggcaggataaaatagctatgccaggggtgtgatggggcctgaggagagcatggcatggagacagacacgtgcagggaaccaagtggtgggaggacaagcccactcagagtgttgccgaactgtagcaaatcagtaactataattagcatagcctcagcaatgacaataatgatcatattctgaaaaaaatattggtctctgcttaaaatggcttgaagtcctgatgagggtgacattccatttcataacaaatacttttggaatggacttgaccaacaacctagagattttctttcagttgaccaactttgatttccaaaggtggagttacttttgtgaacccccaaaatctgagacaggtctcagttaatttagaaagtttattttgccagggttgaggatgtgcacccgtgacacagcctcaggtggtcctgatgacatgtgcccaaagcggtcagaacagtttggttttatgcattgtaggaagacatgagacatcgatcaacatatgtaagataaacattggttcagtctggaaaagccagagatgactcaaagtggggagggggcttccgggtcataggtaggtaagagacaaatggttgcattcttctgggtttctgattagtctctccaaaggaggcaatcagatatgcatttatctcagtgaacggagcaatgactttaatagaatgggaggcatgtatgccgtaagcagttcccaacttgacttttccctttagcttagtgattttggggacccaagatattttcctttcacactttggataagtaagatgtgtgaccctgcaaggaataacaaaaattattctgcttatatattcttagaggatacattaatgtctcagtgattgtcattcatctttcacagcgcccagcaaaatactcaataaatttgtgctaaaaacaaaatcaccagctcttcttgctctacttgtcctctttcaatctcttgctttagtgtttgcaccaaataaaccctcactctgcatatttgctttctgcttagaagctaagaaaggacttgctagcacaatttgatccatgcttctgaataaaaaataaccagagataaagttattctttggtcaagtgacagagattgaagccaatatataaatgagatcattttttaaaattgcactatatgtctcaagaatataactgttagacaattgatatggaatatgtgagaataggctacagcaagtctttaagcataaagccaagacagatcaagtttatctattaacttcatccaataagatttaactggccaggcacagtggcacatagctgtaatcccagcactttgggaggccaaggtgggcagatcacttgagcc

SEQ ID NO: 116903 - DNA, 748 bp, Homo sapiens
gagagggctgactcagagtctgcacatggggtctgcttccaagttcttccaactgggcatatgcctccgccactctctgactgtcctttgcctgtgccaaggtttctgggaagaacaggaagttcagggatggcggaaaatgtttggcagattccctgagtccaaagccggagcacctgctcctgcctgagggcagagaggactggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggagatctcggttcaaacctgttccttgggcggaagtctctaatcccatcaggatggttggggctctcttccaggggc

SEQ ID NO: 116904 - DNA, 547 bp, Homo sapiens
gtcatggcaagtatgaactacagacatttgtatattcactcatttagactgtgtcctagcccaatctaactctcatctgcccaaaaaaacttctcctttttatttaatttacatctgagttattctaacaatataacaatgattttaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggtaagtgcatttttaaaaaatctctaatattttccagcctgagcaacatagtgagaccttgtctctataaaaaaaaaaagaaataaaataatttaaagtagccaactgtgatgtcacctgtagtcctagctacttggggaggctgcagttggaggattgcttgagcccaggggttcaaggctgcagtgagctgtgattgtgccattgcactccagcctgggtgacaaagtgaagccctgtctcaaga

SEQ ID NO: 116905 - DNA, 671 bp, Homo sapiens
cagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagagtctcactatgttgcctatgctggtcttgaactcctggcctcaagcaatcttcccaccatagcctcccaaagggctgggatttctggtgtgagccaccacacctggcctgccctggaatcttaatgtaaagattcttgactgtcttctatgactacagggagcctgatgagactccactggaattttcagtgacacttat

SEQ ID NO: 116906 - DNA, 1115 bp, Homo sapiens
caaaatcagaagatatggataataatatatttttgtcctccaacctctaaaaaggctaaaattcagctaaaagcatcagtgtcaccaacgtgtctgctgtaagaaactgctttataatttcctgttattctacagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggaaacagatgcctaagaatgagtggaagatggaagatataaaaatcccactccctcagcctcaattccagtgtgctaagagtgatcctggtggttaaaggtacaacactcgaatctttcaaaacaacttggctcctaaacacaagccaacaatctcatctgctgctcaactgaaaaacattctccactttttagcatccaggcatgtggagttcctaagaaatgcactttattaatgcccaacatggtaccttcccaggagattttaatggtaattttca

SEQ ID NO: 116907 - DNA, 259 bp, Homo sapiens
gagacacgttctcactcagttgcccaacctggagtgcagtagcacggtcatagcttacagtaacctcaaacttctgggctcaagccatcctcctgcctcagccttttgagcaactaggactacagatgtgcgccgctgtgcctggccaatttacttatttatttgtttaatccctttttttcctttttttcttttttgatacagagtctcactatgttgcctatgctggtcttgaactcctggcctcaagcaatcttcc

SEQ ID NO: 116908 - DNA, 520 bp, Homo sapiens
caaaatcagaagatatggataataatatatttttgtcctccaacctctaaaaaggctaaaattcagctaaaagcatcagtgtcaccaacgtgtctgctgtaagaaactgctttataatttcctgttattctacagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggtactatgaatggcttttccttccatgggctcttctcagctgagacaggacctccagaattcctttgaaaattctttatgtttgtttattcactcaagaaacatttattggttgggcgcggtggctcatgcctgtaatcccagcactttgg

SEQ ID NO: 116909 - DNA, 2172 bp, Homo sapiens
caaaatcagaagatatggataataatatatttttgtcctccaacctctaaaaaggctaaaattcagctaaaagcatcagtgtcaccaacgtgtctgctgtaagaaactgctttataatttcctgttattctacagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaattaatcctttggctcaagggcaataaaattttgtcttaaagtagcagatcctgctccatcaaagcacaactcaattgggagtaaatgcaaacatgtatctatattgagagatagattttactctgattagaaagatgaaggagggatttggggataaacaatatgaaaattgctgagcagagctgagccagccagaagaaaaagcgatagcaagagaaactgtaggcagatgcaacggcaggataaaatagctatgccaggggtgtgatggggcctgaggagagcatggcatggagacagacacgtgcagggaaccaagtggtgggaggacaagcccactcagagtgttgccgaactgtagcaaatcagtaactataattagcatagcctcagcaatgacaataatgatcatattctgaaaaaaatattggtctctgcttaaaatggcttgaagtcctgatgagggtgacattccatttcataacaaatacttttggaatggacttgaccaacaacctagagattttctttcagttgaccaactttgatttccaaaggtggagttacttttgtgaacccccaaaatctgagacaggtctcagttaatttagaaagtttattttgccagggttgaggatgtgcacccgtgacacagcctcaggtggtcctgatgacatgtgcccaaagcggtcagaacagtttggttttatgcattgtaggaagacatgagacatcgatcaacatatgtaagataaacattggttcagtctggaaaagccagagatgactcaaagtggggagggggcttccgggtcataggtaggtaagagacaaatggttgcattcttctgggtttctgattagtctctccaaaggaggcaatcagatatgcatttatctcagtgaacggagcaatgactttaatagaatgggaggcatgtatgccgtaagcagttcccaacttgacttttccctttagcttagtgattttggggacccaagatattttcctttcacactttggataagtaagatgtgtgaccctgcaaggaataacaaaaattattctgcttatatattcttagaggatacattaatgtctcagtgattgtcattcatctttcacagcgcccagcaaaatactcaataaatttgtgctaaaaacaaaatcaccagctcttcttgctctacttgtcctctttcaatctcttgctttagtgtttgcaccaaataaaccctcactctgcatatttgctttctgcttagaagctaagaaaggacttgctagcacaatttgatccatgcttctgaataaaaaataaccagagataaagttattctttggtcaagtgacagagattgaagccaatatataaatgagatcattttttaaaattgcactatatgtctcaagaatataactgttagacaattgatatggaatatgtgagaataggctacagcaagtctttaagcataaagccaagacagatcaagtttatctattaacttcatccaataagatttaactggccaggcacagtggcacatagctgtaatcccagcactttgggaggccaaggtgggcagatcacttgagcc

SEQ ID NO: 116910 - DNA, 2178 bp, Homo sapiens
cagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaattaatcctttggctcaagggcaataaaattttgtcttaaagtagcagatcctgctccatcaaagcacaactcaattgggagtaaatgcaaacatgtatctatattgagagatagattttactctgattagaaagatgaaggagggatttggggataaacaatatgaaaattgctgagcagagctgagccagccagaagaaaaagcgatagcaagagaaactgtaggcagatgcaacggcaggataaaatagctatgccaggggtgtgatggggcctgaggagagcatggcatggagacagacacgtgcagggaaccaagtggtgggaggacaagcccactcagagtgttgccgaactgtagcaaatcagtaactataattagcatagcctcagcaatgacaataatgatcatattctgaaaaaaatattggtctctgcttaaaatggcttgaagtcctgatgagggtgacattccatttcataacaaatacttttggaatggacttgaccaacaacctagagattttctttcagttgaccaactttgatttccaaaggtggagttacttttgtgaacccccaaaatctgagacaggtctcagttaatttagaaagtttattttgccagggttgaggatgtgcacccgtgacacagcctcaggtggtcctgatgacatgtgcccaaagcggtcagaacagtttggttttatgcattgtaggaagacatgagacatcgatcaacatatgtaagataaacattggttcagtctggaaaagccagagatgactcaaagtggggagggggcttccgggtcataggtaggtaagagacaaatggttgcattcttctgggtttctgattagtctctccaaaggaggcaatcagatatgcatttatctcagtgaacggagcaatgactttaatagaatgggaggcatgtatgccgtaagcagttcccaacttgacttttccctttagcttagtgattttggggacccaagatattttcctttcacactttggataagtaagatgtgtgaccctgcaaggaataacaaaaattattctgcttatatattcttagaggatacattaatgtctcagtgattgtcattcatctttcacagcgcccagcaaaatactcaataaatttgtgctaaaaacaaaatcaccagctcttcttgctctacttgtcctctttcaatctcttgctttagtgtttgcaccaaataaaccctcactctgcatatttgctttctgcttagaagctaagaaaggacttgctagcacaatttgatccatgcttctgaataaaaaataaccagagataaagttattctttggtcaagtgacagagattgaagccaatatataaatgagatcattttttaaaattgcactatatgtctcaagaatataactgttagacaattgatatggaatatgtgagaataggctacagcaagtctttaagcataaagccaagacagatcaagtttatctattaacttcatccaataagatttaactggccaggcacagtggcacatagctgtaatcccagcactttgggaggccaaggtgggcagatcacttgagcc

SEQ ID NO: 116911 - DNA, 661 bp, Homo sapiens
agcggaaggtgcgggctggtatcatggcaggagcgcggcgccgcaggaggcgcctggcggagctgacggtggacgagttcctagcttcgggctttgactctaagtccgaatactctccagaagcggagacgcgggaggcacgcgaggctgcccggagtccggatgagccgggcgggagcccctcggccagccggcgtaaaggctgtgcctctgagcacaaagatcagctctctcggctgaaggacagagaccccgagttctacaagttcctgcaggagaatgaccagagccagctaaacttcagtgactcagacagctctgaggaggaagaggagccgttcaactccctgccagatgtgctggaggaagccagtgaggatgaggatggagcggaggagggggaagatggggacagggtccccagagggctgaaggggaagaattgtgttcctgtgaccctcgccatggttgagagatggaagcaggcagcaaagcaacacctcactccaaagctgttccatgaagtggtacaggcgttcggagcagctgtggccaccacccaaggggaccaggaaattgctgaggccaacaaattccaggtcagggacagtgctgtgttcaatgctctggtcaccttctgcatcagagaccttattggctg

SEQ ID NO: 116912 - DNA, 656 bp, Homo sapiens
tgctccagattttagggtctgtaaaaaaaaaaaagtactcaggtaaatgatcacttagagtaatttcattgatgtttcacagagtctgaaggggcgggttagaggagagtgagtttacaatcatttcctactgcagaaaagctcatatttcaaatgtaattcatcgctcttcgagagaaaaccatctaacactaaaaatgcagctgtaagccaggcatgatggtgcacacttgtaatcccagctactcaggaggctgaggtgggaggatcgcccaggagttcatgcctgtgaaaggccactgcactccagcctgagtaacacagcaagaccccatcactaaaagaaaggaatttaagaacaaaaaagcagccatactggaagtataggaaaggggctttgtaggaagaggcaggaaagaagttaactcagtgtccaaagttttgtcctaaagagaacaggaaattccctgggtggttttgcaaccactcggccccaaatgtggtttttgtgatcctgaattaattacctagttaggaaactgtgtagcccacacctgatggaaagctgccaacctaacactttttgttctaagacctagctggtgagaagtgagggacttggtaaaataaatgtggtgataaccacagaaaaataa

SEQ ID NO: 116913 - DNA, 586 bp, Homo sapiens
tataggcgtgagccaccacgcccagccccttttatcttctcttcctctttctcctttttttttcctcctcctcctccttctttctcttgtatttgtccattctcctttttccttaacttagtctattctgtgtattttctaagtaccaggattcttatttgtttgttaatgctaagtgtggtggtggtaaaccctgcatgctgtagtatgacagttactagactttgactgagtggtggctgtcctttgtaggccagggttcacagtagggaatgctaccagagaactgagctccctgatgttaatggtgatagtaggacttcagagtaacagtggccaggtggcaacattttaccatcatagtttgtggtgttttctgtctcctaattatgctgtaagcatggattgtgtgtgtgtgtgtgtgtgtgtgtgtgttgtttgtttgttttgagacagtgtcttggtctgttgcccaggctggagtgcagtgatgcaatcttggctcactgcggcctcaacttcccaggctcaagtgatcctcctgcctcagtccccctgagcagctgggactacaggcatgcgcccc

SEQ ID NO: 116914 - DNA, 391 bp, Homo sapiens
tgaaatggagtcttgctctgtcacccaggctggagtacaggggtgccatctcagctcactgcagcctccacctcccaggttcaagtgattctcctgcctcagcctcttcagtagctggaactacagtcgcctgccaccaagcctggtgaatttttgtatttttagtaaagatggggagaggaggcttcacgtcgagtgctgtgggcttgcactggaagagaagaagggacagccaagggaggcacctttcctgtggcagggcccttgaggactgacaagagctgggtccctggacggcaattagccactgaatgggacaggggaggaccatgttggagagaggccctgttttggttttgctggggtctggccatatttcttttttttttga

SEQ ID NO: 116915 - DNA, 406 bp, Homo sapiens
aggctcagagtgggcaccactgtgtcctaggctgtcaaggaaagggtggggtaagggccgtctctaggagagctctaatgacacatcctgccaggaaattctgtatgctgttgtggcctcaaacccctctgctgctgtctgtccctgttcgcctcctgtcctcaaggtggccagggaccgctgggaagccaagccccgccagggcctgggcagctttctcctggtggctagaattcccccacagcaagactatctggggaattctcttgaaatgtttgtgcaaagcaaatgttgttgcagttgctggctagtgtattttttaaagcgtgttatggttttgagttatttccctgatgcccaggctggaagtgtgtgctaggcctagagagaggaagagccccaggac

SEQ ID NO: 116916 - DNA, 410 bp, Homo sapiens
atgattataatataaaccaaaatctccagaaatgcacctcttgttttaatcgagggatgactggatgttgttttgtttggaactttgctgagagctgctcaccgttgggggaaatcatctgtctctgacagcaactccactcgaactcaagacccaagtcaagacccttgcaccagctgcattagcaaatcatcacgttcacagtgacttgtatttgcacaaacatactcatttgtcaactatttcgatgtgtcagatatcaagtggcaacataattctgttaaatgatcttacttctcatcatgccacttactcattctaagcaggcgccgactgtcgcattctgtcttctggcatagccacacccaggcatttgtgtattgccataatattattttattggaagtcac

SEQ ID NO: 116917 - DNA, 265 bp, Homo sapiens
ttggtttaccatgaagactgaggcccagtaataaacaggaatttccaatcagagttgatggaacagctaggacttgacccagcttggattcttaacagaactgcagcatacagtggtttgtaagaacactgggccaacagcacagggaaggtggggaaattcaatccacattctcctcacccagccctgcactctggagtgatgctggtgctgcacctaaccagaggaaggagccctttctgtggtttgtttgaaaacaccatat

SEQ ID NO: 116918 - DNA, 321 bp, Homo sapiens
tctcccaagtagctgggactacaggcacacaccaccatgcctggtaatttttgcttgtttgaagagcgatgcccaagctagtcttgaactcctggtctcaagtgatcctctggcctcaccgtcccaaagtagtgggattacaggtgtgagccactgcgcctggcgccaactccactttgaataaatagaacccaatgcagagttcacaaataccaattatatgggtatatcacaaatatactcatataatttattatctgagcagctgctgatatcccatgacttgcctgagcagaggcaggtacttcactgccatatccc

SEQ ID NO: 116919 - DNA, 310 bp, Homo sapiens
ggttttttaacaaagtgttgaaaaaaagaaaaaaaaattgaaaacctctgatactggagaaaaatgctaaactagagtatccaaaagcctgggttggggcacagatcacataagttcttaatgcatcatttgttaaatctgtgaaatggagcagacactgtctggcttccaggggccacactgactgtggattaaatgagagaacacacaatgtgcctggcccaggggtcttaggcgaagttggtctttgcgggggccccaaggggatgcatgtgactgtgcaggaaaagggtgctcagtccacccatgc

SEQ ID NO: 116920 - DNA, 475 bp, Homo sapiens
ctaaatgttaaagtctttttgaagagctgtgctcctttcaaaaggtaggatccttctgcaagaccactagcctggactctgaagaaatgtcaatgacatgaaagttagaacaaagcagtaggattattctagattaaaggagaccaaagagacaagacaactaacccttgattggtttctggataaaaagacaagtaggccaggcacagtggctcacgcctgtaatcctagcactttgggaggctgtggctggtggatcatgaggtcaggagatcaagaccgttctggccaacgtggtgaaaccccgtctctactaaaaatacaaaaattagctggatgtggtggcacatgcctgtagtcccagctacttgggaggctgaggcaggagaatagcttgaacccgggacgcagaggctgcagtgagctgagatagcaccattgcactccagcctgacgacacagtgagatttcattc

SEQ ID NO: 116921 - DNA, 236 bp, Homo sapiens
ctcatatgcttttttttttgctttgctcaaaactcaggaacctgtttataaacctcccaaacttgccattaattcccaggcttttacttctccaactctccatttgccaaccctgcacctaaaaggaaagatcaagctaccataaaatctggagaggcgtgagtttttttacaggaaaaaatttctaagttgcttttatcttttttgacttttttggggaaaaggaagagtaggat

SEQ ID NO: 116922 - DNA, 639 bp, Homo sapiens
tccggggcagggctggggcggccgcggacctgcctggccatcaggccgagcgtggaccctcggacctgagatttgctgtttttgttttctggggtcttcccccttccccccgccaagagaaggaggaaaaaggatgaccgttgttgttctttttaagaaggagaaagaagctcacgccgtgtccaagcccaaggcggaattgttgacatccaacatctctagctagctgatttgggttggaaaggtgttttagactagatcatatagcagtcagataagcatcctttaaaaaaaagaaaaaagaaaagaaagaaaagaaatccatctagtttctgacgaattaacaggtgtacaccacactctagggtttgtattttgtcagggaggggaaagtggaatacagtcttgtctgtgttcagttacttgttaagagtctttatcttcctgatttgacttttttttttaaaaaaatgataactcaagagccatcgtgaaaatatatctcaaaatgcattgtcatctttaattaggggcaggtgacttttttcattgtaatgtcacaagtcctcatattgagtttagacccgctctgtttaaatgtcgtcttttaatcaagttgaggtcaaagccaaaccccaa

SEQ ID NO: 116923 - DNA, 403 bp, Homo sapiens
tctaatcctgactccagacggcctgagttctaatcctggctccagatggcctgaattctaatcccgactccagacggcctgagttctaatcctggctccagatggcctgcgttctaatcccgatttctacttgccatgtaaccttgagaaagtttcttaactatctgagcttctataccctcatctataaaatggggctgatgttaatactcacatcaaagggctgctgtattaaactaataaatatatgtgaagtgtctagaaagagcccaggcacactgaacactaacttttgttgtaatttaaaccggtgtccatggagccacttcgtcctccttcttgccatcttcctgcctcaggaacatctcagaactcaccccccaatacctgcctctctcccaat

SEQ ID NO: 116924 - DNA, 259 bp, Homo sapiens
aaatattcatttgaggcagcagttgtataggctgagaccagatcatgcagtgccttataggccattgtaagatttttcgtatgctaagaacactgggaagccattcaagagtttttaatttgtgggtggaaatggaatggttggcctatgaaaattatgagattttcattttgaaaagttaattttagctcctatatataaaacagattagagggtgatcagggaattagaatagtttagataagagatgatcatagcc

SEQ ID NO: 116925 - DNA, 606 bp, Homo sapiens
atttaaatgaatcagcctaaataattgcctagtgttttctttatgtcaaatgttgtcatttggagatatctctgccagcagaaagaataatgtatgtcctccctcagtaaacattccaacactggtcctaaaatctgaaggtggctgatgagggactttctctggccttttcttccatgactgtttgctcccctgtctctgctgtacctggtctccttgctgttccttagtcataccagtcctagcttgccccggatgtgtttggtttatccgcttacttagaaagctgcttacaaatgccaattgccatctcctttgagctattagaccctcgatttcagagcctgtgttttcttctgatgcctggagatgtggagcacagaaagtggttccacaactgtccttagaaggggccacagctgctccttgtcctgccttgagaaggtgcagaaacaagagaatcactatggccactggccattgatcgagttgcggatttagcaggctgggtttctatcccagccagagggctaacagggtttggttaagttaaggttagagcacttcattcaccacgcttttttttttttttttttttttgagaca

SEQ ID NO: 116926 - DNA, 711 bp, Homo sapiens
tgatgtctacagtatcacctttcttgtagattggcacttatgcggccaaaggaacaacaccatgttttctaaaaggctggagaaaataccacaggtgcctctcctctttcccttcatcttcatcattttgacaaattactcaaagatggagggtgcagttgaaagccagccatcattttttaaaacttctcaggacattgtaacatgcacttgggttgagaactgctactcgagcttctccaggaggcccttggagcaaatgttttgtaaacaccaatctaagaacattatctcttggacgggcatggtggctcacacctgtaatcccagcactttgggaggccaaggtttgtgtgattttgctaaaatgcatcaccaacagcgaatggctgccttagggacggacaaagagctgagtgatttactggatttcagtgcgatgttttcacctcctgtgagcagtgggaaacaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacgatctctctccacctttgtcaattccagaatacaaagtaaaaccagaaaggggtcatactcatcttatgggagaga

SEQ ID NO: 116927 - DNA, 641 bp, Homo sapiens
accatgtgttgtggagaaataagaggtaagcatgcactgtaagttagatataggatttgaaatgaaggagaaatatttatgtggaaaagacatttccacataaaaatatttatgtagaaaagaaaatattcttgagttctagtctcttctttatttgaaatgatggtgtagattcagtccacatattttatagataaagatggtaaggtaggataagtctggaaagagtaatcaatatattgtatttcagcacgaattcatttatttttaggattcaaacagaaagaaatgactatggcagtgaaacagacttatatggacttgtgtctaacattttggaagaacaagataagtcacagccatattttgctgaagggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgat

SEQ ID NO: 116928 - DNA, 244 bp, Homo sapiens
ccctagagaggacaggtggggagcagttgggaggaagagggggtacccccagagcgcctgtcttcgagcccagcagtggctctggaagccacgtccgccaggatacagatgaggtggtgcttgctgcagggcttggtggagagcctaggaaggcaggcagcacaatcccctcaaggaagaccccaaacctgccctatgtcctgctggagggctggcaggggctgggagacaatggcaggctcag

SEQ ID NO: 116929 - DNA, 268 bp, Homo sapiens
cccactttgccacttcagtttaggcctcaagctaaacctctccgtttcctgattacatccagagggatgcctcagctttcacgaacaaggctggaacaatattattgtcattagggtcagccttggcctgataagagtcctgccatcaacacccaacatcagctcacaagaaattcgtatgaagattaagaacagagaagagtggctgggcacagtgactcacgcctgcagtcccagcactctgggaggccaaggcgggtggatcacc

SEQ ID NO: 116930 - DNA, 166 bp, Homo sapiens
ggctgatagggctccctcctggttttcccaaaggtcagataacaacttagcttcgtcattgtgacttagaatctgagtgtgactagctgcattttgtttattcctgtgtcttggtgcctagcacaagagtttagtctaaaacaaccgcctcctataattttgtcgc

SEQ ID NO: 116931 - DNA, 400 bp, Homo sapiens
cctcagtgcctcatgctaaggcatgagagagggatgaggcagggaattcacttactcacgcaggaggatcttatggagcacccactgctacgtggtgataagatggtacgcaacagaaacatattccttttcctcagagagcttagaatttagtgcaaaagacaggtgtgaaacaaataagcacaccaataaccatgctattcaactcataaaagtgctgtaaaggtgtatgtagagaatgctatgaatgcttacaagaggaggacccaacttaggggtccagaagatcttgcacaagtgatgtttaagctgaaacccaaaggagtgggagttagccaggcaatgagttgccaaggcaactattcaaggtccctggtggtccccaagagcgagtgccagg

SEQ ID NO: 116932 - DNA, 380 bp, Homo sapiens
attaaaatagccctgaaatgactgactgctcagactagccttaattgccataaaatatggcatacttcatatatgtgaaatatcaaattatttggcagtgtgagaaagtagcaaaacatgaattactctcctaatgaaatatcccagaagctaaatatgagactaaaaaattatctcccactaagctgtcatttagtactttttatatataaattcatgaaagtctagctttttttgtgaaataatttttaatttattaatggtaactggtataacttgctatatgaagaaattttaaaatagagcttgaaacagagagtagatgatagaggattttgttactggttcttctgagatgtgaagcttaactatgtacaaat

SEQ ID NO: 116933 - DNA, 382 bp, Homo sapiens
gcggagcacggagaccgccctgtactggaaaatgctgggcgaccccagctggctgcccgccaagtgccccggcaagggtgcctggtccagcccatggaagtggctgtttggggcgactgctgttgccttggggggtgtggcgctctctgtggtcactcctgacaggaactgaccacccaggtggccgccaccccctctgtacaccatggaccctgccctgtgctccataactcccccaggctccctgtccactgcccttcctggtccggccccctcctccaagttggaggcagcaaggactgggggttgtgcagcccagccagcaggagggactgaggccctctaggaggaatgcgcagagtgagggggacctcattccttc

SEQ ID NO: 116934 - DNA, 642 bp, Homo sapiens
gagcggcgagtgcgggagaccgtgcgcagggataaaacgctcctgaaggagaagaggaagcgacgcaaggaaagctcgcctgcttgtttccagcctcatgttcctccctagggcctccatgaacccttggcatgtattagcccctgacatccttgggacagagcccagctcctcaccctggatcagaccttccaccacccactgtcccttcctccctctgctcggtcagaaggactcacttgtggtccccagatgcaccaggtgttttcatgcccctgggcctttgcacatgccattctttcagtctggcatgtcccccttttctccttccttcaaacttctatctatcctgtgggcagcctgggcagatgcaggaggttagggatgcggatgatgacagctacatccccagcacctagcacagtgcctggcacatggtaggtgctaggttaatgtttgtggaatgatgaatgaatgagtgaatgagctttaacctcagatgggcctgggtgcacattcactcagcacttactctgtgatcttggatcagtgattttttttcctccaggcctcaaattactcatcagtagaacatggatgggtgcagggcctccctctcaggtggttgcctggtgctaatcc

SEQ ID NO: 116935 - DNA, 692 bp, Homo sapiens
ggcacttattgtgtggctcccaaagccacacaatagaatgaagtatataagaatataagtgaagaaaaagcttcactttcttcatttataaaacctacctcgtagagtgctgtgagaattaaaaataataaatataagatgtaactatatagtaagtatttgataaatggtagatattattttcctttagcacacttgatatttttcgtctcgaaaatactgctatagaagatgaatcattttttatgacatcagaactaaacagaattactcatcaaactatacattttctagatagatctattgaaagcatgacacttaaaaaaataagctaattatgatgagctctgaattaaagacactgaatctgctgtctcaaggctgttattataatcataaaaggataagagttattgacagtcatccttctagccatactattcatatatattacccatactattctagagacctgtgaaaatctttggattctatatcctggtaaagatataaatctactatcccaagaccagacatgtaaaaattccatatctcataaatatttgaggatattatataatcctatcaaatgaaaatataaatgaaagaagaacagatgtagaatgttataggtattatatttaagaaataaggtaggatcttaaattctcagaagttctaccctctccttg

SEQ ID NO: 116936 - DNA, 474 bp, Homo sapiens
acaacagcatcaaaaagataacataagtatttaataatttaacaaaagaagtgcaagacttttatactgaaaaatcaaacatcattgaaggaaatttaataagacatggatgttcaaagacttaatactgttaacacggcaatactccccaggttgatccacagatagaatgcaatccctgatgggaatgtgaactagtacaaccactatggaaaacagtgtggagattccttgaagaactaaaggtagatctaccatttgatccagcgatcccattaggaaagtaagtcattatatgaaaaagatacttgcacatgcatgtttatagcagcacaatttgcaactgcaaaaatatggaaccagcccaaatgcccatcaatcaatgagtaaagaaaatgtggtatatatatatataccatggagtactactcagccataaaaagaaacaaaataatggcattcacagcacctgcg

SEQ ID NO: 116937 - DNA, 798 bp, Homo sapiens
tcctgcccctgttctttctggtgtctaaaaattctcaccattgtagtagaaccttgcatttgtggtaagaagttgcctgtgtcgggagaagacactgaagatattgctgggctctttagtgaaaatgaagagttgggaaagatgaggtcaagtctcatcgagaatacagaaacctacatgagtatgaggaggccctttgctgaatatccagtatgagtgtggtttaattagcagacagtcggtcacattatggcttactgagatctaatcccaagattctcaaatgctaatgtcctcacaaatatctgatgatcttattaaaatacaggttttgatttggtaggtttgagatgggacccaacactccatatttctaacaagtactaggtggatattacactgcaaacactggtctaaaacagaacaccaggaagtgtggaataagaggaccagaagttaagaaatggatcacccccacagggttctgaaggaatgagacacaagggcggtaatttgggggattgtcaggtacagaaaattttatgtcttcttatgtaaaggatgcctctgaatgtcattcatctgtatgccaaagagaaactggttcctttgaccaaagctttatttctgtgaacattgccaacaaggtatgtaaagcatacttgccatgcattctcagaaaccttctcttttctgagagtagaggtttaaaggcatagataacttgctatgtttgtaagcaaaaatgccctcccgatgactttaaaaaggtctgtagccagatccacaaagccacaa

SEQ ID NO: 116938 - DNA, 212 bp, Homo sapiens
attaagctggatagtgaaaaggaaatgagaaatacagacagtgagcttatatttcttcctcccttccttccttccttcctttcttccgtctttccttccttccttcctttccttccttccttcctttacttccttccttctctctcttttcttttcttttccttccttctttccctccctccctccttccttcctttctttcttctttcttt

SEQ ID NO: 116939 - DNA, 152 bp, Homo sapiens
atcatgctcaccaagtgttacaggaacacagccatgccatgccatttgcatattgcctgtggctgctttcatatcacaatggcaggctgcagagggacaacagaaaccttagggcccaaagccaaacagatggattatctgacccttaacag

SEQ ID NO: 116940 - DNA, 472 bp, Homo sapiens
atgtatttgacttttttagattccacatgtaagatcatgtagtattttcctttctatgtctgccttgctgtgattaatgatgactttcaacaagttgcttactttctctgggcctaaatttctttggtctgtaaaggtaagatattggacctaacctgtctggggcaattgagccattaaagaatctgatgagggctgggcactgtggcttacgcctgtaatcccagcactttgggagttggaggtgggtggattgcttgagctcaggagttgaagagcagcctggacaacatggcgaaccccatctctactaaaaatacaaaaattagctgggcatggtggcatgcctgtagtcccagctactcagtggggaggcaggaggatcgcttgagcccaggaggcaaaggttgcagtgagccaagattgagccactgcactctagcctgggtgacagagtgagaccctgtctcaa

SEQ ID NO: 116941 - DNA, 426 bp, Homo sapiens
ctcctttccagggctagggattgtagtcctgcttcccctcttagtctctatctacctcatggatatttctcccttcaggtacttgtgatgctttctgtgggttaaggaagggacaaatctcctcctagggaacccaagatagtgggcaatctggttccactttggtcttacttttccagtgtagaaacagtgagttggagggaaattttccttgcagttggtgctcggcaaaatggggggaggggcatagtagatgtggaagtctgattctctgtctgctgggagccaagaggaagtctctcaaaactagaagggaaaggtgtttcctccacatcaatccagctttggagacattctattagtgacatatgccccttcacccaaaaacaacaatgaagtgttctgtgtgctaacaacatagcttta

SEQ ID NO: 116942 - DNA, 393 bp, Homo sapiens
atccatccctctctcacggcagtctaccatttgtagtccaatccatgccttctggctccatttcctgacatcaggaggttaaagactaacttgttttctcctagtcacagctccacacctaggaacagctttttcacttttaaacagtttatctctgttccccctaccccctttaaaaagaaagaaaaacactaggaatgagtaatactgatttctcagtatttgtttgattctgtggcatactgtacacttcagcagcaaaagtagatggttgagttatattgctagttcttactcagtctataaacctaattcgttttatttatgatgagagagggaaggatcgtgagagaggcaagatcgtagagagggaaggatgggtgccgagctcga

SEQ ID NO: 116943 - DNA, 411 bp, Homo sapiens
accatttgtagtccaatccatgccttctggctccatttcctgacatcaggaggttaaagactaacttgttttctcctagtcacagctccacacctaggaacagctttttcacttttaaacagtttatctctgttccccctaccccctttaaaaagaaagaaaaacactaggaatgagtaatactgatttctcagtatttgtttgattctgtggcatactgtacacttcagcagcaaaagtagatggttgagttatattgctagttcttactcagtctataaacctaattcgttttatttatgatgagagagggagaatttatgaattcattttgttaagcaattcttgagcctttgtagtgtgctattatgatggatacactcctggtttgaagaaatacagagtccctga

SEQ ID NO: 116944 - DNA, 1540 bp, Homo sapiens
acggtgtctgaccttggctaagagggaaggagatcctatcagtggggagagtgtgaggggagagggagagcctgcagggcaggcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgtcgccctatccacacccacagttccctgacgtgaccctctgggacctgccaggagccggctctccaggctgcccggctgacaagtacctaaagcaggtagacttcagccgctatgacttcttcctgctggtctccccccgccgctgcggggccgtcgagacccgcctggccgctgagatcctgtgccagggcaagaagttctactttgtgcgcaccaaggtggacgaggacctggcggccacgcgcacccagcggccgtcgggcttcagagaggccgctgtcctgcaggagatccgagaccactgtgccgagcggctgcgggaggccggcgtggctgaccctcgcatcttcctggtgtccaacctctcgccggcccgctacgactttcccacgctggtgtccacctgggagcacgacctgccctcccaccggcgccacgctggcctgctgtcgctccccgacatctcgctggaggccttgcagaagaagaaggccatgcttcaagagcaagtcctcaagaccgccctggtgttgggcgtcatccaggccctgccggtcccagggctggcggccgcctacgatgatgcgttgctcatccactcactgcgtggctaccaccgcagctttggtctggacgacgactcgctggccaagctggccgagcaggtgggcaaacaggcaggtgacctgcgctcggtcatccgctccccactggccaacgaggtctcgcctgagactgtcctgcggctctattcccagtcgtccgacggcgccatgcgggtggcccgcgcctttgagaggggcatccctgtgtttgggacgctggtggctggcggcatcagctttggcgctgtctacaccatgctccagggctgcctcaacgagatggctgaggacgcccagcgtgtccgcatcaaggccctggaggatgacgagccgcagccggaggtcagcttggaagtggccagtgacaatggcgtggaaaaggggggctccggggagggaggtggggaggaagccccactctcaacctgcaggaagctcggcctccttcttaagtacattctggacagctggaagaaacacgactcagaagagaaataa

SEQ ID NO: 116945 - DNA, 488 bp, Homo sapiens
acggtgtctgaccttggctaagagggaaggagatcctatcagtggggagagtgtgaggggagagggagagcctgcagggcaggcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgcccccctgcctcacccacaaactaagtcttaacaaaatccaaattaccaaca

SEQ ID NO: 116946 - DNA, 1653 bp, Homo sapiens
acggtgtctgaccttggctaagagggaaggagatcctatcagtggggagagtgtgaggggagagggagagcctgcagggcaggaaaaagagagctgtgggcttccagggcgactcccttcacatccgtggtatctgtctctccctgccccatgccaaggcccaggaggtgtgaatggctcccttctcctctgcaggcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgtcgccctatccacacccacagttccctgacgtgaccctctgggacctgccaggagccggctctccaggctgcccggctgacaagtacctaaagcaggtagacttcagccgctatgacttcttcctgctggtctccccccgccgctgcggggccgtcgagacccgcctggccgctgagatcctgtgccagggcaagaagttctactttgtgcgcaccaaggtggacgaggacctggcggccacgcgcacccagcggccgtcgggcttcagagaggccgctgtcctgcaggagatccgagaccactgtgccgagcggctgcgggaggccggcgtggctgaccctcgcatcttcctggtgtccaacctctcgccggcccgctacgactttcccacgctggtgtccacctgggagcacgacctgccctcccaccggcgccacgctggcctgctgtcgctccccgacatctcgctggaggccttgcagaagaagaaggccatgcttcaagagcaagtcctcaagaccgccctggtgttgggcgtcatccaggccctgccggtcccagggctggcggccgcctacgatgatgcgttgctcatccactcactgcgtggctaccaccgcagctttggtctggacgacgactcgctggccaagctggccgagcaggtgggcaaacaggcaggtgacctgcgctcggtcatccgctccccactggccaacgaggtctcgcctgagactgtcctgcggctctattcccagtcgtccgacggcgccatgcgggtggcccgcgcctttgagaggggcatccctgtgtttgggacgctggtggctggcggcatcagctttggcgctgtctacaccatgctccagggctgcctcaacgagatggctgaggacgcccagcgtgtccgcatcaaggccctggaggatgacgagccgcagccggaggtcagcttggaagtggccagtgacaatggcgtggaaaaggggggctccggggagggaggtggggaggaagccccactctcaacctgcaggaagctcggcctccttcttaagtacattctggacagctggaagaaacacgactcagaagagaaataa

SEQ ID NO: 116947 - DNA, 327 bp, Homo sapiens
ccaccgcacctgccctcatcttgaatatctttactgcttttaagtttttattcagtaggtcttatcagaaattgttcaagatattcctttaataacaattatctagaagtccagatgtttatagataccatgttgccagttaggttgaacaaaattttccacacatgtagtacaggggatgaacaataggtaaagataaagttggagttgtaactgtcctaatatgaaatgggaagtatatggcaagataattttcaatgatgaagataattaatggtttgtgtgtatgtgggggcttttatttctggtagatatccatttaatcta

SEQ ID NO: 116948 - DNA, 442 bp, Homo sapiens
tactttccttaacctcccagttcccccaaaatatgactgtccctgcttccatgcatccttatatacttttagcatatcactttattgtaactacttcttgatccacttgttttcctttagactttgaactggctcagggcatcactgtatctctagcacctaaacacagcgcaatttcaaacagcgacccaaaactgaatttcataacgcagtgtagcacaaatcttttgcccaacgtcacacagatgtagcggtaatgcaagtttttaacaaccagtcctttagactcccagtccagtgctctttctcctgtaccacagtgcctccctgaggcaatcggtcacttaactactcagtctctgcctggacagcccaagagtgcccaagatgttgtccacttggttgtcgtgggaccatgagcaaccagagtcctcaatctcac

SEQ ID NO: 116949 - DNA, 247 bp, Homo sapiens
ccttcctgtgtccaagtgttgagcaggctctctttttctagtgctctgcctgctcctgcgctagcccatggtctcttttctaatgtcctgttctctcttcgaagtctgtacctggcacccctactaaatggcacacacagacacctcatatttctggggttctagtcacacctgagtcttagctggtggaaggaactatttattttcccctttaggaaaccaatcatttgaagcctcaagtatcagc

SEQ ID NO: 116950 - DNA, 290 bp, Homo sapiens
cctcctgggttcaagcaattctcctgcctcagccccccgagtagctgggattacaggcgcctgccaccacaccctgctaatttttgtatttttagtagagacaaagtttacgtagagacagggtttcaccatgttggccaggctggtctcaaactcatgacctcaggtgatccacccaccttgccctcccaaagtgctgggattacaggcgtgagtgactgtgcccggccagcagtgtctaggatttaccatacacatcttcaacttcacgccgcatacctttaatcact

SEQ ID NO: 116951 - DNA, 346 bp, Homo sapiens
aatcatggctcactgcagcttccaactcctaggcacaagtgatcctcccacctctgcctcccgagtagctgggtctataggtatgtgccaccatgctcagctaatttttaacttttaaattttctgtggaaatggaatcttgctttgttgcacaggctgatgttgaattcctgacctcaagcaaccctcctgcctctgcctcccaaagtgctgggattacagttgtgagccactgtgcacagcctttcaccaattgtcaaaaacttattcatgtatgtgattgtagattctttgaccaacatctctccatccttctacccctctaattacccaagcctctgataaa

SEQ ID NO: 116952 - DNA, 153 bp, Homo sapiens
aatgtgtgtttgttgtatgcagttgttacctaatgtgtgtgtgttgtatgcagttgttacctaatgtgtgtgtgttgtatccagttgttacctaatgtgtgtttggaatttggcttgtgtctgtattcagcaagcagatacttattagcaatg

SEQ ID NO: 116953 - DNA, 667 bp, Homo sapiens
gttccctttaattgctttgtatggtgtgtagtagtgtttgaatgttagggtgaaatgcactcttcgtccttttagataacctgcctgttttagctccaacatgttggttgttgctctatggagtaaattaagaaaattcctctgtttatccagtgacaaatattcactcacatatattaagtttatgtcttacagctcttattgccaggctctactgtgcagttatagctgttattttcaatccttcatcataatacagtatttctgaagtcattttaaatagcaattaagaattgcatttgggtgcaagctgtagaaaactggatgaagagtggcgtaacttattaagggtttatttgtctaatacagaaaggtgtagaataggttgtgcatgaagagactggggtggcagctacaaaatgtcattaaggacccaggctactgtctttctgcttgagcatatattattttcacatatttatggtgtttgttttcacatttgtgaaatggtttctgcacctccaggcaccatatctgcgtttctgcaagtaagcagactagagaagggcaaaagcctgctttgtgttttcattcatttaagtgaagccttcccaaggactgtctgcctcacatctcattggtcagaactgtgtcatgtgattaacaa

SEQ ID NO: 116954 - DNA, 351 bp, Homo sapiens
aacgatgcgctgcgaagacggactcctgtacaagacttcgatgactgacataggcacaattgtggcttctagtttttattttaactttttatttaaagtaacttatcgatggaagcgaaactctgcaaaggaacgtcagaccgctaccagaaagggggtgaagtcaggacttactggtgattattgtccaaggacacatttaagcagatagttttgaaattaattttggcataaccctgagacaatgagaagaaacaatgcatttataaaaagttattaaaccatttttttttgtcacagtcaaaacattcattagcttgtttctattattaggtgcccaataggtttgtt

SEQ ID NO: 116955 - DNA, 309 bp, Homo sapiens
ggcctcctaaagtactgggattacaggcatgagccaccgtgcctggcccacatatgttttttcataatgtgttacaaatgtcttccttcttatgaatgctgcacaacattctttttgctgcttgatgcccactgcagggatgcgtgaaatccactagctccagtggccagacacatcccggttgcctccaggttgtaagcaatcctgaaatagcctcgtatgttcctaggacagagttctagaagtgagattgccgaactggaagaatgcaagttacattcaacccacgtcctgcgaatgccgatctct

SEQ ID NO: 116956 - DNA, 552 bp, Homo sapiens
gtaactgggtatgtgaagttctgttcagttctggggggaaatttattctgagttgtgctgatgacaagaccctacacgtatgggattacaagaacaggcaatgcatgaagaccctcaatgcgtatgaacactttgttacctcattggatttccacaagacagcaccctatgtggtcactggcagcgtggctcaaacagtaaaagtgtgggagtgccgttgattgtgtcttcttcggcccttcctccctcttttcctctggatgcactctgatgataccatggctaccccactgagctctgtttaaataaatattgtcctttcatgtaaattattctggatgtagattgagcttattaaatgttacaaagaaaaaaaaaagaacagcatcaaaaactaagacgtaaacagtaggtgtgctcattgctactgggatgacacttattcaggccctgtcaggagacagaacaaggaaatatataccaacccatatctgtaagtgtattgtacatatccgtctgcatctattttgagctgaactcgattccacgttg

SEQ ID NO: 116957 - DNA, 345 bp, Homo sapiens
ctttgtacctgcagtgtccctcatagtctgtggcatgttgtaagtactggatagattttcattgaacaaattaataaatgtgtttgtcgtcttaggtgaagagagactgctttgacaatgccaggcctcagctgtccaagcccagtctcaatgcagaaaccaggcctgagtgagttgtggcagaatgttgggagtcttctctccatcagaaggtgggagatggaacagtcttcagtgcatgaagagcatctgtggcatctccagggacctgcgaggtgtttgccttcatctccactctgttacttcagcccacaaatggagttctgccctgattcctggattgac

SEQ ID NO: 116958 - DNA, 544 bp, Homo sapiens
ttttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggag

SEQ ID NO: 116959 - DNA, 238 bp, Homo sapiens
tgtgagaacagactaatacatctcctaactgggttgcctgcctaatgtctggttcctttgcaatctaccctttacattactacagaaccacttttctaaaataaaaatctgattgtgcttgtcccctgcttggtcattcagtagttgtctagtgcctcaagataaagcccaaactcagtatggtggcaatgccaggcctttgtgccctacccctgcttgcctccacagtctcatctcc

SEQ ID NO: 116960 - DNA, 319 bp, Homo sapiens
ctttctgaggctgttttcctgagttcaactctccacttgagacacatatagtaatgaagtactaatataagaaacaaaataataactgaaatcaagagtgccctaaataaccctacccaacacagatcctttattcctaaggctttatctcctaaacattattattaagtttacactatatcttattactctttttactacataaatggtagttgatctaatgttggtttctgctttcatggttcttttctccctcaggtggattataggctaattaaaaataaaaattttgccttgtaattttcttcaattgaaatca

SEQ ID NO: 116961 - DNA, 195 bp, Homo sapiens
tccactcggtgtgacagggcacttagtgccagaattatttataacattgagatggcaacagggcaatggagagcagcccaacccatggacactttctctttgaaagctcgatcaatggacctagatcactgtttactacttggtgtctcggcctctgccatgtttcctgctggctttgggggatggggaaacagg

SEQ ID NO: 116962 - DNA, 750 bp, Homo sapiens
atccagctgtgttttggaacaaatgccaattcttcctgggagcaagtgtctttcagtcgcgttcctggctgttttcttcaaaagcaggcgtttctcctggtagcaccgcttgttggcgacgtcggattcttttccgtggcagtactggtcgtttcatggagtggccggtttctcactcgcactgtgccggctggcagttattccgtggaggcgcagctctcagccgcttcccttggttctcggtgtcggctgtccctgtacctgcgtttgtggcggtatttctgtcacaatcgagtctgtgttttttcgatgacaacgccattcatttctctaaaacaggctatgtttggaattggcaatttttctttgtcagagtccttggtttcgcagagcctgttgttccaggttactggactgctgtttgctccgtgctagcaatgttgcacccagtaccgttaggtgctccctgttggagttttgagacagcgttttgagataggtgcaccagcactccagacctggcacctgaagaaagcattatcatttcaagctcagtaggggcaatagaatgagtggtgttagagaaagcaagcagatgcttgaagaaagggccactccacagtattttttggcttttttttttttttcactttttttgagacagggtctggctgtgtcccccaggctggagtgcagtggcacaagcatagctcactgcagcctcaaccatcctgggtcatgcagtcctcc

SEQ ID NO: 116963 - DNA, 438 bp, Homo sapiens
ttccagggacagagcgaggtactggggacacaggaaggacgaggcagagctccgcgctgacgaaaccaagggccaagcgtgcgagtgaatacgaacatcctggcgttaaaacgtcttgcattctagtgaaatgagacccattggacacagagaagccccaccacaattgcatctgtgtaaaatcgagagaaagatcgtgaaaacagccatggcaggtgctggactaaggggtgacattgggttttctcttcccacctatcctttagggttgttaaaacagaaatagatctcacgtaggcccctgctctgcaccctgcttgctgagtcacgcagggccagttacgcagctaccgtgtgcttacccggcctcatctgtaaaataaggatgacactgcctgcctggcagggctctcctgagaatacacagtgcctcgtgca

SEQ ID NO: 116964 - DNA, 205 bp, Homo sapiens
caccactcagccctcctccgcaggcctctccctacccctctccccccacgtggcttctcaggctcctcctgtgttcctgctctgccacagctgggcacaggagccaccacagactgccacgggccacaccaggcctctggggtcaatctgcccaaaccaccgcatgtttcagagtaacctctgctgttcccgtgggagtgggaca

SEQ ID NO: 116965 - DNA, 358 bp, Homo sapiens
tctgactctctacttacttggactttctccttaggtttcatagacctgcccaccacaaaacaaaatgttatgtgatttactggcaaaagttagtctatgtattattttaatttctgttaagtaagaatgtccttaaaagcaggaactttattacccaaataaatttatgagtggatgatcacacctagtaaagtgctttggagagagtaagcactgaatgaattcttgcaactgaatatatgttaaatattaaataattggttccaggcacagtggcttgcacctgtaatcctagctatgagggcagagttgaaaggattgcttgagaccaggagtttgagactggtctggcaacatg

SEQ ID NO: 116966 - DNA, 335 bp, Homo sapiens
attttgtgagtaaccagctttaatttggaaaacctagacttgtacatacagattgttatgtttagggatcatggaaaggaagctgaatttgccaagttttgccacttgggcattgcatgcctatgtgattaaccaccaataaaaacctgggacatcaaagaataaataagctgctctaattgccaagaattcacatgtggttgtatgcagctttactgggagactgaagtgtatctgcatgtgattctgctgtgatggacacttgtaagtttgtgcctggagtctcctggactttgccctgagaatctttttcctttgttgatacgactctgcat

SEQ ID NO: 116967 - DNA, 275 bp, Homo sapiens
ttctcaggaggctgaggcaggaagatcacttgagctcaggaggctgaggatacagtgagccatgattgtcccactgcaatccagcctggatgataaagtgagactggtcttaaaacaaacaaacaaacaaacaaaacaaacaaacaaaaaaaaaccaagatgactagaagtttcttaccaacttaggtaggtgacgagtgccttacttgggagcttagtaaaggatggctgtccattggggaatcaactaaaatgtacagtaattttttttgttt

SEQ ID NO: 116968 - DNA, 283 bp, Homo sapiens
tttgaattcactttgcaaatttaagtcttagagtatcaagcaactcctacgccatataattctgtctgaaatttttcattaaaaaaatcacatgtggcattctaaaagcacttattatttcctcttctttcccaagtcttagaaaccaagcccaagatacactctatgatattgcgtcactcataactgtaaaatttggttaattcctttcttcttgagtttttccaaattttgctatgatcttaagcctcccagtgagtgagattcattgtaatttctgaaa

SEQ ID NO: 116969 - DNA, 515 bp, Homo sapiens
aatgataccaacagccacctattgactgaaacctgattctatctcctaaatgttttgaatttctttctcttcctccagtttagcctaaatgagcaccagcctcctaaatcagctatttgtctctggtcttgatctttccagtttttagtccacacaataatcaggatgattcctggaaaaacatgcacattcgattgttcaaactcgattgttgaaacatgcttaaagccacacccaagacactaggattgtttcccagaggccttagacagaaaaataaattccctatgctctactgcctgtccaggcctttgagggcatctctcaagaacaaaggggaactcccagaatcttaggccagaaccctatgagtccttgacgcatctatctctcttgccctccatgtccagtgagtcacgaaattctgtattcttccttccaaattacaccttgcatgatttcagctctctttagctctactaccgacttaatctaaacttggtgtcccacagatt

SEQ ID NO: 116970 - DNA, 288 bp, Homo sapiens
gagaaatccacttgtttcccgggcactgagcaggaggtggtctccaaacagatccaagcacacgtcctctcgatgggcagtgcaactctggtctctgtggtggtcacgccccctgttcacgtgaagggtgaaggtcagtgttggtggtgtctccgcaggtgggtagtttgcaggcgctgttagcactggccttcctgcacactgggaacttcagtgccgcaggatgttgggaacccgatccctgggtgagagcagtggggcaggaagaagacggtgggaccagcctca

SEQ ID NO: 116971 - DNA, 464 bp, Homo sapiens
attatagtcttcaaatagggacattaaagggaagagggggtgtgttgctcacgttgaaatgaggcagaagttaagggacagagatttctgtttaatacaagatctttctaatgtttagaactgcagctaattccactgttcgatttgtgaaatagtgagaggcctaccactcaaaatccagttgataagaggctagagaatggatgaatatctgttatccttgcctgcacttacaggacttgcctagttcctagctctgagtaggtgcccaacaagtgtttcataaaagaaaaaaggctcaactggattatctttgggatgccctccaactctgaaatggaaggacaggggatgcttctactttcaagctaggataaggcttgattgacaagatgttcttgaggatgcccatccatctagttgagatggctggataaataccttcctgatacagagcagaaggt

SEQ ID NO: 116972 - DNA, 440 bp, Homo sapiens
gatgtggtggcacgcacctgtagtccccagctatgtgggaggctgagctgagaggattgtttgagcccaggagtttcaggctgcagtgagccgtgattttacaactgcactctagcctgggtaacagagcgagacccttttctctacaaaagaaaacaaaaaaacacgcacaaaaataaggactttaaaaaaccaattgcccgtttaaaataataattccaggctgggtgtggtggctcatgcctgtaatcccagcactttgggaggccgaggcgggtggatcacgaggtcaggagttcaagaccagcctggccaagacggtgaaaccccatctctactaaaaacacaaaaaattagctgggcacggtggcagacgcctgtaattccagctactcgggaggctgaggcaggagaattgcttgaacccagagggtggaggt

SEQ ID NO: 116973 - DNA, 383 bp, Homo sapiens
caccgcctgcccgtcttgattgttttaatctgcgaaatgggaacactgccagtacttccccaggcactgttttgtagatattcattgagatagtgcttctcccacctgttaagagggattcagagggagagtgcaggcgttgattagtcatgtctgctacagcagtggcccatggcacattggtatccattggtctcagactgcaactgtggttactctcatctttttcttttcttttgagacctgtctcccaggctagagtgcagtggtgctgtcatagctcactgcagcctcgaactcctatgctcaagtgatcctccagccccagcctcccaaatagctggaactacaggcctgcaccactacacctggctcatttttta

SEQ ID NO: 116974 - DNA, 222 bp, Homo sapiens
ccaaagtcctaggattacagacgtgatccactgtgcctggcctcttctttctttttttgtagacttgatatcgttctgcctcttaggctggagtgcagtggcatgatcacagcacactacagcctcagcctccagggctcaagtgatcctcctgtctcagtttcctgagaagctgggactacaggcatgagccagtatgcctgactgatttttgaacttttt

SEQ ID NO: 116975 - DNA, 378 bp, Homo sapiens
agggcctcaggaaagttttattcatggtagaaggcaagggaagctggcatgtcatatgggagagagggagcaggagagatagggcagatcccagactctttaacaaccagatcttgcttgaactaatggcactagaactctcattaatgtagggaaggcaccaagccattactgagggatctgtccccatggcccaaacaccttgcaccaggccccaccaccaacattagcagtcacatttcaatatgagatttggagaggacaaatatcaaaactatctcaacaagttgtgcttcttttaagtttattcctaaaaatgtatttttatgctattgtaaatggaattattgtcttaattttattttcagattgttcact

SEQ ID NO: 116976 - DNA, 438 bp, Homo sapiens
gccccacgtcccacaaaaagaagtgaaagtaatgtgttggcttcatcacccaagtatccatgcacacttttctttcaaaccttgctttgaaaaccaatggcatgtttctattgttaacattctctgtgggcctgagctttcaataattttattctaaccctacagttagttcttaatattatgcaggctaataaggtcactgtttggggggtttgtctttgtttggttgcttgttttttaggatattcttctatcataacacttgtgtactaattcccctaaacttctttaaatttcctcaaacttgacctttgaacagagaaagtctgctgtttctgaggctgaccacgaatgcatcctcactctgccttcacctctctttatggttgctttctcttttttggcagaacagaaatttccaagttttgtgtgtttgct

SEQ ID NO: 116977 - DNA, 879 bp, Homo sapiens
atgttggtcaggctggtctcgaaatccagacctcaggtgatctgcccgcctcagccccacaaagtgctgggattagaggcgtgagccactgcaccctgcctcatctcattcttatctcttgtttcagtgagccaatatgttattttattttattgagagccaagcgaatgtactctaaaatataccagagaaatataccataaaatgtcatttggaaaattttatttttctctgtttatagtgtccttaaacatatatttccttttactcatgcatgcatgatgagacttctatctaggaattatatttgatttctagtggattgagtaagttcttcttgaattcctttgaactttacctatatgcgtgattgcagtctctgacacatcatcctcataatcaataaatatggagactataaaaagattctctaacataaagagaaacaaggcaaacaaaacaaatttaaacttagctttcttatctacttaaaggagataataacacttaggtcacaggaaatattgcaagattaaatgcctaagatgtttgacatactccctgagaaatacttaacagatatagctcttattattacatcagtggagaatctagttattatccagaatattaaattggcatggaaaaagcatctggttattgaaactttggatatgtaaaaatagcattcatggatagtactcatttcttaccacatcattgcaaaattacaaacagcctgggagtccttcatttttattcttcaccttgagaagcgtgtggacaatctaactaccaatatcatcctttacgtaactccttaactccctttaaacattatacttcgggctgggcgcgggggctcatgcctgtaatccc

SEQ ID NO: 116978 - DNA, 294 bp, Homo sapiens
agtagaaatgagggtctcatcatgttggccaggctggtctcaaactcctggcctcaagtgatcaacccacctcgacctcccaaaatgctgagattacaggcgggagccattgcacccggccatagttttgaattctgcagcaattacaaaattgattcaaacaaagtatgttggactcagggagatacgtgaatgtaacatttggacccaatgcctcagcagccaggccatgaataaaagaccacaagtagacctgtctacttgaccagtcctgtctaagctctctggacatct

SEQ ID NO: 116979 - DNA, 322 bp, Homo sapiens
caggtgcagagacaggatgcagtaccgtcctattcccaactcgctctgacagcagcagggagcctgtctaagcactggcctcggtagaaaagttagttacaggccgggcgtggtggcccacgcctgtaatcccagcactttgggaggccgagtcgggcggatgacctgaggtcgggagtccgagaccagcctaaccaacatggagagaccctgtctctactaaaaatacaaaattagccgggtgtggtggagcatgcctgtaatcccagctactggggaggctgaggcaggagaatcgatggaacgcggaaggcggaggttg

SEQ ID NO: 116980 - DNA, 411 bp, Homo sapiens
tttttcaaaagccatacttttactatgtagcagcagctgcaataatactttcttcactgcttacttgttggcaggtcctgtgctaaattctttcacagcccagtccaagcaatggatattagtatctgcattttgcccatagaaactgaggcccaggattaagttacttccccaagatcacatggccaataagtgcggaaactagtattggaagccagatagcctgaacaggagccaatgcttagccattaagctgaattgcttccacctttatctggtgaaggatgtcattaaagataaaggtaatctttgctcttacatggtgggcacatttgatgacataatcagagtccagaaagaacttgatgtgttggagtgatatgttgaatctaacacaattagatttgaagg

SEQ ID NO: 116981 - DNA, 409 bp, Homo sapiens
attaacttcagacagagtagagttcagagcaaggaaaattatcagggaaagacaggggcattacataataagaggccaattctccaagaagacatatcattccttaatgtgtgtatacctaacaacagagtgtcagatatatgaggcaaaaacaggcagacctgcaaggagaaacagataaatccactattatagttggagacttcaacaccccccatcagaaatggacacatcaaacagatataaaatcagtaaggacataattgaactcaatagcccctcaatcaactgaaatatagttggcatctattgacgacttcatccaacaacagcaggatacatactcttttgaagctcatgtagaacattcagcaaggtagatcacattctggaccataaaacacatctg

SEQ ID NO: 116982 - DNA, 581 bp, Homo sapiens
aagtacgtgttattcatccttcagtactccgctaacacacactttcatctggaagaacttactctgtcccccattctagacttacataggctggaagtaaaaggatggaaaaaagagtctccacacaaagtttctgtaggtcagacatccagcaaggagtttctgggttctttgctctgggttttaggagagtgaattcgagatgtgagccagaccaagttctaatttgtaaactctgaagaaaagttattgtccaaggtattttgtggtgaagatgaactctagaatcaggtactgcaatttgaatgctggctccacaactgataaggtacatgccctgggacaaaccacaccacctctcagagcctgtcacaaggcagtcaggacattttaggagcaaacgcctatgaagctcgtaaaaagggcttggcttatgggaagtgagtttaacaattctgaagaagtatcatttgcaagcgtctggggaaaaaatgatcagaatttgaagaaagaacaaaacgcacaaagtaacaataaaaaaaatcaatgaaagacaaagcaacagaagaacagagtaataa

SEQ ID NO: 116983 - DNA, 675 bp, Homo sapiens
tagctgggattacaggtgcccaccaccaagcccggctaatttttctttgaattgaaggcactgtctccaaatactgtcacattcttgggtactggggggttaggacttcaccatataattgaggagggcagcacacaattcagctgtaaaacaaaagtaggctaaaaccaaccaggatgcaagatggaatttttttaaatcagcaaacaaaagaaaaagtaaatatactttgaaagttgaggaaaaacatacaattttaaatatcctccttaattagcatgtagcttattatgccaattgccagactcagctcagggatttgtctgctgtataatttttatcacagggacaaatttgccgatagtagtagctacagcatctcaatcttctgtagcctgaaaggaattggtagcaacagtatgtcatagtagaatactaggggtgtgtactttacttacctgtcctctgttacagattgaattgttttcccagaaaagataatcttaaagtcctaacccctggtacctatgaatgtgaccttagttagaaatggagtcttggcagatgtagtcaagttaatatgagattattaaggtggagactaatctggtgtccacataagaagagttgaagatacacagacacagaaactcagacaataccatgtgatgaagg

SEQ ID NO: 116984 - DNA, 362 bp, Homo sapiens
tggagacggggtttcaccgtgttagccaggatggtctcgatctcctgacttcgtgatctgcccacctcggcctcccaaagtactgggattacaggtgtgagccaccgcgcccggcctaaaatattcttttatgtttatcctatgttaatagttttattttagctcttgagaattaaaaatttaactgtggtgaagaacacatggcaacatgacaatttaccaacttgcctgtttctaagtgtagagttcagtagtgtgtactcacatcgttgtgcaacagatctccataaactttcatctttcaaaactgaaactctgtactcattaaacaattccctgtttccccctactcccggaccctg

SEQ ID NO: 116985 - DNA, 395 bp, Homo sapiens
aactgctcccctgaagaacatatctgatccccagaaagaaagagtcagtctaagtggagggaggaagaaaagcagctgaatgagctgggctgggctgcctgttagagcagagagagctcaagggccattgggagggaggggaagtccaaagaggggtctgtgtgtttggagtagggcagaggtgggtagggcagtcagtgtgaacagaaaagagaaagactgtggaaagccagaaggaagtggagttggactgaaaagatgaaagaatgggagaggaagtgggagatgggcttaaactcaaacagtggagagaagaaagtgctacaggccatattgcttgtttccagatttgcttttaaagaactgagatttaggccgggcgcggtggctcatgc

SEQ ID NO: 116986 - DNA, 560 bp, Homo sapiens
cacaaaggacactgagaaggaccaaagaaagagggaggaggagacctaagggcctggcaggaatagctgttaccgtgaattggaggtctgctgctgttcacatactatgctgagaactccaggtccctcactttgtaaatctgcaacagtcttgcaggtgggtggaattagccatgacttaggggctccgagtttaaataacatgtccaagtttagctgtccagccaaagtggcagatctgtgttttttttttccccaaagcccatgttcttttccaccccatgggaatggtggtggtagcagagatggaggctccagagtccagaaaacctcctcctttaggggacctcagtaacttgggcagatgtcaaattggaggaacttgagcattacaggtgccaatgagagggaggcccactgggctcatttctctgttggccccactgagcaggtcacatgacagggacctggacaagaaggctgtttaaaatggaacatgaaaaacaatgccaggaatttaattgcaccgtgaattgtggccagaaaaggaacctagcaac

SEQ ID NO: 116987 - DNA, 253 bp, Homo sapiens
ttttatagcagaggaaatttaggttcaaagaagttgagttgagagtcccaggagtaagaagcagtcaaggatccccccaggcctccggggccgcctgggctgcctggcctcacgacctggccccatgctcctgagatggagaagccccaggcccatgagcctgttgcccttggcaaagccacttcccttctgagtaaagtcagacgagcctgcccagtcccaagagactgcgattccgtaatcgccctcccct

SEQ ID NO: 116988 - DNA, 926 bp, Homo sapiens
ctctagccacttagacagaggataatcacaagttcctggaggataatattggaaagggaatctgacaggagagacatctgatcacactcagaggtggcagaggaacggcagtgggatgtctgttgccttgccatccagttgtttggctcaaacctctgcatacgcttcctcaaccagtacttctccaaggggcctcacatcaagtgagtttttcaaatgcatggagctacaaggcccactccagactagagtcagaacttctggggcaaaagtttggggcctgggcatctgtatctttaaaaagctcatcaggtgattctgatgcactccctgttgctataaaccatggccagatcgctgctcctgcctgggtcggtgtgtctgcctgaccattggtacttagagaacaggacggagacctgtgtaattctctccattcagaagctactctggcaccatacacaacggtgcacaattgaagggcctgttctgctcctccacatggcacccttagaaacgtcacttccccaccttgtgtggcaacagccccggccaacgtgcttatgaagagccatggcaggctggtcttgaactcctgacctcaggtgatccacccacatcagcctcccaaagtgctgggattacaggcatgagccaccgtgcccagcctagggcctggttcttaagaacgccattcccttcttgatcctcaggcccagtgagtgaggcagcgtggcagtccaggacctcccaacgccgagcacatcctctctccttcctcgctggggcagatgcttacacaggtagagagcccaagcccaggctagcagcctcagttgctcagtcatgcagcaggcgtatgctgaccccctgttacagtcctgggcagacagagatgtgcaccacactacagaaataaacacagt

SEQ ID NO: 116989 - DNA, 687 bp, Homo sapiens
tgtcttcaaggagatatactagaatttgctcctgtgtttgtgcccatggagtaaagtttgaggcttttttctaagctgtgcatacactttgcattagcctgtgacttgggtagaggaaggacactgaggtgatttgtggggagggtaacatagaccccaacagctgcatttcatcttttctttgcttatttattggaattgatgccaggcagaaaatactttcatttctaaatatgagttaataactttcctaagatcttttctaaatttggggacttctcctactcaagagtcctttttgagaatactttatgttgatttaccttctgaaaataatctgtgtccaacatagatgtttttgcatgaatattatgtatatatacaatgcttttgatgctcttctaattgaactattgaaagctttgcacaaagctttgcacaaagatgcagatagtatttttaaatactattccattagggtgaaattctcagaggcctgtactttgccatgaccaatcttgttaaatcttcatccacgtagcaagttttaatttcagaagcatggcttccccagacgccagagccaggctcatgtgcactatgaaaaggatgtatgaaccctgccatactcagaaaatagccaacatccatgtgcatcttgctgtctctgaaaattgatttcttaag

SEQ ID NO: 116990 - DNA, 471 bp, Homo sapiens
tgatatcatctcaacttagtattatacccacacccagtccaattgtttggtatttttaaaacataggtgtattcatgttactccacctgcctcaacctcccaaagggctgggattacaggcttgagcaccgcatgcatagacttctttgcccatcagggtgcctagaacagagcaggctgttagtaaatatttgttgagtgaatgagtaaacaaatcaatgaaatcttgctgaagtaagtgttaaagaataaaacccattattagtggcaggaatggacaattcccactttagtcagtcctatctgcagaatgccaaaaaagaaaaatagtattttagggtgtttttatttttctgaaacacaattatttcacttgaacatccataagaagtctatgattgtatccccatttttttatgttggaaagttattactgtatttgaatcagaagaagaggagatcagagataat

SEQ ID NO: 116991 - DNA, 1615 bp, Homo sapiens
ctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtagtcccagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttggggcagtctctctctgttgcccaggctggagtgatgcgtgatttctgctcactgcagtctctcccacccgggttcgagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaatggc

SEQ ID NO: 116992 - DNA, 1157 bp, Homo sapiens
ctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtagtcccacctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaatggc

SEQ ID NO: 116993 - DNA, 730 bp, Homo sapiens
gcggcgatccggggtctgggcgcggcgaggtctggtgtggcagatgtggatagctggaccctcctgggtgcctctgcgttatgtcgtttggttgatgcatttggagagaatctgtgctctccacaactgcaggggcaacatgctttcctggcctcttcagatcagggtggctgttcttgggtgctgcaccaaaactccagcagtgggctttcttcaagtggccggctcacctcattcctgccaagacccaggtccgtgttctcacagtgctgccatctttcctccgtgtgagcgtgggctgtgcggagagtggacctcggtgtgtgcggggctgcgtgcactgccatcgctccctctacacgagccggcgtggacccagggctgagctgtgaccacgagggccatcccgacgagccgccatggacccagggctgagctgtgaccatgagggctatcccgacgagctgccgtggacccagggctgagccgtgaccatgagggccatcccgaaactgtgattgttttctgaatgtggaagcgtcggccgagcgcggtccttggagaacccttgctgcggagaatgacgctcactctgcggcctggcctcgcctccccatcccttctgcaaactcacaggacaggattgatggggagagcccaggcgaaacgaagctgaccctagtgaccagccctactggcggctctggaacaggcccgggaccagtggcct

SEQ ID NO: 116994 - DNA, 369 bp, Homo sapiens
cttagactttaaattcctatgctcattccacattgtcagtagtgactgacatttgcattcagaagtctttctctcacaccttatctcatttgcacccctctgtggccctgttaattttcctcctaaattctctttcacaagtccaatcatcgacatttcttctgctgaagtaatgactgctgtagttctgctgaagtgagtgactcttgccggccagggattgatgccctccctccaggcatgggcagcatggaagagtttctcagggtttctacaaggcacagagatcagggctgggatgtctagggtggtggcacagatactggagccagattgcccactctactacttagtatcttgagccagtta

SEQ ID NO: 116995 - DNA, 397 bp, Homo sapiens
aggtaacagctcaaacttctagatccagagctacctcacagcaaaggacagcctcttacaccccaccaccgtctgcagagcccacagcaggcatccaggtgaagctcctcagtttatcaatgaaggaattgcacctgtgaatggaagtggcctgccgaaggctacacggcagtgagtgtaaccagattacctgataccccttccagggcccttggtgtgacttattgagatctcatgggccagtgggtgtcactgaaattcctggataaaagttgcttgtggagggctgtcatagtggctcatgcctgtaatcccagcatttcggggagcaatttgggaggccaaggcaggtggatggtttgagcccaggaattccagatcagcctgggcaacatgg

SEQ ID NO: 116996 - DNA, 256 bp, Homo sapiens
tcctcccatagtttaaataatttctaacctagttcttggttggcctcttgcaaggaatatacatgaacagttctgttaggactcgcagccacgtggaaattgggcagtagcctttggtgaggttgtgtaagctcggatttagcgtccccttatggatctggcagttggggatgaattggagtcctgtgaaaatccagttgagagctagtccttgagccagatcgtgtcgggagggcactggcagaatctgctgtca

SEQ ID NO: 116997 - DNA, 390 bp, Homo sapiens
tgtccccacgcagaaaagagcaattatatgcttgagagtagtaaatcgccctaagatgtcttcaaacaatggatagacctgaatgagaggagagaatcctctttgtttccataacacttcaaaatcatgggctactccaaaaacatatctaggtgtaacaatgtaaaccctgcaactcttttgcctttgttttaagatgagctgctgcacaacagcatagccctaattgatcaatgtctttctcccaggtcacatctattgagatatcccccttgcaaatactaatattgttgtttggcttataaatggaccttacttaatggatgaatctggattctatagggctggatacactatagtgtctttaactgaagaaacaggaagtgccta

SEQ ID NO: 116998 - DNA, 768 bp, Homo sapiens
agcggacggacgcgctcgcaagctcactgggaaaacatggcggagtcggctggcgttaagttgctttttggcaaagttgggcggcgagattgtttttggtgatttggattagaaagctgcaggagggtcatcgcttagtaatttagggttaagagtacagaagctatgtcttccgttggtcgcatgccatttgagttcctttttatttcctcgagttttatttgttggttattcatggctaggtctgttcgctcctcacgttctctcctaatctcagtaactttgttaacctttcattttcaagtaattcacagttacagaaatattgctaaactagtacaaataattcccacaaacccttctagattccacaaatgttaacgttttgcatgtgctatatcatttgaaaggaaattgccgacatgatgtccttctatcgctacatttttttttttttaaagacggagtctcggtctgttgcccaggttggagtgcagtggcgggggcttggctcaccgcaacctccgcctcccgggttcaagtgattctccagcctcagcctcccaagtagccgggactacaggcgcgcgccaccatggccggctaatttttttgcatttttagtagagacagggtttcactatgttggccaggctggtctcgaactcctgacctcgtgatctgcctccctcagcttcctaaagtgctgggattacaggcgtgagccgccgtgcctggcgtaacattcttttatagagacagggtctc

SEQ ID NO: 116999 - DNA, 311 bp, Homo sapiens
tctagatcttagtggtctgaattatgtggaaaaggtatacaccacacttcgaggactggctactttcactacaaaaaaatggagtcaccctaagctttttgtaagaagcatgtattgaatttgtaatcattgtaaagggtttaaaaaatggcatttctcaaaggatggctaccattttgctggagccaaagaagtatccattcttatttatgatttctggggcctccctgacccaactacttgttcaagacttttattttgacttagaatgatgtaaaaatgacttctgttttggtgaaggaggctgaaag

SEQ ID NO: 117000 - DNA, 849 bp, Homo sapiens
gttaactacagtcaccctactctgctattgaacattagaacttactcctctatctgactgtatgtttgtatccattaaccaacctcttttcatccacccaccctcttaaactcacactcttcccggccttggatagctgtcactctactctttacccccatgagatcaacttttgaagccccgatatatgaacgaaaacatgtgatatttgttattctgtgcctggcttatttcacttaacataataacctccagttccatccatgttgttgcaaatgacatggctttattctttttttatggccaaatagtattccattgtgtatacatacacattttcttcattcattcatccactgatggacacttaggttgattctatatctttgttattgtgaatagtgctgcatagaggtgcagatatctttttgatatgctgattttagactaggagcattttgaaatcttgccaagtttaatagttcatctttgttttaatatttgctttttaaaaagagaaagaacaaagcaacccaaatgtccactgatagatgtatgaatggataaagaaatgtaatatacatgtacaatggaatattacacagtcttaaaaaagaggaaaatcctgtcacatgctacaacatgattgaaccccaaggatataaattatgctaaatggaataagccagtcataaacggacaaatactgtatgctttcactcaaataaagtatctaaaggggtcaaaatcataaaaagaggaagtagaaaggtagctgccaagggtaggagaaagaagaaattagtgtttaatgagtatgggtttgttttgcgagataaaagttctaga

SEQ ID NO: 117001 - DNA, 315 bp, Homo sapiens
ccagcttcatcctccaggtctcctcctgcctgaccctcgccagcgcccagctcttagaacacagtgtgagaaccacggagactcccccagtccctatgggggtttctcacgtgtgaactgggggctctaacggccctggaggcacatttggaggtagaaagttactccaccccaggccgggaagcccagttgagtcagacccacaagcaccgacatggcagacttcatccaagcaggagcagctgtttgcagcaggcagagtgggaggcaggtggtgtggggtggcgtggcaccatggcacgggggagagcaggc

SEQ ID NO: 117002 - DNA, 528 bp, Homo sapiens
aggctggagtgcagtggtgtgatcttggctcactgcaacctccgcctcctgggttcaagcgattttcctgtctcagcctccggagtagctgggattacaggcatgcaccaccacaccctgctaatttttgtatttttagtagagattgggtttcaccatgctggccaggctgatagtgaactcctgacctcaggtgatctgctcgccttggcctcccaaagtgctgggattacaggcatgaaccactgcgcccggccgttgaataacatttaaagacacctaaataaattgagaggtatagcacattcatagatattattaaactgactgttagggagatgatcactttgtagattcagggtaattgcagtcaaaatcccaacatatttatggaactttacaagctaatttataatttatatagaaaagcaaagggcccaaaataggcatcttcagaagaaaaagaaagatgtggataaacttgccctaacagaaatcaagacatattatgaagccatggtaattaat

SEQ ID NO: 117003 - DNA, 477 bp, Homo sapiens
tttttgagcaaggggaaaaagaagaccatggtcgattatgaatactagccataaacttagagtagtgatgtgctgatatgcaagccagattgctgttatttgtattacaggctatgacaaggaaggaaatcacagacacacagaataaatgttgagtacagatttggaaatcttggttttatttattttgtttaactttcatttcaacctgtgtcaagataggtgattattgatctagaatccctttctggacttctagtctaaataatcctcatcataaaataaatcttttaagtgtttctttttcctaaatttctgagtatttttttcttcttgcccctaagaacatcgtttctttttaagaatcagaactcaaaccatctggtgtgtaatgggacagcccttctcttgtacttacagtcagtttcctgctgtagatgtcactgtaatataggtaggtacaggaatgctttagta

SEQ ID NO: 117004 - DNA, 715 bp, Homo sapiens
acctagttaatagggagtctagcttcaaacccacatctgactgaatctaattccacctacagctttgaaggctcagaaaacataactgcttgaaaaactgagttaactctatgactgccaggacaaaagcttaggatttagaaatgaaacaatgaataagtagacattttgctctcattttgttattttttactttattttccaaatatgtttaggttaaagaaaagaacatgggatttagagtcaaataggcaggtgttttgattctacccttgctaaccctgtgacctttggacagcctacgttgtccagtggaggcagccttcccattccaacggacatttgtgggatattagagaccaagaagtgttaagagatgatcttcacaaaatgctgagcttgtgtgggtgtcgaactacaaacaggaggagatggatattcacatgcagtggtggagggttatggctctccagcctggaggattggagcttgagccaggtgaacagtgggtccattaaaggggcagctcagttcagcaagtcagagcctgaacaggatgaaaggggcaacccacaaagatgaggactgaattggagttacagatcccagttggttggagagaccattttcctggaggatgacccagtttgggagtcacagccagagctgggataaaagataatccacactcttttggatataatatgtattataa

SEQ ID NO: 117005 - DNA, 386 bp, Homo sapiens
ctctagaggatcgcccctaatcactgctctgtctaaactcctgtatcgcaacttcctccctgggatataaaaggcaaggctgccagggtgagcacaggagagggattttcatgcagcaggagtgtgggaagcaccctgccatctcagttgggatctctagcttgctatattctaagagtaggggtgaaacagatgtagcctgagctttacagagatggcagctcattctttgaacatctcagtccatgtttggattaaagtgatctgttggctccatttatctaaaagaggatacagaactctcctcagaggaaggcagtagcagccagagtctcaggaactttaatgggcattgttcagctttcaacagaaaggaagcatgcata

SEQ ID NO: 117006 - DNA, 721 bp, Homo sapiens
agagatcatcagaccattctgaagaggaggagttggcacagttacttctcctctctgagcctcgatctccctgccggcaaaatggggatccttgtcccagctccactcactctatagggttcgtttgaggctcatggaatgaaaagatctaaagaagtctggccagagggacactgagatgagcaatgtggttggaggagaggatactgacccaagaattctctggataagaagaaggaggaggggaagcctgaagtggatgggtcgagcctcagctgtggaagaattgctaattacagccaccataaggaaatatcaatgatggacgtcaatattattgcctcctgcatccctgcctgttatttggagatgaaaagcgccctagggtcatctctccaggacgaagatgagtgatgacagaagggaggagagctacacatggagaaaagggcatcctccagctggattcattcatgaaaccaggacccatttcctctgggcagagttctctccactgagggcccagggctggggctgagggcaaaggaacctgcacagggaggaggaactagtgatcctgctcccagccctggttcaccaagtgactgcatgtatgcctcttagtgcctcagttaactcatctgataaatgggtatgacaattccaaaacaaaacccaaaaactctccagcgctggaatccggccaaaaagggcctgatac

SEQ ID NO: 117007 - DNA, 128 bp, Homo sapiens
tccttcactatactgtgcgcatcatccatttctgtatcctagattgctagcaaaatgtctcgtatttgtgcaaaactttatcaaatatagattccataaatgtttatttagtaaaacgatggatggat

SEQ ID NO: 117008 - DNA, 185 bp, Homo sapiens
cacaggaagttagcaaggcaggttaggaagggtctgaatggagagccaatctaaggagtatggctcttcagtaggcaaagggaagacagtggagtattgtaggctgatggctgaaaggatcagattttcaatgagctctttagaaagatcacactggctggagtctgaagaatgaactggaagga

SEQ ID NO: 117009 - DNA, 587 bp, Homo sapiens
gggtggactatgagaggcaataattcgaaattatatcgtggaaatgcttcaacctctaccaagacctacttcaaaaggaaaatcttgtgttgagtagcagttaaaaatggaataagatatcagaccttcaaccaaatagttcttaatagctcaaaactactataggatagcaattttattcccaaattattctagaactgaatatctgaaactcagtgaccaaaagccagtcaaccaatcttccacagcctaatacacacacataaaatatacctctggcattacattataacttcccccatcaaacaaaacaggaagagtggttatgttgggctgatagtgtaagatggtctgtcatgtagcgtttccgttatattctgaatttgagttggtataccatgtgacagttctttatatatatgttttcaacaccgctatgacaagagtgtctttctgtttttgcgtcagtgtctcatgaaaagaagacataaagaatattcaaaagaaattttaagaatctttgttatctgaaggtcgtatctttagtgcatgttctgtctctcatagttgctaaactctagctgcag

SEQ ID NO: 117010 - DNA, 352 bp, Homo sapiens
actctctgccaatcctgtgctgagggacttgcatttggccctggtaacaccacaatgagatccgttaatactgtgcccattaatagtaagtgaaaccgagggggtttaataacttacctaaggactcattgctaagtggtggtgccaggtgccaggatttgaatccagattggcctgcctctaaagcctgtgctctttttttttttttttttttttgagacagagcgagactgttgcccaggctggagtgcagtggtgcgatcatggctcactgcagcctcaacttcctggcctcaaacaatccttccacctcagcttcccgaatagtaggactacgggcacaggccaacac

SEQ ID NO: 117011 - DNA, 523 bp, Homo sapiens
gacaggcctgcatccaaatcccagctctaccacttgccaggctaagcctcagtttcctctcctgtaaatgaaggtcaaggaatccctatcttgggatagttgtgaaaattcaatgagatcatgcacgaaaatctcagcactaggcctggtgctggtgtccactcagtgcatggtagttaaaagagaaaaaggagatatatttagatgttaaaacctcacttagactaggctaagtttcccacttctgtactaggccccactgcagcccctccatgatggacagggactggtgggcctgtgaccccttcacctctcgggtctgcatctgatcatacctcaaccatggctgtgtgagtcatctccgtgcatgcagcaggtgcttaatacatgcttgtgaggttaactgacaaaaatagctactgtttctcaggcatttcctgacatttatatagtgccccacagtttacagagcaccctgtaagttcatctatggagcaaattattattattattatttttgaga

SEQ ID NO: 117012 - DNA, 634 bp, Homo sapiens
ttcgagctcgccacccagcttccctctctcacgtaaggaataagaatactcattttatgggcaaataaactgaatgtgaagtaaagtaggtgcatctcaggttgcctggtgaaagaaggattaagtctggtatagggtttgtcttttaaaattgtggaaaacatgcatatcgtagattgacttttagggaaagatgtgggtcctattgggttaatggcggaatcttttggtaagatcatgcccagccctgaggactgttgccaatgcctccctcaccacgtgtgccatgtgctcttgaggacatcctgtcattggcttcccacaccatcattacatctggaacaagggacgcataaaaagtgagtggcccagcgtggctcagctggtaagtgaagggcatgggcttggacccaggacttccagctgctgcagcatgtgtcctgctcccctacagcttgaagagggctaaatgagactggaggacttcttagaaaaagagacttgattatcagcgtagtgggagaagagcaaatgcttatgaatactgcacctgtgctttaaaagtcaccatgagctgggcgttgtggcttacgtctgtaatcccagcactttgggaggccgagacaggtggatc

SEQ ID NO: 117013 - DNA, 345 bp, Homo sapiens
ggaggagtaggggtgctgactcccttcctagtggggtcatagctggagggtctgctgcctttcaaggactctttgttgagaggactgagggcaacccagagggtggcaggcagggatcctggcctcaggtggcttgtgtcccatgtcaccaagagcacaaggcggtaggagcccagggctcagggcaggagcttcccatctcggagctggttctcctggggctggaagccactgactcggggcttgccaaggctgccagggctggcaaagggatggtggcctttggggctggagtggaagagggagggcagctggtgggtcctgtcagcttggagcctgtgagat

SEQ ID NO: 117014 - DNA, 419 bp, Homo sapiens
aacctgggtgttgtgcagtgggaaattacggaaagaatcaggacacgtggttaggtaggggcccagtggcgtcagacttagctcttcgtgactgcgagcttcttggtttaataaggatattggctcgctctgttcctggggtttctgggaaaagatatggaactgaaatgaaggtttcattgaatatggcccactgattttacaagcagaggtgcctgagataagcaaaaggtgaggcatgacctctggctgtgcattatttgttctgatattacaggagccaagcattccacttccttctttttaaagagctttgatttcctctcacatcttcatgaagaaggaaacagtgcccccacttacttatcctcaggccacacctgttcccatttattccgtgagttcctcccgcacccttc

SEQ ID NO: 117015 - DNA, 478 bp, Homo sapiens
gcacgagggcgcgcacctgtaatcccagctacctggaaggcggaggcaggagaatggcttgaaagcaggaggcagaggttgcagtgagccgagatctcgccactgcactccagcctgggcgacagagcgagactctgtctccaaaaacaaacaaaagctaaatgagcatggctgtgtgtcaatgaaactttattatggatgctaaaatttgaatttaataacattttcaagtgtcattaaatactccccttggattctggccctccctccccagtcatttaaaaatgtaaaaaccattcttagcttttgacgtatacgaagacagatagtagaccgtagtttgccgactccggacaggataataatgaaatatccggtatttttcaagcgatagtaattgggagagagtgaaaacaagctataatctcttaatttcatctgtctgtttaccacaataataaaggggatctgaattctt

SEQ ID NO: 117016 - DNA, 216 bp, Homo sapiens
cttccacactcaagcaatactcctcccaagtaggtggtactacaggcatgcaccacaacgggtctcactatgttgctgaggctggggaaaaaaaaaggccaggcacggtggctcatgcctgtaatcccagcactttgggaggccaaggggggcagatcacttgagtcctagagtttgagaccagcctgggcaacataacaagatcctgtctctaga

SEQ ID NO: 117017 - DNA, 280 bp, Homo sapiens
gagctcaggagtttgaggccagcctggacaacatagcaagaccctgtctttaatttttttttaataaagagagctggctgtgcagggctgggatgtgacttagcggggcagcaggtaggatggaaggagccactcacagatgggaatctaataattagtctccaacttgagagagggtatagaaacatctttggaaaggaacagaatagatatgtgattcccacgatacagatcgtattgccatttccttggtcaagcccccaaatgttagtatccttcc

SEQ ID NO: 117018 - DNA, 846 bp, Homo sapiens
gtgagtctttgttatgcaaatgtattttccactcagggagaattatatgctagatgtcatttccccatactgaatctacaagttacttccgtggctgagggcacaaaggaaatataaatatatccattctttaatctttctaaattatgcattttcaagttttaatcaatttttcttgtctaaataatcaggctcttggaaaaattatttccaaggaacatgattttgagtttcagaagatgggtcaactatatcatttgtaaataacatcaagggtcaacttttggccaatctaagaaaaacttttttatttgatactgattcatttttatgaacacatctacttgaatgaattaatgtgcgtctctttcttgtgacattttaaatgacaataaccatcgaattatggcgtctatacgttatacctgaattttaaaaatgaaattaataaaaaatagcaaccattttaaaatgtatgctacatagaagtactttatattatctcatttaaccctcatgattaaaatgaggtatatattgtccttcccattttacaggttaaaaaaaccaagtcagagacaagttaaacattttgcccaaggcagcatttaaacccagatagatttgatagcaaagtccaggttgccagtttatcccttaggtgtctgaatccagttgttctctaaattttattttctaaattatatctaaattgtatcatttgcaagtaccaaatgatataatttagaaattataatttttaattaatttaattaacttaataatcttgaaggatttaaatgtcaaaatttgcaatgattctaccagaattttttacccttacaa

SEQ ID NO: 117019 - DNA, 353 bp, Homo sapiens
aataaactagataaagtatttgtcatacatatgagagcgaaaagggtaatatccacaaaacacgaaaaactcttgaaagtcaattgaaaaaagataaactacctaatggaaaaatgggaaaaggacatgatcaggcaattcataaaagaaatacagatttttagtaaatacatgaaaatatgcataatcttattggcaataaaattaaaacaatatcttcttgttttacctatcagattaagaaaaatttaaaagattattgcccattgttgttaaaagtgtaggaaaggcctggcgcggtggctcacgcctgtaatcccagcactgtgggaggccgaggcaggtggatcacg

SEQ ID NO: 117020 - DNA, 677 bp, Homo sapiens
aactgacagaggcaaatgttttaattctgttacacctctaaataaactgcttcatgaactgatatattagttatggtccagatgaaccctggaaatcggggtaactgacatcactccccaaaactcctgtcacatgacatcagcatctggtgctaagggaagaatgtgtaaccacagcgcctcctgcagcctacacagaggccctgctttagagaggaaggctaccagctccggcctccttactcagaaaacaaaaccacatttttgaatggaggaatttaaccaaattcggttgttattattgtcactattttaggtaggatattatttcttggaaataagagggctaaaaatgagacaaatgacattttgattttctatactagatctgtagtgaaaaattaagagtgaacagagccctggcaatgagaaaagtgactctcaggccttcctgacagtgcctctggtgaccactacatcaggcagccctagcccgtggcctcttctggctgtagctgtgtgaccttagacaagtcccttcacactcggggcctcagcctgtttataaaacagaagtgttcacatgtaagaactaagctctctcctggctctaaaatcctgtgaatctttacaaggcagtgaagtattccatggttctgttctgattctattctcta

SEQ ID NO: 117021 - DNA, 690 bp, Homo sapiens
tgcatgttgatgataacttatctcttgttttcatacttgaaagtaattgtctagatatgaaatctttggctcactttttctttaacttaaatgtattactccaccttctgcaggaataaagaattgtttctgttataatcatttggtctttttatctggatgtacaatagatattttctttttctttataataatttactagaatatgtcttagtattgatcattctgagctgattttcccagattcggggtatgttctttcattatagagtagcaaactttgtttttcagaaaagttttattgaattatagttttttatattctgttctcttgctttggttttcttttttgtgggaactcctgttgtatgcatgttcgaggttcgtttcttgtttctaatatttgttgccttctcttgaattattttttttcttctaaaagtttgttttcattgtctgtttctcttacattatgtattgtgtatattgactcttatgtttctccttagtcgtcttcttaaaatgattcattttatagctaattccttcctgagttccatcagctcatttccgagtgtttgtcactctgatttatgctattctttcgtatcttgtagcaatattaaaatgtttttaaaatgtgaaataatagataatttcatctttgtgtgtatgatttcttaccatgat

SEQ ID NO: 117022 - DNA, 393 bp, Homo sapiens
aatgattgtgggtcaggggccaatggcgatgtgacattcagcctatagaaccatagggcagaggtgacagttgctggaatagatgggagctcagtttaaggaagatcgccaagccagacatcgctgttagatggatgtaatggggaataaactgccattgtcaactcaaaagtaaccagggccaggtgtgggggctcacacctgtaatcccaatactttgggaggccgaggcaggtggattacttgaggtgaggagtttgagaccagcctagccaacatggtgaaacaccgtctctcttaaaaatacaaaaatcagccggacatggtggcaggcacttgtagtcccagctactcagaaggctgaggcaggagaatcatttgaacccaaaaggc

SEQ ID NO: 117023 - DNA, 296 bp, Homo sapiens
tcttctccaacaccaagtttctctcaattttctttttttctcttctttcactctaacacagggaaagaagtctccccactcctttgcaaggtgaatacctttacttcttcagttagttcttctctcttgcatctttaatgtctccaacttcaatagctcctttctccaaccttagacatgtctagttctacactatgtccacccccatacacatatgttcacgcgcacacacatacaaacacacacacacatgcacacacagaagcctgccttcactaatcctacttcccactgat

SEQ ID NO: 117024 - DNA, 180 bp, Homo sapiens
tgaggtaggtgagatcatgagccactcagccataatgccaccatcggggaataatcaaagcacatctcaaatggaattctgcttctgtatttattaaccaaatgattattagtaaagcagaccacaaattgttaatacaacctgttctgaattctcatcactctctacatttctgaggtt

SEQ ID NO: 117025 - DNA, 283 bp, Homo sapiens
cggggaatgtttcaaaggtgcttgataccaaagcataggtcctaagtcctcatcatcctgtatgaagcatgcacatgatgccacatggtagctgaggccatgctctgaaggatgtctacatgaaacaaccatgaaaaatcatataatatgggttacattcccaacccacatcttctcaaattcactagaaggtgtccattttgttgacaaaactgaatttgaagtatatgcaataaatgacaccaacattatttttatggctaaaagtacttgaagagcacgc

SEQ ID NO: 117026 - DNA, 383 bp, Homo sapiens
tcctgacgtgggtggcggatgggtgcttgacgtggccgagaagtctcgggggttgggggtggtcagagccgcctgcaggctgaggagatgctgccaggtagccccagttcttcatctgacactgtggggatgtgccgcttgtgtttctcagtgttgtgttctgaaacgtcaaactggcggaaaagttgaaggcagcacaaggggcgtccattgtccacttcctgctcatggggttccccagacttgagcgtgtcccacggcggctttccctctctccattctaaccgtttaaaaataagtcgcagacgtcaagaccagaaagcctcataactctatacagcctgagagaaattccatgatggccactggtgtttgtgcccctg

SEQ ID NO: 117027 - DNA, 499 bp, Homo sapiens
tcccttttctggcccaggacaggattataataaaactgatgcaaacaccatccttgaaattaataccagatagccctttaaatgggacagccagaaaatgaagcctaagaaacttcagttactaaacttcctccatgaggcccaaggcagactaaccagctgagactaacatggattggaatgtttataagtaagatttttagttattctcatgaaccttactgtgggccggtcagttagcaagtcctatataatgcttgttaaagatctcaaactaagattttcagggctcacagggattaagtggaatggaagaatggagagaagccatttctcccggctgagtccatcatgctcaggagacttttaccctcttcacttcctgacccatcaatgatgttcccttcttggctttagctctaacctgtctccagagcatctgatccattacttccaagtgtttatttaatggggcctcccctatgggcaactttaagac

SEQ ID NO: 117028 - DNA, 545 bp, Homo sapiens
gatgtctgaaggaagtttataagaataacttacactctaccttatatgagatgaagaatcacacagtgtttctccttcttatggtcctaagatattcgaatttgcactattcttaaaatgaggcatatatagaaaatgtaagcacataatttctttagtattaggaagttctgtttatgatttgtgtctatatgtgtatatacttatgtacatgaatgtacagataaccttccatgtgactcagaacacatctcatggggaacacaattagtcctcactataaatttatgaattaagttaccattacacaaggctggggaaatagagaaaagaattaaaataactggtttttaaagaacaacctggtcaaattagtaaaatcttagcccttgacagccaacgtggttgtggtcaaggaaaatcataaaatgacctgaacacttcaaacttaaccttgggaaaaggctgaagagcagccatttgttaagctgaagctactaattctgcaaatcaaatatataaatatcaccctaccatgcccctgg

SEQ ID NO: 117029 - DNA, 671 bp, Homo sapiens
gacctttgccagctgtctgtggatcagaagagatgatatattgatgcacatggaagtggcttgatttgtttgtggtttgcttgaaccaaaggaaggctgagggagaggctggcttcctcactttaatcttgatgggttattattaagcaactctgtgcagtgagctgctgcaggctttggcaatacagtggggaattttcctgtcttcagaggaggttatcatctagcgatgggggtgacaagtccaagaatgcaagctcctcacgcctgtaatcccagaactttgggaggccgaggtaggtggatcacgaggtcaggagatcgagaccatcctggctaacacaatgaagccctgtctctactaaaattacaaaaaaaaaaaaaaaaaaaaaaaaaaaaactttttgggggccctgggcccagaaaaagcttaaaaccacaatccggtagggacacgggggccacaagaggaaaggaaaatgtgcgcaaagaggtgtccaaggggaaaccggggccaagaaaaaggggaagggaattcaccacaggtaaaaacgcccgcggggacacacgagcggtcggaacaaagccccaagaggggatcgaggggctcacgcgcgggcactaataccagagggggttcaaaggagagcgcgagatagaaattgaggcca

SEQ ID NO: 117030 - DNA, 519 bp, Homo sapiens
gacctttgccagctgtctgtggatcagaagagatgatatattgatgcacatggaagtggcttgatttgtttgtggtttgcttgaaccaaaggaaggctgagggagaggctggcttcctcactttaatcttgatgggttattattaagcaactctgtgcagtgagctgctgcaggctttggcaatacagtggggaattttcctgtcttcagaggaggttatcatctagcgatgggggtgacaagtccaagaatgcaagctcctcacgcctgtaatcccagaactttgggaggccgaggtaggtggatcacgaggtcaggagatcgagaccatcctggctaacacaatgaagccctgtctctactaaaattacaaaaaaattagcccggtgtggtggcgggcgcctgtagtcccagctacttgggaggctgaggcaggaaaatggcgtgaacccgggaggcggagcttgcagtgagccaagatcacgccactgcactccagcctgggcgacggagcgagac

SEQ ID NO: 117031 - DNA, 398 bp, Homo sapiens
ataataaggttttcagacctctcatcttccagttcattcgcctgtgaactgagacagtgttcaaaacaccaaagtgaaagaattcaaatggtgacaaataactcaagggcactacaaacccctcctttgggttggtgggaagtgggggagcagggagcactggggaagggtacagggtccccagagaccaggcctgttctggaaccttccacggacacccccccaccaacagggcaacacaagtgagccccccactgtgggccaactcggggcaaggactcccctgatcctttggataatcgttcaggtaaattcccaaaggtcatggctcacagatattgggaccccagctctctacctgtgaagatggggtctgcaggagccaggcagaggggagc

SEQ ID NO: 117032 - DNA, 233 bp, Homo sapiens
accacctcctccctttgattcctacagtcctacccaaggagtggtagctgcttcctacagcttcctgagtaactctgtgttaactcagtcttttccattctctagcacctgttgaataagatcttcgtattaaataatatgtcgcattacatagtattgcttccattttcctaatagcccctgactgattaatttccccaagccctagaatcctggcagaggtgtggcgagag

SEQ ID NO: 117033 - DNA, 338 bp, Homo sapiens
gaaaacagaggtttctcctagccctagcattggagactgacataccctcaatggatgtcaggggagacccagtcactaaggatgactctcctgcccctaacccattagcatgtcccaaaaagaaacaggagaccaaagacctttgccttgtataacagtcatgctgcctcggaaaagctgggaagtcccctcccagtgaccccatgttctatcctaatgtgaacgatgttcatgctttttcatcaaatcttttaaatagaaagggtgcagagaaagtcaactgtaatcacttggtgcagagtgcagggagagagagcatttcatattcaagaagaaat

SEQ ID NO: 117034 - DNA, 547 bp, Homo sapiens
cacggtggctcacacctgtaatcccagcactttgggaggctgaggcgggcggatcacaaggtcaggagatcgagaccatcctggctagcacagtgaaaccccatctctaccaaaaatacaaaaaaaaattagccaggcgtggtggcaggcacctatagtcccagctactcgggaggctgaggcaggagaatggtgtgaacccaggaggtggaacttgcagtgagccaagaccgtgccattgcactccagccagggcgacagagcgagactccgtctcaaaacgaaacaaaacaaaaattccattacttatatatgctaatgacatgtatagtatttatagttacattattctttacattaaaaacccagaaactacccaaaagctcatgagcagaacaatgaattgtgttaaaaacaatacaacagaatactatgcagcagtgaaaatgaataacctacagttgaactcatcaatacagatgtatctgaaaaagtgttgctaaactaaacaagtcagccaggtttggggctcatgcctgtaatccca

SEQ ID NO: 117035 - DNA, 142 bp, Homo sapiens
cgtgaggcaggactcggcggtggcggaaaccttttgcatgagggcctcagtctgacacccaagcaggtttcccagcctgtgaggcatcatcgtacgggcacaggcccatgggtcagctggccctgcaggcccaagggctcag

SEQ ID NO: 117036 - DNA, 254 bp, Homo sapiens
gaagataatgcctgtgccacagtggagactaattggagggggcaagaaatgcaggcagtggagccgaagtgagagctttggaacagttcaggtgccaggtgatgcaggacacactgggaccactgcagaggaggtggagttagttgttccagaggcttcatgacatctacctgacactaggtgcagagggaagggacatgaagaacaaagatgatttgggttttgaacatctaatggttggaaggctatgttat

SEQ ID NO: 117037 - DNA, 254 bp, Homo sapiens
atttagcatcacattttttcccttgctggcactcaaaaaatattgactgactggttgatagatgagtggcatacctttcaaccatgccaagatgttgagtggccttgacatctgtccattgtcaagctgcctgctgctctcaaggtctgcagcccacgttttgtcaataatcttgcagccctgctcattttaggtcaatgtttggtgatgcattgcagatctgtattccattactgtgctgttgtccataaaaa

SEQ ID NO: 117038 - DNA, 321 bp, Homo sapiens
ctaaaggtacctgtgcagaatttgtctcttccaccaccagaacaggcgtgcctaccctacgacagcatcagggaaaatgaacccgagaagggagacagcttggaaaactcaagaagtttaatggataggaccggagatgactgagttaggaccggttagttagctgtatacatgcagggtgaaactatatagtttcggttgtcctggaagattgaacgtctgttgcctgggtttcttggcccctgcctggccttgcatacttggggtgaccctgaagcaggacccaaatgatccactggccagagatggaagtacacagtc

SEQ ID NO: 117039 - DNA, 169 bp, Homo sapiens
gagtgggtgagcagacccgttcagaaccagtgtgctttggggcaagggttaaggagagtgccaaacagctcagccagttccacgtggacatgtttattcatataatttttacagctttaacaagcaataaaaaaagacctgaaagtacttggatgtgtacagaaccacg

SEQ ID NO: 117040 - DNA, 309 bp, Homo sapiens
ggttcctcaccacagcaaggaggaaaacacagaactttgttctctcctctctggataatggtggccaggatagaagttcatgggcaatgagaagcctgggccctcctgcacaaggttggcatcaagcaaaattgcattagctaataaaatagtatccttgtgcaagttatttcaccccgctgagcctcagggccctcctcattaaactgggaaaataatactacctaccctcctgatgcccttatttattcctgtcttcaggtcctttttatttacctcttctgcctttttttttttttttgaaacagg

SEQ ID NO: 117041 - DNA, 151 bp, Homo sapiens
ttcttcatgtctcagtgcctctgatctagtgaacacactgtcctgaatgtgaaagaacttgctaaatttctggtttatttttaggtggctagaacagatttataagacttccttacccatgtctgctgaagtttgaattcttagtagtagg

SEQ ID NO: 117042 - DNA, 654 bp, Homo sapiens
gtgcacagggctccactgcagttaggagccggtgagtccgggtggatgaggtcagagcgccccatggtgtggtgctgcctctttgtccgttcgcagttcttccagggatcaccccagaagaaaacagctgatacttacatctttgctccaggatctgctttaggggaactccaaactaacagcaggtaaacataaaagaaagaagacttactaaagacagacgactggccaggcgctgtggctcatgcctgtaatctcagcactttaggaggccaaggcgagtggatcacctgaggtcaggagttcgagaccagcctggccaacatggtgaaaccccctctccactaaaaatacaaaaatcagccagtgtggtggcacatgcctgtaatcccagctactcaggaggccgaggcaggctaatggcttgaacctggcccagtggaggtcccagtgagctgagattatgccgctgcagtccagcctgggcaacaccagcgggactccaacctcataacataacgtccctacagacatacctaaacactgtcctcaccacatagataccaggccaacgtgccgctgggctcctgcctatcaatcccaagactttctgacggctgacgccacgacggatcggctcgcagcccacgaagc

SEQ ID NO: 117043 - DNA, 256 bp, Homo sapiens
tgaggccatccatgtgcagggaaacgttttatgccagagagtaatatttttggaaagggaggaactcatatgattctgctgagcagcttgttcttcctacatttggctctgtggggtagtgtgtatgtctggaagtggcagatacatgtttcccactacctcggggtaaatgtccacaaaaaaataacactcactgtttgggaaaattaaaaaataagcctagggatgattaggttcctctgatccaagtctttgg

SEQ ID NO: 117044 - DNA, 177 bp, Homo sapiens
ctacaggttctaccaaactgttctccagcatggttcttccgatagatttacactttgactagcaggggatgcaagttcctactgccctacatggtcatcagtacttcatattctcagactttgcatttattattattattattattattaatgcaaagtctgagaatatgaagtact

SEQ ID NO: 117045 - DNA, 754 bp, Homo sapiens
acggggtttcaccatgttggctaggctggtcttgaacttctgacctcaggtgattcacctgcctaggcctcccaaagtggtgggattacaggtgtgaaccaccgcacccagccttattgttctttaaactgctttctccaagtagccctccttgctgacatgcctctctctctttttttttaatattccagtttatcttttgttagtaagaccctatatttaagggtaagtgatgcatggagtttgcaaagtctgtaagttcagagcctctgatgttggactccctgggttcaaatttggactctaaccttgaccagctatgtggtcttgggaaatttttttaatctctgtaagcatcgtttttctcatatgcaaagtcaagataacagcacaacctcatagcattgttgtgaagattgagtgatgagagacatgtaaaatgctaggcacagtgcccagcaagaagtaagcactcagtaaatgtcagctgttgttggtacctgataaaagataatacctgcctagtgatcctaaaaaaaacacaatagatactcatcattatgcacaacataaagaacataattaagaacttggcaactgaaaaaatatagcatacggtttcatacctattgtatgatcctaagaacaaaccatttgttcttttccttttagttagtattcaaaattaagggaaaattgcttacaattgaaatctgggcattataaaaatgggtcacagtacaaagccttccac

SEQ ID NO: 117046 - DNA, 1542 bp, Homo sapiens
cgtgaatttgctgatctgagttctttggcttttcatacgtggttgtcctattgtactgcaggagctttgtgcttttactaagtttactactagaaaagccttgctaaaattctagtgtactctcagctacttctcttatagctgtgtcttggtgactaaagagaattcttcttccatgtagccagagagattaacagatgtccgagctgaaccccaaagcatccagccgtctttcccgctttgaccctgtaacctctcccctggttggcagtgtgcctgtgttgacagttctcctggttcagccaaaggtgaaagataattgcttgtggagtagcggctgggatggtatgtgtttttgtagcaagcatccccacccccgtctccaggcaaagccttgaatctggtgcatatttcaaagcatgtgttaaactttatgtgatactgattaaaatggagggctccagggtgaattggcagagtcccacaactgcatctgccaaatgacatacagagaaaatgtcttgctacaaatggaagggctgaaacctgtctatcttagcaatatgtaagcctgcaaaaggaaaggtgactccggccatgtgtatatacacagcctgtggaacatgcaagattctttagcaactcctttgttcctatggcattttaatgcaaaagaaagtctttttattttccttccccttcaaacaacaataacaacaaaacccatatggaaataatagtattacatgtcagtgctccattcccattgaacatttgtttaaaaatctaacttggaccaaaaatatggaggtggaagaattatctatcttctgaaactagatttgtgagtcactgagataagatctgtgaagttcactcttttattttattttttatttttttgagacagagtcttgctctgttacccacgctgtagtacagtggcaccatctcggctcactgcaacctccgcctcccagggtcaagcgattctcctgcctcagtttcctgagtagctgggattacaggcgcccaccaccatgtctggctaattttagtatttttagtagagatgggattcccatgttggccaggctggtctcaagctcctgacctcaagtgatctgcctgtgaatgcctcttccaaagtgctgggattacaagtgtgagctaccatgccccaccagttcattcttgaaggaagaaagctcttttcaaagcagaaaatttgtatccagagcttttagattcaaggtctccttaggacattcttttagaaagaaatatgcatttatatcataggcatagatcaacacttcctcaaaagcaatgtagacaacattagtatctcatgtcacatttcctcaccctgcttttatgacaagttaggatagagaaaccatcagttccttaaagggatttggatatatttttttaggaaagcagaaaggataagaaatttagaggagtaaggatgagtggcacaaggaaaaaaaaaaagaaaaaaggaagaaaagtttgtggaaagaggaaggtaagtag

SEQ ID NO: 117047 - DNA, 999 bp, Homo sapiens
tgagcctttctttggcccatatgttgctctgaaatttttggactgtatcatattagcaaagtgattcttcgccatcttaattcatctgctctgaaatctagaatcaggaaactctaaaaatgcatagagaagcaaatatagatactgtaaaatctacattctaactacatgccctttagttccagaaaagttcttcttcacctatttaatctttctccagatgcaattttaaaaaattcttacattcactcccctaataattattgagcaatttctatggacaaggctctatttcaggcattcagtaaataaacagacacatcacataccctcaaatagcttatattctggtgatggggagaatattcaataataaattaatatgtcatgtggtaaaaagtattatgaagataaagcaggaaagggggctagcaagtgacaggtggtgtaataaggatatgcgttattattatataataagaagaatacgaagtaaactccatgatatttgggacttattattcacctccattgcactaacactgataaaaataatggcacatagtaagcacaaggtaaatattgtgtgaatattttgagaatgaatgaatgaatgaatgaatgaatgagtgatggtgaggaagagaacccagttaggaggttacaataattcaggtgatagccaaatgatggctaaacacaggaagaaactttgcaaatcatgagaggagaccatagtctggatacatttaaaagatagaactggctgggtgcgggggttcatgcctgtaatcccagcactttgggaggctgaggcaagcagatcacatgaggtcaggagttcgagaccagcatggccaacatggtgaaaccccctctctactaaaagtacaaaaattagccaggtgtggtggcagacacctgtaatgccagctactcaggaggatgaggcgggagaattgcttaaacctgggaggcggaggttgctgtgagccgaga

SEQ ID NO: 117048 - DNA, 197 bp, Homo sapiens
tgggaggactggatgccttcaggaaactagggaagacctgtctctgcaagaaggcaggaagtgtagcttatgggaggctgaggagtttggagtttctccttggggaaggtgggagccatggaggctgaagacagttgtccaactcagggcatacaaatgagaggaactcaactgctgctctgcaaggaacccacgat

SEQ ID NO: 117049 - DNA, 178 bp, Homo sapiens
gcccatgggaagagtccaccttgcctcagagcctgagggtcagaggaattctgattgctttcctgagacccctgggaaaggtttgagcagtgcagtcagggagccagactttgtcaggcctctgggaagacagagagcaacaggagggaccaaggcccaaacccggaagtaaggctgg

SEQ ID NO: 117050 - DNA, 264 bp, Homo sapiens
aagaagtcataataggactaaaatattaaaatgaggaaaatgaattttccaggtaagatggcatgatgtgtggtggcaagcattctggacattaataagatctcagctttatttcttacttcctacatagcttttagataagttaataaatcttactggactttctcaaactctagttttctccactgtaaaatgagtgcctaacaaaattgtaaggactaaatgagatactatacatgaaagtttctagcataatgtttggta

SEQ ID NO: 117051 - DNA, 424 bp, Homo sapiens
cacattttcccatagtgttcttaaccagggatagtaacattttctgcattccccccagccctgcaaataatgtctggaaatttgtggggccatttttgcttggcacacagacttgaggtagataccactgacatttagtagttgggagccaaggatgctaaatgctctgcagtgtgaatgacactccagcacatcaaagattatcctacccaaaatacagatagccccacttagagacaagtgcattattaaaatgctgatttttcaggattactagaataattatccatttttgtaataggcctacctggaccatgcaaagatattaaagcaagtgacattaccaagagttcttgtaagttaacttgggaacctccagaatttgatggtggaaccccaattcttcattatgtcctggagcgca

SEQ ID NO: 117052 - DNA, 268 bp, Homo sapiens
tctctcagggatcctgccgatcattgccctggctgtgctaagctgttgcccacttatacttcatggacattgctagtcttacacgaatatttgtgctaatagactctcactggctgcctggagcatgcatttcccagcctgctgttgtccagtgaggtgttcgttattttgaccctagtcaggacccagaggaaatagtctataggataggaagtatttcttctctcaaacaatagacatgctttctctactgtctgttctagtttct

SEQ ID NO: 117053 - DNA, 299 bp, Homo sapiens
gttacataaaatgtctttccagtagacatatatctggacataaaactattatcagtagtttgggttaacctacgtggtatgcaggtttctcaattatacatacaacaggagccagtgagaaagacccgccccagcgatggctccatgaagagatggggactctgagttccagacacaatcgcaatctgctagagcccactttttctagatgacagatctgaagtctggtcctcctattcagaagccaatcccaggactgaggtctttaggaaccacagcagcaatgaaatcacccactt

SEQ ID NO: 117054 - DNA, 352 bp, Homo sapiens
atgcccgaataatttttgcatttttagtagagatggagttttgtcacattggccagagtggtcttgaacttgtgacctcaagtaatctgcctgcttcagtctcccgaagtgctgggattacatgtgtgagcctggcctgaatggcatttttaatgtgatggtttcagagtccttaacgaagtaagatataatctcccattctttattacatgtctatgattgtgtcaagaagtcattattgccattttttttactttcatggtaaaaatagccatgaattataagctttttttttttctgccagcctaaattgttacttagtgaagatgagagtacaactgatggactttga

SEQ ID NO: 117055 - DNA, 655 bp, Homo sapiens
agcagtcttgtcacaaaatattaaacctggacctgatcaagcatctggactggcttatggatatagagaaaatgtaggggatagatgagcacgggaaatgtctccgtggggcaaaattcacgaaattcagattgttggacactctccaggacaaaaggtctagattcttcaaaaacaacaacatcgaaaaaaaaaaactgccagaaagaaaaaatacagagggagaaggacacagaacacatttatgagtcttttcaccctcatttcgttgaagattttattggccgaagaaccctcagtaggcacgaaattcattctcacaagcagagagatgcattatgctccatttattgctcatcctaaattataaacatttccagtgaatgtaaaggaagatatgattgaaaaggactctgtgaagacaggatgtttctgtacagtccttgtatctgctcacctattccaaactttccagagattttaccagaggtttaagatattctcctgagggtttgctgtagagagatttttcttaactaaggagtgcaagtagcaagcaatagcccacccagttggagacaaaaaagaagggtgtcagtgttcccactgttaaaaaacaaaaaaaaatcaccctggacacctctgagaattatac

SEQ ID NO: 117056 - DNA, 180 bp, Homo sapiens
tagtagcactgctttaatttcttaaactcagaattgacttgtccatacatccgtttatatttaatttccctgaagctctgaaaatagggcaaaagaacatagtcttggtccatcagaggtcttcttttttgtctttttggcctatcctttgggctcagtctaaatctttcccccaggatt

SEQ ID NO: 117057 - DNA, 240 bp, Homo sapiens
taacttctctgaaatcgtccgccccatgtgccttccctaatttatctgacagatgcaacactgtctcccaccaccgtaagtcttctctcccaaggagaggtaggcactctctaagacctaagttctaaggtacatataataatgcattctattttatttttaaatttattattattactattcttgaaacagggtctcatcctgtcgcccaggctagagtgcagtggtgcaatcacagct

SEQ ID NO: 117058 - DNA, 851 bp, Homo sapiens
cacccgccaccacgcctggataatttctgtatttttagtagagacggggtttcattatgttggctggtctcaaactcctgacctcaggtgatccgccttccttggcctcccaaagtgctgggattacaggcgtgagccactgtgcccggccgtaagaattctttatatgttgtagatttagccttttccctggcacacttttgcaagtattgctaaaagatttcttttatgttttcttctacacatttggtagcttttcatctaaagttaaatcttcgatccatttcaagtacattttgtattcagagtgaggcacacgcctgggttcctttctgttctatgtggatatctaagcttggtacctttgttttgattaaataaatacaaggttttttttctggactttttgttctcttccattgatctgtgtttctgtctttatcccagtaccatcctgccttgataagaggtttaaagtaaatctgaaattaggtaatataagtcttgcaatcttcttactttacaaaaaaaaaaacaaaacaaacaccaaaaaaacactttttgggccccctggccccctaaaaacttttctaacaccttctcttttggccgcggggccccagtagtgtcagttcaccttggcccacaagcgtgtgtcctccaaggaaaacacccgggcactggaccacagtggttgtggtagttctcccaccttataaaaaaacccccggggggagacaccagaagttgttttttgacacaatcccccgatgggggtttccaggaggccactacaccgggcttctcatccacacacgggattcccaagacggagtccgatttaatagcag

SEQ ID NO: 117059 - DNA, 410 bp, Homo sapiens
gtgaccagccgcagctttgtctcactgcacctgcagaattgggcagaaactcctcccagtctccatgatggtgctgttctagttagtatttgagtcctgtttcactgtcctgagatgagctgcttgttgctgttgtgccttgggagagatggaggtgcaaaggtgggcagttgagggtcttaggacctaatgacccagccaagaagtgacattttggtcaactcccactctccaggccagctggtgtcccagtgatgccagcatcccgggatggtattcatttcatctgccttgaaatagtaactgcaggtgtttgagaagcgcggggaggttggtgtgggctcagggaggttgtgtctcttccacgtgcggtctgtcatggctgagagcaggccctgccccacttcttg

SEQ ID NO: 117060 - DNA, 329 bp, Homo sapiens
cacacagtgagcttacgttacacgtgaccttctcgctccatccaggggtcatcaataacaataaacctaagcctaacccagcatgcttcaactgttttcaaagaaagagtgacaaagcttcttccatactttacatatggaagttctcacaatatttctgaacaaaatcacagaataaaaaactgccatatttgtgagctaggaaaaaaaaatacctgggacatttttgttttttaagagacaaggcctcactctgtcacccaggctggagtgcagtggcatgatcatagcttatggcagtttctaactcttgggctcagatgatccct

SEQ ID NO: 117061 - DNA, 803 bp, Homo sapiens
gtggaatgaggggattggccaaggaagacacaagccccaccttttatgtgaagagcctagggactgtgattcaggttagcaagggtggcagagactccaagcctcatcctccctagcctccacaagggaatgttgaggtccctctgattgttaaatctcaccaattacagagattctcttctcttctcttctcttcctccttccgtccctccctctctccctctctctctctctttctttctttcattctctttctttttggattcaagcccttctcattagaacattttttaaaagcttaattttagccatttcaaaggtgactttttgatcaaaacttggcagaactagctcgggcccacagggcaatgtgaataggttgggagtgctgtctctgccctgctcggtccctgtcttcatgccctactccatgctttgttccttcattgacagctaagaggcagctcatgcagaaaggcaagaaacaaatgacacccctcctcctcttctaccttctaccttctcattctgtagtgtggccagttataatccctgaatgaataaagtagtttggacagatgggtgggaaaaaatagcaaacagcccaagtgccgaggctctgataatgtcagccatccagaaagagtccaaaagggaagaagggagaaaagtctcccccaaaatgaatgggacagagtgtgaagtggatctgtctcgaacagagactgccccctccattgccccacgatagaacagagaagaggatagaaacaatagtaaaagggaagttacttgtcttttgg

SEQ ID NO: 117062 - DNA, 740 bp, Homo sapiens
gtggaatgaggggattggccaaggaagacacaagccccaccttttatgtgaagagcctagggactgtgattcaggttagcaagggtggcagagactccaagcctcatcctccctagcctccacaagggaatgttgaggtccctctgattgttaaatctcaccaattacagagattctcttctcttctcttctcttcctccttccgtccctccctctctccctctctctctctctttctttctttcattctctttctttttggattcaagcccttctcattagaacattttttaaaagcttaattttagccatttcaaaggtgactttttgatcaaaacttggcagaactagctcgggcccacagggcaatgtgaataggttgggagtgctgtctctgccctgctcggtccctgtcttcatgccctactccatgctttgttccttcattgacagctaagaggcagctcatgcagaaaggcaagaaacaaatgacacccctcctcctcttctaccttctaccttctcattctgtagtgtggccagttataatccctgaatgaataaagtagtttggacagatgggtgggaaaaaatagcaaacagcccacgtagctagcaaggtatgatccatccatagaaagagcacatcctctcagaaatgaaagaaaagtttcttttttatgttcctttattttttttgagatggggtctcgcgctctaggtgctccggggcgaattgt

SEQ ID NO: 117063 - DNA, 514 bp, Homo sapiens
tcttgaactcctgacctcaggtgatccacctagctcggcctcccaaagtgctgggatcacaggcatgagccactgggcctggcctacaacttcccagtatttaaagacttctgtgatgagatcagtggtaatagatggaatttttagtattggataatgaaatacataagcattttgaagagctcacaactgaggaaacaaatattaacttaccaatgcatgatgtacagaattatgcatgggtaaggatccattcagagtgaaggcagacatggattttaatgtaacagagtacagaaagttcattgatagggttttagattttacattggagctaacctttaggaaactaccatctaggctgggtgtggtagctcatgcccgggatctcagcaccttgggaggccgaggtgggaggattgctggaggccaggatttcaaaaccagcctgggcagcaagcaaggctccatctctgcaagaaaaaaagaaaagaaaagaaaaagaaagctacaa

SEQ ID NO: 117064 - DNA, 237 bp, Homo sapiens
tacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttga

SEQ ID NO: 117065 - DNA, 646 bp, Homo sapiens
ccaagcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttccttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatggtgaggcccg

SEQ ID NO: 117066 - DNA, 421 bp, Homo sapiens
aggctcacaaggcagctgagcacaaagcttccactttgcagcggaagaaagtgaggctcactttgggaaaagattgggggccactcacacactctggcccaggctgcaggaccaggtagggctactataccaggtgtcccagccaccatcggacccatcgtgcctggaaaccatgtgtggcctattccttccagcccctttcttgacagagcctctacttatccatttgcaatcaagccagctcaatcgacatcagagtaaagaggcccttgtttccctcttcaaatgaggaaactgaggttcaaagaggaggcagggactgcctccagtcacatggcatattaatggtagagccaggactagaaccccagactcctggcttgttccacggccccaagctgtctatcctggcactgtattc

SEQ ID NO: 117067 - DNA, 607 bp, Homo sapiens
ttaagatcttcatgacagagggtagttgtgcaatataaaaccaggtgcctgctaaaggtaggctctcagtctcctacagaaacatttgaatagtgtgctatcattttggctatttacattttgaagcaatggctctctactccccaagcgttggactacagcacttctgcttgccctctcctggtggctggagttttctcttgactcctacctcctgccactgaggtacagcccacaatacagggtgaacagccaggaggtcacatctcacatgaaccccaattgccacagcagcactccagcgccacatcagagagtgaagcctgagctgcaggaggagagcctgcaggcctcctgggtaggaatgcaccttcacaataatgagaacgggaacagttttaggctcagtttctatttataatggtgacatggaaaacattctgctggatttccagcatgagtctgtaaagagacagctccaagagttccattgtgacagcccacctcattcacagacactgtgaaatgctaaaatggcttctgaaacagacactcaaagcattggagagaaaaacagctctcagtctcagaaagattataccgagag

SEQ ID NO: 117068 - DNA, 444 bp, Homo sapiens
ggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgttgtatatcagttgttgggggccgtgcttccccagggcagatgcatgcaggggctctggggcagagtgatcgtgggttcgatg

SEQ ID NO: 117069 - DNA, 858 bp, Homo sapiens
ctgaattgtcagacgccagtaaggttgagacacggtatcctaatataactactagtcctctatgcacacaaaataatagggtatttagagggcgaatactctacaaatctagtaatgttcaaaatcaagtatggagttccgcattgggcattcaacgcccatgcctaccctatgcatatcaccccaaatttcagactataccatgatatcgaccatatgtgataatcttccaccaccccctgcgtgccttcagcactcaaggaattatacaacataattgtaccagggacggttttcatttgcgttagaaaaaagccacacaatccttccttgaaaggacccactcttctttttcactcatctcctctcactgatctctccgctggtggtggcggataaaaggcagagatgtggtcaactcccaaatgagattatgttctgggaattcagagattacagtctgaagaattcaagataaggtatgaacctccctaaagaaccttcatatcatcttgccctgcatgaaaatattagaagcctttgctctggtctttcatggtacttttaaaggatattatcatttacaaaatggaataccaatgacttttcacaagtggtctatcaactaagcatgtacttaagtaaatattttcagaggatttcattaacctctgagtgaatagttgaaaaaaaagaatgaaacagatataagtccatgtttttatttgtaaataaatgtattgccaaaattacatacaaataacaaataatgtctcgagtgacatgcaatgatcaaaatcctcaaaagaatacttttgtttagtagagatttgaacaaataaactacaatttaaggag

SEQ ID NO: 117070 - DNA, 684 bp, Homo sapiens
tctcgcccaggctagagtgcggtgatgtgatgtcggctcactgcaacctccacctccggggttcaagcagtcctcctgcctcagcctcccaagtatctgggattacaggtgcatgccaccacacccagctaatttttgtatttttagttgacacggggttttaccgtgttggccaggctggtcttgaactcctgacctcaagtgatctgcctgccttggcctcccgaagtgctgggattacaggcatgagccaccatgcccagctggtatgtgtactttgaaaaagctcccccttcagcccccagatccttcgtccacttttcttattgatctgtagcagctctttgtatatttgggacattcactttgtcatctgtgttgcaaatgtcttgctctcccaggatggttgtgataaacccacatgctcctccctctcgctgagagccactgctcgcaggggacagtgtgctcaggtgttggtgatgcaagagctggcgcagcagagcctcagagacccagctctgctgccaccaccatctctgtcagtcccacgggtgcgtggcctcgctggggtgtctcgtctgccattgttcctcagttccaccgagtgacacctcgttagtctccaccctctggcatcctcagttgtctctgccttcccattattcaagataagtggctgtt

SEQ ID NO: 117071 - DNA, 673 bp, Homo sapiens
gctccttcaccttccaccacgattgtgaggcctccccagccacgtggaactgagcctgaagttatggggcgtgtatacagtgagggaccgcaccgcccgccggcagctttcatctgtcaactcctagtgagaagaacactcacccaccaaaaaaaggaaaaattgaaaatggtgctgatttcgagcatccacagggtacttggagactggccccgggctgggccctgtctggagcgcagaggcctgcctgtcggcctgggatgactgcagaggctgctgtcaagaaagctgtgctccatggtcaggacaagcaagccgacctaggggcccaagagaccaagatgagctctccaggccccacagcccggccttgagcctcttctgctgaagccagcccgtgcgctgacagcggtatggggcctgcatgattggcgcaggaataagcaaagagaccctggacccaagggcgggtccagaaagcggccccttccccacgccgatttataacaaaggcccctgcagagcagggggaagaggtggcctttccctgccacgtgtccagtatcagttggacactgacagaaaaaagtgaccccatccccacaattaatttaaaatgagtcacagagcaggctgggcacggtggctcacacctgtaatcccagcactttgg

SEQ ID NO: 117072 - DNA, 484 bp, Homo sapiens
atggtccccctatcttctaaagccatcctctccaactgggagctcctggtgtcccccatgcctccatagtgggctgcagttcccaattgtgcgcattcctttctcaagctggcaggactctctcctttcaccatctaggtttagtctaagttccatgttcttcagcgtctctgggggatgtgtccttcctcttccttgcctggctgcaggttcacgtcaggtcccacctggattatttgtctcctcaatgacctttcagaaacaccctgccaccagtttgtcttacagagacaagtgccctttccaaagcacagactggagcatgccaatgtgatgctcactctcccttgagggttccccgaggctggcgaggggatgtcctggtgccttcaggtgactccaacatctctgtgtcatgccccagccttgctgtttgcatttgctcctgcttaccatcttccttctccttggtgcaagcccctcc

SEQ ID NO: 117073 - DNA, 417 bp, Homo sapiens
gtgatgctagtgttgctctatgggccatgcattgtactgggaggttttaaataattcttttagctgtgtgttttgctaatcaatgttagacattcttcatttatttcctgcaataatttatgaacatttcatttctccatcagccttacttgccttacttgccttcccatctttacattacagttatatttagtatttttattaatattaataaacactgctatagtacagtgactgtaaaattgtttactgcatagtaaagcagtgaactattataattcatttctcatacagccttttgtttttcctggagtttctaattgtatttattttcttcttacaatgtcttgctcataataattctgtttcccctctcccctcgataaagctcaccataacagctcatctataaagtcc

SEQ ID NO: 117074 - DNA, 249 bp, Homo sapiens
gcacgagactgggtgaaaatatttgcaaaagacacatctagtaaaggactgttatccaaaattacaaagaactcttaaaactcaacaataaaataatgcaacaataaaataaacaatgggcagaatagactgggcatagtgattgactcctgtaatcccagcacttcgggaggtcggggtaggaggattgcttgagcgcaggagtagttcaagatcagcctgggcaacagcaagacctcatctctacca

SEQ ID NO: 117075 - DNA, 94 bp, Homo sapiens
taatttttaagaatataaataattatatttgcctattaagtaatatatagccatatatatatatatatatatatatatatatatatatatatga

SEQ ID NO: 117076 - DNA, 772 bp, Homo sapiens
gacagccggcaagaacgaggacacttcacagggctgggctgccgaggaatagatgagagactaaatctgatgagaatcaccaaccagtttgatgacttggagaacagtcacttcctctttctgggctacagttttctcatcagtaactgaagagcttgcagtaccttcaacattccttcagagctgctctgtgagaagacaaggagaaaatggtccctactaggatactcacctctgtctcagggagacactcaagcatttattcaaccaagaaagagaattagttccagtacagacagccagcatgcagtgagcactcagcgatggccaagtatgggagaagccatgctggaatgaacatgtgggaccattttgtgcagtttctcagaggaagataacaaccatcttcaatggcacatggcagttgccaaattgccatgaagcaatatctaaagccacctcatgctcaggagaaaacgctcaccttcccctcctggctccccgtgctctacacgttcagagaaacttctctagtaatgaactcaggaactggtcactgagagtatagtctctatggacagcttcggagccatggagtgaagccgagcaaatccatggaccactgccctgcccccggtctatctcgctagactagggacaggacttgggtgatgcaggaacagagaatggcctgaggaggacacagaccagaccagagaggaaggaagatgagaggaggatgcgggaaaggggcttacatcaatctccagaa

SEQ ID NO: 117077 - DNA, 643 bp, Homo sapiens
gctctgtgttgtaaacactgaactcagctcagtcctgtaaacaggactaccttgtgaaacagaaagagctgtgttaattttactttcattaatatgaaggatagtatggaaagagcaagaagcatttataaaaggcctctttggcaatggcctttgatgtctacgtctgaacaaaatgtcctgatgtgaaaataaaatggcaatattaaaacagcttttctgtgaggtcaggtcctattacttgggaatgtttaaagaaaaagcataaaccaggcaataataggcttagaaattctgcagtgtggtcagaataagatggagtttggtggaattagtttatgttgagtatgcagtgccagattagatagcaatgttaaccaaatccacagatttttcctggggtgaaaatatctcatttcagagaaaccttatgttaggcaagtatgttcacagaggtagagttggggggtgggggttgttgtttttttaatttttttattgtcttcttttccatctgtttcagagaaaccaggtattttcaagcactctttaatatgaaactgttaaaaagcaaaattatacactacattttgggctgtgggttgctcaaaggtagatggaataataagcttcccattcagaa

SEQ ID NO: 117078 - DNA, 213 bp, Homo sapiens
tcaagaacaaaaagaaaagttcagtcatcctatttatcagggaaatgtaatcactatttcagaatcttcccatgaagaaatacaaagtccagaacattttactggcaagtgctaccacacacttaaatgacaattaattttaatctgacacagtctattccagagaacagaaaaataggaacactctcccagtcactgtatgaggttagcaaa

SEQ ID NO: 117079 - DNA, 779 bp, Homo sapiens
atggtaacagtacatccagagactggtagtgcatcaagcccaatcacgcagcatatgtcctctgggataatgtgtgctaagaacctttacagagagggctttgagggcatgtctgatctgaaatgtgtccaggatgccaagggaggttctttctacagagatcactgccctgtgctaggtgagcagaatggcaacaggaatcctggtggattgcagattggtgacctggtaaatatagatctcgacctcgaaattgtacagtctttgcagcatggtcatggaggatggactgatggaatgtttgagactttaactacaactggaactgtttgtggcattgatgaagatcatgacattgtagtacagtatccaagtggcaataggtggaccttcaatcctgctgttctcactaaagcgaacattgtccgaagtggagatgctgctcaaggtgcacaaagaggcacctcgcagttgtaagtgggtgatcctgtacatgttggttatgacctggaacgaattagacttctacagggaggacatggggaatgggctgaagcgatgcttccaactttaggtaaagtcggccgattccaccagatttattgcaacagtgatttaaaggtggaagtttgtggaacatttcgcacatgcattcaacagtaatttccaaggtggtatcggaaggatctaccatactcatgcgtctggagaagactctcaccagtcccgaaaattatttgaacccaggaacgggtgaccttatgaagaataagtaggct

SEQ ID NO: 117080 - DNA, 423 bp, Homo sapiens
ctcaacagtttgccttcactctaagatatttcaagtagatcctgatattcttagtttgaaccttatgggcctgtcttattttggatcctgctgctaatagttgagtctgaattcatatgactgaaggctgagacctggttccctagaggcatatcccttggcctttaccttgataggaagtttgacaatgcattttaaaaataaggcatctttatacacagtgacagtttatctatcatttacatatttgaatcttataaatgtttaaaacttgcttctttgggcaccaaaacttttaaaattattttttaaattgagatatttttctcagtggcctttgggcatcattggaaatgttaattttgctgacttgtagtgggcttattttatttaattttttttcagacagaatctcccaggctg

SEQ ID NO: 117081 - DNA, 315 bp, Homo sapiens
tgacagagcaagactctgtctttaaaaaaaaaaagaaaagaaaagaattaagcttaaaatacatttttacttagtgatttccacatttgcctttctggttcctcttgccgtatgacctggactaggctttgcttctacttgtaacatttgggccctcgtgagggaccagttggtcctcagtttctcctggagcagccaccaggctcccttgctgattggacatgtggaattggctgttcttggaaagagagttggagtcaaccgttcaaatgttctgggacctccgaagcccaggaatcacgccaccacccccca

SEQ ID NO: 117082 - DNA, 2513 bp, Homo sapiens
  misc_feature (424)..(424): n is a, c, g, or t
  misc_feature (1967)..(1967): n is a, c, g, or t
agcttttcatgacaactttgtaatactttttttgtttgctgttatgaaatatctccttttgggtggggtggagaggggatgtcaggtagtatctgtggtaataggtgaagagatgatagctaatgtgaggctgttggtccatctggatttcagggaactcacctccccaccttgtgaaatattagagaaaattaccattactgttctcatgatgttaattatatcttctgaagttttagaggtttacatataaaccaaaccccaattaaggtttaagaaagtggcatgacttagtgcaaacagatgaaatgttgatttctttaaaagttgtcttaatactaatggatcttacaggtgttttcaagaaagttataagttttgtaagtataattttagtaaataaaattttgtaaatataattttnattttggacttttttttttccttccttacttgctgcatcaaagtgaacaaatgacaagtgaaatttttttgagtcttctgagagaaggaagtttataaaagcagatgcctttttctgtacttccaggtcaaaaattgtaggcctccattttaatatagcttattgttagaacaaggaaatttcatttaagacaagaaatgaagtcatagttacattctgtttaaaactaatagaattaaacattttgacataaataaaacaattagaaaactttacaaaataaatgtaaaaagaattcattcacaatacactgattattacagctatgttaaagtctacaattgaacacaaaatataaacaattgttatttaagggattataagtaaatttaataaattttctttacaaaatttttggtgagatatcttataagaagtagaggggtcagaaatcaaatttctgggatgcttattaagataagcttgaaatgtaattgaatttttaaattcgcattacaagtcataatagtagactattcggtaaatgtagggagtaatggtaggtaatagcaaagctaggtaatttgactctttttttttttttaagctcattttcaaatgagagactccatacacggagatagtagtgtcgaacaatgataaaaattctaggagttgttactatcttaacacatttatctaagcatttacctatgttgccttggtgcctttgactgctgacattgcaccctttcgtctgtttttaacttgtcgaaattgttgttataacatttatctgcctctgttcctcaggtatagctgtgaaaatagaaatggttcggggttaaggattgtgaatgggaggaagaaataatcctctcattattttcaatacagggaaagaggattatttgtaaccctgagcttttaccccaaaaggacataaagtataataggtgatctttgcttttataaatgtgaaccataataactactcttgggaaaggattgataggccctattttctacttgccttttcatccatttattttgtgataattcctctatgtttcctaatcatttgctctttgaaaaaagtgagagcttgtgatcagtcctgcacggaagccagtacacaatctaggtattagagcagtgcattgacagagaggctaccttccattttgtgcttccaagaggtggttgtaaataggaaagtgaaaattgttaaatgacaaaaattactttgaagtaaatttctctgcctgttttagaacttaactctagatgaagaatcagtatattttggggggcagtaatagtaagaccaaaaagcaacgtttttacagcagtgtcagaatatctatttgccaagtattatttccactttatggatggggcctaaaagccagatagtttgtttgacttgaaggtcactggttaatgagccttttattactacgtaggttttcaccggtgctgagcaagaaagcttacaaatctcctacctaaggcatgcttatatccgaaccattccaagatnaagaaaatgtacaatttaagcttttctggaagaaaggaaaacctcaacactttctgatctctctcagatcaatagcattttaaactaaatcttttatgcgaaaagttaattaaggcaactccaattcctttcttaacagaaatggttttacatcatcctccatgaagtaactaaccaaagacaggcccaccttcatctttctccttagtaagtttattgatcccagggctctttactcttacacgtccaattttaaaatgtacacgtggccgggcacagtggctcacgcctgtaatcctagcactttgtgaggccagggcgggcagatcatgaggtcaagagatcgagaccatcctggccaacatggtgaaaccctgtctctactaaaaataaaaaaattagctgagcgtggtggtgcgcggctgtaaccaaagctacttgggagtctgaggcaggagaatcacttgaacctgggaggtggaggttgcagtgagccgagatcacgccactgcactccagcctggcaacagagcaagactctatctc

SEQ ID NO: 117083 - DNA, 678 bp, Homo sapiens
aaccgctgccccaggcccactcggcgtggctcggccacgctcggcttgacttggctcggctcggccacactcggcttccctcggcttcctctcggcctctcggcagcactgcgggctccgcagcccttctggccttcacgtggttcccagttctcgtggtacgtcctgcctgccgggatctcagggctcttggaagaccccaggcccggggagggcatgtcccaagggcatgccaggtcaaggccacaatagcgagccctctcccacgccctgtagtcgtcggagaccaacgtgttctcccaccccattccggtccacagcaatccctgcctacccaacctcacatagaccttaggtcttgaacctcttttcctacctggaaatgaggttaagaactacccacctcatgggtgaagttcaatcagaggatgcctgaaaagtgcttaatacgtgatgtgtgcccagtcattggaatcagccctctctgcttgattctttcattgctgctgtttgtttgtttgttgttgttgtttgaaacaccgtctcattgactaggcgcggtggctcacgcctgtaatcccagcactttgggaggccgaggtgggcagatcacttgagaccaggagttcgtcaccagcctggccaacatggtgaaaccccgtctctactaaaaataca

SEQ ID NO: 117084 - DNA, 338 bp, Homo sapiens
ggttctctgcctttccagggatttgaaccataggttggttcataatagcccatgtgctctcagactgtagtgtgcattggaatcatctgcaaggcttgctaaaatgcagagtctcagggcctggtctcagagagtccaattcattaaatccaaagcaggtctgaggaatctgccgttaattaaacacactcccacggcaatgctgatgaaagtggtcttcagctcatgctttgagaaatgctgctccacagttttctcccatccgcctgctgcagtcacacacatgtatgcacacatacacacacacacatgcaaacacacacatgcgcacacacaca

SEQ ID NO: 117085 - DNA, 409 bp, Homo sapiens
agtgcttctgtcattgggacttctcagtgacccttgcacatccatgcactgtgcacctgaaggtttggcatatcctgagcctgcatcctgagctcattcttcttaatctacagactcttcctggctgacctgacccacatccacagcttcagcttacacagtggggatgtctaaatctgtatgtctacaaaaggcttgcccgccaagcttccaatctactcatacacctcttcaaatcagcccgtccaaagcttagctcataatccctgtctcacctgtaactcgagtcagcctccttttctccctctccctcacctgccatgacattttctaacaacattctctcaagcttttttccacctccattgccaccatcttagttcaggctcttgtcatttcctgctaaacc

SEQ ID NO: 117086 - DNA, 453 bp, Homo sapiens
tggggtgaaagcggcaggaggtatgtgagatggtgaaatgatttgcttctgccatgctggggtcacgggtggatcgccctaaactctcggtggccccctcagtagttttggaagaggaccaagtccttgtctctccagcagtggacctggaagaaggatgccggctcagggacttcactgtaagttcagctttattttgctcccctggtaggacctcacagggctgcagccaagctgcagcctggagtttttcctgaaggatttaagttgttaatgcaggagcagggggcaagtcttggggctcagggtgaagttatggatggaggcagagccctctcagaattgtgtagcatctttcatttatcttactttggttctctgggaaaaacccttgcagtgatttccagaccaggcagcatggaaaagctggctggattcagcctttagatttcc

SEQ ID NO: 117087 - DNA, 580 bp, Homo sapiens
atgcttacctgaatgctgcatctcccttcgagcttccttggtgcctgactaagctcttcttgttactcacacttctgttgtttggatctcggcttctcctgaacaacaagcaacaaaatacactctctctctgtctttatttttttatttttttatttttttttttgagacggagtctcgttctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctctctgtctttattatctgccttggttgtttctggattcttctcacgcccttgttccctagctatatgatctcttctgggggagccaaaagttaccctttgtttccttaatagccaaccatcat

SEQ ID NO: 117088 - DNA, 499 bp, Homo sapiens
gctgtctttacttcattataaatatatctgctaattttatctctttctttcaggacaggagttttaaagggaaaaaagggagggatgatttgggagaagttacatgatttacttgtcaaaggcagatctggccatgtgtctaactgggagatactgggataaaccaacagacagggaaggtagaaaatcgctggtgacaataaattaatcaccttgtagcattccaagagaaagctctgggccacatggtgtccaaaaagtgccaaatgcaggtaacttcactcattcattcatctatccatccattcattcaaaaaacatttaaccagctttcgcttcatgctcaacactgggagggttgaataaaacagtctcacaaagtggtagcagagacagcctaatagatcacccatttcagcataatgtggcaaagctgtgattgaggtagcaagactactagaggagcacagaggaggagcatctatattggattaggaag

SEQ ID NO: 117089 - DNA, 862 bp, Homo sapiens
agtggcaaaggttacgaagctattagttaaggctctttgctcctcttcctgcagtccatgccatgaaagtctgaatatactttcacagtaatcaccctccagtgactgattttcaaaagccaagtgtggcaaattatagtaagtcactctgagtcgctgtattgcctcttgccttgtgaaaatcagatgtttgggggtatccatgtatgtgaccacaagcatcagtttgatgtttgtgatttttaaaaaaagtgtgtgtgtgtgtgtgtgtgtgtgcgtgtgtggtggtgtcagagagatgtttcatagaaaaagtaatttaagtgacattctcatttggcagtatttaattgcttccttcctaatgtgtacatagcaatctggctgattattggttgttacttgttcagaatttattgtgtcttattgctatgtatgcaactgagtgtatgttaaagtttagacttcagtacgctatctgcacaattgtgtgtgctttaaacctctgtaaacatgcagatgaatcatgtatggtgtgttaaatgtgacttccactcttgaaacaataatttttggtatgtacatttgaaaactatttgaacaatctaaatgtgtactgtaaatgtccagtaccctcaatcaaaaacagcactggtaaaatgtatgcctcttcaacctaccaatttataagaggtcagggataaattgagaattaagttaatttttctaatggcaagtatttttggtaatttcttacctgcctaagtgtattttcaagaaaaattgtcgacagaagaaatctaagctatcagagggaatgactttatttcataagcattaattatactttatgtcttaccta

SEQ ID NO: 117090 - DNA, 403 bp, Homo sapiens
cataatcacagagagttctactggacattgctgctctagaggctggcaggggccagtcaacgaggagctttgaatgacatgccaagatgtttggaccttatcctgaggataataagatgccactgaagcatttgatataagggaatagaatgattaaatttatgtgtttagaaaagccactctataggtcacaaaagagattagagagaggcaaggctagaaattagagatatcagtgaagaaagtattggattaagcagagcaagagatgatgggggccttgtatgggtagaatagagagaagtatatggactcaagaaattttaagaaatagaatcaataggacatattaaacaatatgaaacaatatctaaacagatgtggaggatgagaaggcagaggt

SEQ ID NO: 117091 - DNA, 314 bp, Homo sapiens
cttgaacctgggaggtgggaggtttgcagtgagctgaaatcgcaccactgcactccagcttgggcaacagagcaagacttggtctcaaaacaaaaaggaaaagaaaaattccttgaattcgtcaagttctttcctgtgtcacattgtcttccatgtttcctttatcagaaatgcaggccccttatttctgatggctcctactccaagttttcacattatgtgggccccatgcatatgtcctctaagcttgtctcatcttttagctttctgcttcaatgtcacttcctcatagagcccttctcagatcttccagg

SEQ ID NO: 117092 - DNA, 385 bp, Homo sapiens
tagatgatgcgtctcacacataaagcctgtgctgtttgtcaaatgcacagaggtgctgctataatttttaagatacatgtaaaaagtattactgaatgcatggtagctttttctcagcatgcagttcttcatttgtagatactaaaagtacaattatgattacttggaaggatccaaaagtggttttgaagtttgtttgtttgtttgtttgtttgtttttgagacagagtcttactctgtcacccaggctggagtgcagtggcgcaatcttggctcactgcaacctctgcctcctgggttggagtaattctcctgcctcagcctccggagtagctgggattacaggtgtgcgccacaatgcctggctaatttttgtatttttagt

SEQ ID NO: 117093 - DNA, 180 bp, Homo sapiens
aagattgcaccactgcactccagcctggacgacagagcgagactcatctcaaaaaataaataaatcaaataagatatccttttaatatattttaatcagctttattgaggtataatttattcactaaaatgcacattttaaataaagcttgctgagttttgaaaaagtatacagccatgt

SEQ ID NO: 117094 - DNA, 1382 bp, Homo sapiens
aggtccacaaaaaaatacaacaattagccaggcgcagtactcacacctgtatcctagcactttgggaggcaaggtgggcgaatcacctgaagtcaggagtccaagaccagcaaggccaacatggcgaaaccccgtctctacaaaaaatacaaaaattaggcgggcttggtggcatgtgcctatagtcctagctactccagggaggcagaggttatagtgagttgtgattgtgccattgtgctccagcctgggcaacggaggagaccctatctcaacaacaaaaaccctgatttgcagccaaatagtttcctcagcctatttcctgccagtaaatggttaggagcccagtggctttgttttgaacagtctttgtccattttagtccaagctagtggtgcttgtgttagttcagttctcttaaaaacattgtgagttttctgtggattttactgggattcactgtgttagataaaaaccatctccaccaatctttttaagatacgctccctctctggggtgcatgtcagggtgctgtgtgagaacacacttgttctttcagacgcctgtttgtctcactaaccatgagggtttgagaagcaattccttacatctttctgggattttaacaaagggcctcatgttgaccagaggccacgttttacttgtggcatcgaaaccacctttgcataaattataactgagaggattatgacaatgaaagagatgtgacctaacttactgatttgttcctaacctccaagctgtccttgttcattcctgggtgtaggctgaactaattttggaaggaacttaacttacagtttaactttgttttttgttgttgttgtttattttgttttgttttgttttgagacagagtctcactctatcacccaggctggagtgcagtggccccatcttggctcactgcaatctccacctcctgggttcaaacgattctcctgcgtcagcctcctgagtagctgggactacaggtgcacgccaccacgccagactaatttttgtatttttagtagagacagggtttcaccatgttggccaggctggtctcgaactcctgatctcaaatgatctgcctgcctcggccttccaacgtgctgggattacaggtgtgagccaccacgcccggcctatagtttaactttgaaacaaagatggtaccagccctttccctgaacaaacacccttttagcctgggaactataaactgcctttgcaggactaacaaattagctacaagattagaaattgtggtttaggagtcatgcagctggaggtggcaagattctaaacccctccaaattgctcctccagataacaggtattttggagaccctgcactcgatggatcagctgtccct

SEQ ID NO: 117095 - DNA, 341 bp, Homo sapiens
ttgtttatttccagacatggattgattaaatccaaggaacagagggggagctggcatcagataaaaaaaggccctgttcttataagattttaaagtgaaagtaaatatcaggagagagagaaggtgataaatgagcatgaatgaaaactggacacttggactctagatcaatactgtgcattcatgagcatcccgagagatggacatggtcaccaggtctgtgttgttaagatggttgaggctgcaggttctgggcatgcatatgtcaggaaacactctgtcactagaaccaactgtttttcctcactttccaattttggaaccttggcaaaagcaatgtg

SEQ ID NO: 117096 - DNA, 435 bp, Homo sapiens
acatagtaatttgaaggataaatgaatgtctattagctagtaagacaggctgctaatcacagacaacttgtatctctctggtagaaggaggactgagcacagataataatttcaacagtcctaatatttctgccttatagattttgcttttatctttgtgtatgtcttataaatatatattttttaatcttttacttttttatcatctggtttcagttccaagtagttttctctgctttgaaaaagcaacagattactctcttatctgtacaggctcctctacaaaacaatgaattctattctggctaaggaaaaaaggctaaattaaagaaaccactaatttcttgccagtgaattaacccagctgagtatccctcatccaaaacgcttgaagtgttttgggtttcgtattttttctggatgtgggaatacttg

SEQ ID NO: 117097 - DNA, 1572 bp, Homo sapiens
gaagagattaaatggaagcaaactctttccatctcttggggaaatgggagatgcgggtgtccactggagccagggcttctaaattttaaaatcacttcttcaccaggctgaagccggggtgcccccacggaaggtactgttgaattgcttcgaaggtttctcattgagagaagctctctgtttctccctaagtgttgggattacaggcatgagccaccccacctggcctttattttattttattttttaaaagagatgtggccttgccctgtcacccaggctggacccatgctggagtgtagtggcctgatcatggttcactgcagcctcaaactcctgggcacaagtgatgcccccacctcagcctcctaagaacccaggattataggtgtgcgccactgcttctggctgggcatctttttttaaaagtcctaatgtacagctgcaattgtgaaacattcattacctgttttcatatttagaatgagggtaatccttctagaggcacacaaagttagctgagtagcaaaaagctgggtctcaaaccaaggtcttctaatttcaaatatcatgttttatctactttaccatgaagctgaattgtgtgagcacaattatgaggtctcctttgcctcccaccctcgctgtattgtccattttccaaggtaaacacacccagttctttcagttctttttactctgtgatttcagtgccttctgctctcctagtaataatatatttaccagccagcatatatttatgatcagtatacatttgtgatgcattctatgggccaggtacagggctaggcattgggactccagagtgcctggaggagaagatcccccacgcttaaatatagtacatttgacatagtccttatccttagtgccctcaagacctttcccagcatatctggctcttcataacatggagagctagtggtccttcctggatctgcgtgtcctcagtctaacccctgcagatctcccttcatgtgggtagggccttctagatggcacctgggctatgccgacttaaccctgcatttcaggctgatcccacacagcctccaaataggcactattgctctaaggtgcctgggagagaaaaggttggccccggttttggaaactttggggttttgcgtgtgtctaaaaagattatcttcagtagttttgctctcccagtgagaaaaggagaggctgatcatgtgctgccagacactgggcaaagggtgatgtttgtaatgaccatccagtgactcctgctgccgctgtccttcctgcctggatgtttttggagcttccgtctactcattcagcatccagggaggctgtgatgaagtaaggaccatctgttagggaccagatagcaaggacatttgcagcgcattgaaggttggcctggatgaccagcaagggtttttcctgccctgcatgcctggactcccacctccccacccctggttaggcttcctggttgtggggagtcatagccagtggagctctagtctgtaacaaacacaccatcggaacaacaaaccctcaggtctttcacattgattagat

SEQ ID NO: 117098 - DNA, 656 bp, Homo sapiens
ctgtgcctcgcgatcagctgatgatctcacttgagaaaatgagtaaacagaaggaaacaatcttcctttgcaaaatccactgagctagtttgacctatatccatgtactcagccttccctcttcatacaatggatagagtgtcctgtccacctgagtccagggtgctgcctcctcacctgtggaaggactctgcccttctattataccccctctctctccagcatcatcaaatctccctctctatgggagcattcccatcaggaaacatacatgttataatatcaatatcgctgataaaaatattcccttaccttaccttctccagccactttatagcaaaaccccacaaaagcattgcttattctgtctccacttcctcaccccaattctctcctgaacccactctaatcagctttcatttcagctgctccacttaacctctctgatgaaaatcagcagttaggcctatatctccccagtcctcattttacctccctctcagcagcattgccacatggctgggcatgccctcttttctgaaaccctttctctactgggcctctgcagcagcacatacttctgctttgcttccttccataccaacctctcgctccatgaatgttccttcaccagctctgcctccttgccccaacct

SEQ ID NO: 117099 - DNA, 135 bp, Homo sapiens
acataagtccctcacaatgccttataaaagagttttatatttaaataagcttggagattcaaaagcacatgatatacaaaagaatggcctttatggcaggtctacaaaagtagacctgccataaagaaagtaatt

SEQ ID NO: 117100 - DNA, 493 bp, Homo sapiens
tgtatactacgttgatttgaatttttactgattggtaaataaaatgagaagaatggggaatatttatgtaaatttcttgctgaattgtgtgttcacatgtgtttggactcaggcttaattttaagtcttatgaggtaaaattatcaaggtagctggttatattctcattactactgtgcagctaaaatttgagaaaagatgaaaaattcacatttgtcttaccatggtcacagaatgttttgtgtttattattatgcaataaattattgaccggaagagtaggcttacttctaaaacagagaaaatatatctttgaatcaggtgataatagtgtagaaggaatttgattaaatgcatacaaccaatatgatttctagcattaaattgcaatgtatattgtgttagtgaaaaaatcattagtaaaaatatagtccagtggtgtatcctgcttgaatagagcaggctggatgcggtggtttgctcgcctgtaatc

SEQ ID NO: 117101 - DNA, 405 bp, Homo sapiens
cttatgtggaatatctcattgccagtcaatgttgaataagtgaggcatttattgtgtggcggaaaggtggttctttgggccagatgaagtaaggtgggaagaaaggaatatgaaatactgagagaaggaattactactttaaataatagatgtagctttggtatgtttttctgtgcaaatcttgagacaaagccctttttgttggaggaaatggcatgcaagggattttattttcagtttgaccatttgcaagtattagagctgtctccatgggagaaaggtgagttccctctggcagtgtggtttacgaaggtttgcttgggaggaaaagagaggagctagttgatccagagtggaaaaacaccaaagcaaagttttctccaaaataacacacacggatttctg

SEQ ID NO: 117102 - DNA, 583 bp, Homo sapiens
cggggttactgcggcgaccgccagagcagccttggcgctatgttggagccaggggctacccctcagcggtacttggggctggtcctgggggagccacgcagggttgtggcagcgctgcctgaaagtatgagactggattcgaatcctcatggttttccatgggaaatggtgatatgtgcagctgttgctgcattttttgctgttctcctttttctgtggagaagttttagatcggttaggagtcggctttatgtgggaagagagaaaaagcttgctataatgctttctggactaattgaagaaaaatgtaaactacttgaaaaatttagccttgttcaaaaagagtatgaagactatgaagtagcgtcatcgttagaggatgccagctttgagaaggcggcagcagaagcacgaagtttggaggcaacctgtgaaaagttgaacaggtccaattctgaacttgagcatgaaattctctgtctagaaaaagagttaaaagaagagaaatctaaacattcgcaacaaaatgaattgatggcggatatttcaaaaacgatacagcctctagcagatgagtcagaat

SEQ ID NO: 117103 - DNA, 305 bp, Homo sapiens
ggcatctgtgcagttgcaaggcatttgggggatagggagtggggatgttgagggtctggcaaagtgggaaggatggggactctgacagcaaatgtcaccgagctagccctctgggctggagtgagttggatgttgcctctctgaacagcacgattgtaccctttctctgcctgcaacttattgatgaccccgaagggtttagaactagcattcaaatcaaccaagcaaagcaggctgcaatcatctactcttgcattttaaatcctaatgaccattttgggaacctgagcaaattactctgcaag

SEQ ID NO: 117104 - DNA, 446 bp, Homo sapiens
  misc_feature (157)..(157): n is a, c, g, or t
gacgagacatcgagacatagtggcatctccaagcctgcgctgtttatgtattccaccaataggcacgcaattatcatggcctgtgatttatactcattcgcgagtccggtagcaagcccgaatccagtttactttcatcattctatcctctattganaaagaaagtacagaaatttttagattcactaaaagtcattgaacaggaatcagtggggtgtttttggcaagccaactccttattttccatttcaagatcagatctaatcctataatagttttaagcctaacctttaaatgactgctcggctggtcacggtggctcatgactgtaatcataacatttgggatgctgaggcaggaggattgcttgagtagtgtgctgccttccaatgagcatggccaaggactcagtttcatctaatggaacaccttcaaactgtcacagg

SEQ ID NO: 117105 - DNA, 342 bp, Homo sapiens
tggacacagggtgttttctcaggaaaacaatagttgagtggcagaagatagatttcctttcatatgagctatttcaaaagcatcttccttgagactgaccttgaggctgcatttctaaaagtgcactgaatattctttttaaaaattacttgaaagctgcttttagggctgtgtgacatggagtgcagtttgacagctgcaaaagtacaagttgtcaagttgttcattgagaagtgagagtggggaattgaaccttcagtctgttcctaaacccatcattgtggattgtttggctgcctgatccagagttctttctatttgttgaaacttaacgtcaccttt

SEQ ID NO: 117106 - DNA, 431 bp, Homo sapiens
tcatgatggtttctcttataatcaggttggaaaggatctcagggtgagtctggtaaaaagccttctgaaatgttagaccagagaattatctggagagggaggaaatgcagggcaagttcctgcaaagcctcacactcatgttggtctcaccgatgtttatcagggagaaacagcctgtactcccagggcagccgtttgaacgggcagagcccactttgttcctcgattctgtttctttccatgcaatccgccctcctgacctaataccgttgaggctggtgtcttgtcccatgggacatggaactagggaacacagatggatctaagctagcactcccctacgttttggcaaatttaagaatcaacactctgaagaaccgtggttttgattccctgagaaggaaatggattaagacttactctccctactc

SEQ ID NO: 117107 - DNA, 453 bp, Homo sapiens
atgtttgattgagaagaatagaggccaagcacagtggctcacgcctgtaatccctgcattctgggaggccaaggcagacggatcacttgaggtcaggatttcgagaccagcctgaccaacatggcaaaaccccgtctctactaaaaatacaaaaattagccgggcgtggtggtgtagatctgtaatcccagctactcaggaggctgatgcacgagaattacttgaacccgggaggcggaggttgcagtgagctgagattcgccactgcacgccagcctgggtgacagagcgagactctgtctcaaaaaataaaaaagaagaatagagattacaattagaatagaaataatggttattatccaggtctttaaagaaaagtcagacacaggccaggtgcgatctcagctcacatcactagtgaattcgcgccgcctgcagtcgaccatatgggag

SEQ ID NO: 117108 - DNA, 505 bp, Homo sapiens
atgtttgattgagaagaatagaggccaagcacagtggctcacgcctgtaatccctgcattctgggaggccaaggcagacggatcacttgaggtcaggatttcgagaccagcctgaccaacatggcaaaaccccgtctctactaaaaatacaaaaattagccgggcgtggtggtgtagatctgtaatcccagctactcaggaggctgatgcacgagaattacttgaacccgggaggcggaggttgcagtgagctgagattcgccactgcacgccagcctgggtgacagagcgagactctgtctcaaaaaataaaaaagaagaatagagattacaattagaatagaaataatggttattatccaggtctttaaagaaaagtcagacacaggccaggtgcggtggctcacgcctgtaatcccagcactttggaaggccaaggtgggcggattacgaggtcaggagatcgagaccatcctggctaacacagtgaaaccccgtctctact

SEQ ID NO: 117109 - DNA, 602 bp, Homo sapiens
aagggacattttacagccatgatcctcaaatcattttcttgcctcttggtttcctttgcttaataaaaaatgttttgattagttttaattttctgggtgcattgattgttagctcttttgtattctgatattgttggcatcaggactcatcaatttcataaaattattgagtaattatattgactaattattgagtaattagagtgaaatgtctctaagaaaaaaaattcaatttggagggatttctcatctaaatgtaaatgtttatatttacgtattttctttagttagttttttttttttcacctggttgatttctttgttatattttggttctaatttcaaaagcatttatagacacgaaaacttatgtggctcaaggacccagtactgagagagttctaggatggctgtgctttggctaatgtttgttgaaaccagataggaaagattaattagagacctaagtgacagaaaaaacaaggaaatttaaacttaggtttgtttcattttaacaaactgacaaagtaaagaatgaaaatttactaaattgtagccttaaatttacagaatatttagactagaataactgtgtgtttgat

SEQ ID NO: 117110 - DNA, 504 bp, Homo sapiens
gggcccagcttctgcttctgaaacatttcctgctccaggtctcctgtcctgatctcctaaaaattccctagtttctctagatacagggttttttaaaaaacctttacgcaaaagttacctgctccctaagcctctctgcaggacctaacatactacctggaggtaaacattagcactataagaacttaaggagaatgcagtttttctatctccaagccccagcccttcaagctatctcctaatatgcctctcactttctttttttttttcctttgtgaagaatgtgggcatcattctttcttcttttcttcaacatataccagttcctccagttcctgcttcttgaaaccagttcctccagttcctgcttcttgaaaccagttcctccagttcctgcttcttgaaaccagttcctccagttcctgcttcttgaaaccagttcctccaagtctttataaaatctgtttatggttttcccataatacaatagcatctggctcttat

SEQ ID NO: 117111 - DNA, 271 bp, Homo sapiens
tatctcgtgccttgttggattagaactgattgagctctgtctgctgccccaaacatgtggctcagccaatctccagtggcatctgcaatgtgggtattctagcctccagtgctcacgtggctcaccttagaaagggcagatattcctatttcctgacgctgctggagaatgaggtctgagtcagaagtcctcaggtgtgacctgcccagaactatctgaaattgctggatttcttgttcttcctcagtgtttaacaatcacccaattgctc

SEQ ID NO: 117112 - DNA, 555 bp, Homo sapiens
tgtatagctgctcctgagggaaaatgacgctactgatcctacagaatgttccagcggaaccgcctcaaaaccacacttagagtaatgtaggtatagagtgtaaatgttctgcttgaagtggatggctctagtgcagtggattgtaaactctgggagaggatcggagacgcttttggaaagctgggtaaactatgggccatattctcagaaaagtgtccactaaactcacagaaagactcattctcatatacacacaattttgcattctcttatcagagggctcctggccccaggttaataacaactgctctcttcttgtgaccctcggactaaatgtaatcaggcagtctggcaaaaatgtaaagcctgttctcagctgattccttatttctggagagacagcgagtgtggagcacaaggactctggtggtctagagaccggaaagaagagagagcagatgacccctcccaaaataaaagccatcagagagagaagcctcagaacagaagagggccattggagatggcccgacgtaggctgggtgaaccttgctt

SEQ ID NO: 117113 - DNA, 337 bp, Homo sapiens
caatcagagcctcaaagcctaaaagcatgaagtcagacttaagggaaccgacactgcaccacggcagctgggcagcctcagagccctctatgtgcatccctcacgctccctgtcacctaccctgctcacggtctctctatcctggcccaacactggttctaggtggtttctccttcctcctctcccaccaatctttctggcccagctggctctcacctgacttctgctttgtgctgttcccctgaccacagtcacctgatccaccccaccccagcccagccttgggtgctggccaagatgacacagccagggaccttcctcctcagagcagaaggga

SEQ ID NO: 117114 - DNA, 244 bp, Homo sapiens
ctcttcccaacttccagttatgactgttacaagtctgccacgggccaggccctgtcctatgcactttgggtctccctgctcccctcctggccctgaagatcatttccctcatgcagccagagggtccctgtgtacacccatgacgcatcatattccgcacccctgggcacaccagcatccttgaaattactccccaggacaggcctgtctcagggcctttgcactggctgttccctctgcctgg

SEQ ID NO: 117115 - DNA, 525 bp, Homo sapiens
acagtccgccccccttgtccctgccctcctcccggggaggagtcgccgctccagcgggaggcaggatggttgctacctggggcggccgccagctcctcccgcagggctccgggccgcccctcaccccagggtcgcccgctcctagtgtggcccaggcttcccggcctgcccctcccagccctaggaagacgtcccccgggccccctcagccctccgcctccccttctctccctttctccccgctcctggcaggctgcagccgtctcctcccggtgctcgctccttccttgagctctgtccaccgctgcccactgggggctagagcttcccggctaccctggaagctggaggctgggaccagctcttcaggtgacaggcctctgtgtctccacagtggccagaggggagcctgcctgactgatgagcaaggctccactttgtcaccaaggcagagaaggggcccggggtcttctctggcccagcctttgactgaagctggtctggagacaggggcgttagagaagt

SEQ ID NO: 117116 - DNA, 338 bp, Homo sapiens
agagccaggaaagggtctgggtctgggtcagggccaggaacaaggcagagcagggccagggccatggcagagtcagggcaggtccttgacaggaccaggttccaggccagggccagggcagcagcaggggcagggcctggataagggcagggccagggatatggcaggaccagggctagggccagggccaggccatagtgagggcagggcaaaagccaaggcagggtcagggcaggtccagggcaggtccagggagcggccagcaccaagcggggccaaggcacaaccagcgcaaggtaaagcagggcaatggcaccactgggccatgacagggcaaa

SEQ ID NO: 117117 - DNA, 587 bp, Homo sapiens
aggctatgaacacctttatgagcattaactagaaaacctacaggagatggataagttcctggaaatataccaccctcctagattaaaccagaaagaaatgaaaactcacaacaaaccaataacaagcagtgagactgaaatggtaattaaaaaattgccaacaaaaaaaagtccaggactagacagattcacagctgaattctatcagacattcaaagaagaattggtaccaatcctattgacactaatccacaagatagaaaaagagagaatcctccctaaatcattctatgaagccagtatcaccctattaccaaaaccaggaaagggcctaacagaaaaagaaaagtacataccaatatccccaatgaacacagatacaaaaatctcaaaaaaaaaaaaaaaagaaaaatactagctaactgaattccaacagcatatcaaaaagataatccagcgtgatcaagtgggcttcacagaagggatgcttggatagtttaacatccaaaagacaataaatgtgatacaccacatgaacagaattaaaaacaaaaatcacaggatcatttcaatagatgcagaaaaaa

SEQ ID NO: 117118 - DNA, 499 bp, Homo sapiens
gttcccagaaacagcctccagataactttgcttacatctcattggctagaacatcaccccgtggctgcaggtggctggaaaatctcatctttattctgggtggccatgtgcagctaaaagtactgctactgtttatagagtttgggcaagaaccggctgtctgtgccatgggtggtagacgagaccagcagtccccactcacttggaactgagagtctgggggaaggatagtgacaaaataaacagatacttacagtgacaaggcctctgagaggtctgcaaaggtgtgccctgcgagtaaacaggaaggacacctaaatcagactggtggggtgggggaggggatgaggaaacgttgcctagagactaagcaagaatctctctggactgaggaaatgggcagggtattgaagcaaaggctcggaggcaaagggggcaggtagttgggtgatggaggagcatatgaggaacagaaagtagaccagggaagccagaggga

SEQ ID NO: 117119 - DNA, 237 bp, Homo sapiens
catgacctttaacactttgggtacaacttcttatttatggttctcagcagctagtatttatagctgtagaattatcttcccctgatcaccctgagctgcaggggtaataattttattatccaaagtcatgtcatgactgtagttcagttggatgctgtggtactaccaaggtgaagctattgataaaatatatgctgttgacaagagcattcgtagcatctctgccgtgcatggcac

SEQ ID NO: 117120 - DNA, 208 bp, Homo sapiens
tgctgcggtgactctaaggatcccccttcggggcttggcatgaaggttgaaggttgagtgtacttcacggggtaaattaccagggagatgatctggaacacagcagccaaggcaaggagacctccaatcactcttaggaagacaagtatctggggtacacacaggacgaagaaggagaggatgaaacagatcaccaggatgctgacgc

SEQ ID NO: 117121 - DNA, 399 bp, Homo sapiens
gttagtgataatatttactgtcatggtggtggtgatggtgccaccaataaaacttgtcagctgagggcccttgctctggaccacttaaagagggctgatttttcacaagacgaaataacttagaaacatagaggataaagtggtccatagggttagtaaggtggaggagggtgactaagtcatgaaagatgtacagcacagacagaagagtttttaaaatgattccaaatagtgtgtgagagcagactactgaagttgaggatggatgtttgcaccctgcagagaatgctgcactctagagtttcacagtgcaagatgacctgactttcatagtgggcaggaaggtctgggaggccttgctttggactcaggaagaagtaagcaagctgagtagccgga

SEQ ID NO: 117122 - DNA, 396 bp, Homo sapiens
tactgttaggatcttaatgtacttagtggaaaggttgagaggcgctggcctacggcaggcactcctacagtaagactgaacctaaactgacattggtcagtttacttgggaagttgaccatatgttttttgtttgttttctcccaggctatagtacagtggcgtgatcttggctccctgcaacctctgtcttccaggttcaagcagttctactgcctcagcctcctgagtagctgggattacaggtgtgtgctaccacacccagttagtttttgtatttttagtagagatggggtttcaccatgttgcccagggtggtctccaactcctgacctcaaatgatccgcccaccttggcctcccaaagtgctgggattacaggcgtgagccatggtgcc

SEQ ID NO: 117123 - DNA, 349 bp, Homo sapiens
ttccaatcatcatttctcaaaacacacactttcatctctatttaccaaacactattttctgcatctccaaacccctcaagcttcagtccaggtccaagtatcaatgggtatatatgaagctcctctgccaccagaaattcactatggaaagatgttatttctggtaccccagttgcaaaacaatgatgcctgtttttttctttttgagacagagtctcattctgtcacccaggctggagagcgatggcgtgatctcggctcacttcaacacccacttcacaggttcaagcaattctcctgtctctgccccccgagtagttggtattacaggcatgtgccacgacgcctg

SEQ ID NO: 117124 - DNA, 139 bp, Homo sapiens
aagggtggccaggccatgcaggagggtgacagtttggttacccagcaaggcattttgaccctgaagatattttgtactaaaagttaattctcctttattgaataatggtcttcagaaaaagtaaaacttagagcagaat

SEQ ID NO: 117125 - DNA, 334 bp, Homo sapiens
ctgaaaaataactgcttacaattcattgcattgaaaaaaaaaatccaggttttattttcttactgacacctcccgttaaccttgagacctttaactcacaacattaatccaaaaagagattatattatttcaatcgatacctaaattattagattgggtttccatgatctttggagatccttctggattattgtaattgataggtagggctggggggacaagtttttttcactgagattgctacacattattttggcatttatgagattattcattttagaaagtatatataaccagcctcctctgaaatgcagaccagtttagctagggcggg

SEQ ID NO: 117126 - DNA, 327 bp, Homo sapiens
gaagttcttccccgtccccgcaacccttgttaaatgtttggaggaggttaaaccctctcactctcaaacttaccactaaatctatagatacaaattgaaatactgttagaccaaagtcttatatacaaaagttacttttactctagcccggctaagagagaggagtcattgaacccgagaacgtccggactccacgcgccgccccgggtggagaggggttggcaggcggaatccaaacggcacagacactgctggcgcgcctggtagccttctgtaacgcacgcatctgaaatttagatctgaaaataattacgaagagagccaaga

SEQ ID NO: 117127 - DNA, 384 bp, Homo sapiens
ctgcagaaagatgcaattgcgtgacagatagtttggaagagaagagtatggagaaggcaagccctctgaggaggaagctggaccagagctgtggctggggaagtggggaacgggcgtactgaggagagctgctgaaggagaaccgatagagcctggtgataggaaaccaaggggaaagaagaacttgatataacagcacagttctcacttcgccttcctgctgagatgtggaaggatcccggtgctgccagcagcactcagtgcgctggaaagggtcatggctaggaagacagctgaggagaggacccacaagcacaaccgcctcataacagaatcaactctgctattgctagagaactcttctccctctgaacctaccatcaa

SEQ ID NO: 117128 - DNA, 739 bp, Homo sapiens
agcggaatctggtttgggagggtgaagaccgctgaaatttccaggctgcccgaggctccaccttccaccacccaacgggtgggcggtgggccgggctggcctcggagcctctccctgggtgtcggttgggccgagaaggggacggttggctgggtgggcctggcggctggtggctgtccgtaggccggggtcactctgagggcattttacattaccctaatcctgtccacttggcaagaaacttagtaagccccaaaggttcattccaaatcctgtctgggagggcgaggactgtggaaacttccagatgcctcaggctccatctttagctgttgagcgggtggttgggccgctcatggccccaaagatctggggggtcttcatgggcagttgggtcgctgagggccctaaagatctggggctcctcccaggtgtcagttgggccaaggaggaggctgggctttcagagtagaacctgcggtgctaacgatggctctgcagggctgcgggctgagggcctgggcggcgtcctgtggcccggagatggcgctctagtggtatcaggccttgagtcagcgacatcctggcttctgaccccccattcctatggcccctacagtctggtctccgcttccccactcccggtgaattgctgttggagcagcctctcctttctgggtagtggcctggccgagctccccggggagggcttgacccagacctgtcctgcctccagtcc

SEQ ID NO: 117129 - DNA, 150 bp, Homo sapiens
agggtagggaagatcgcaggcatgaggtctgaggctcgctggcagcctccccctgctgggccctcctcatggttggaaccaaagatacctgaagcgggctctccgactcagggtgctcaggccccccaggccaggctcctccagcctcgg

SEQ ID NO: 117130 - DNA, 312 bp, Homo sapiens
tgctggaattacaggcgtgagccaccgtgcctggcctgatagtgatttatcttctattccgtaacaactaataaataccataaaattaactgtactcagaactagagccttgtttctttcctttgatccacaaatggaacccctaatatgtgaatcacattttattacaaattctgggggaataagtaaaagaaaaagaatattcaggttataagatcttgtgctcttagagcttatgatttcttttgagagaaaagatttgtatgatgatgtagatatgataggtgagcacatgccaaatgaccagtatgc

SEQ ID NO: 117131 - DNA, 306 bp, Homo sapiens
aaggccccactctgtcatcgtagagatcaggaaacaggctcagaagtaggagggcttcctggtcctagggcccagctcttccctcttttcaggcctgtcttctgcactaaggacttcaggccaccagggaaggtggggagggaggaaaggagatgagatagacttgggcgggggcctgaggacagagtttcatgtcacttgggcagccaggaaagggttaaagatcccttatcccaagccatgggcactggcactgccagaggatgctgaggcctgctggggcataaggacaacaagcaacatcct

SEQ ID NO: 117132 - DNA, 131 bp, Homo sapiens
gcctcagcctcccaaagtggcaggtatgggccaccatgcccggtcctttttactttcttatttttttcttgagacaaagtatcactctgtcgcccaggctggaatgcagtggcgcaatctcagctcactgc

SEQ ID NO: 117133 - DNA, 496 bp, Homo sapiens
gttgcccataaattcaagttcctagccatttcctctttctgaacaattaattttccttaatctttattgcaactaaaattgaaacaatatctttacatacacacctgacatttaaggaactaagaaactcaagttcctacctcaatcatagaatttactatgttacgtggaagtcaagtttatgtgctaatctccactactagcctgtgagtttcttacaggcaaggaccctgcctctttgttcatttttttatatgttgtagccctttacacagtactttaggaagtttaggttattgtgtgtgtgtgagtgtgtgtgtgtgtgagtgtgtgtgtattgggagtggggatttgtgcaggaaatgaggaaagaaggaaagtgctgtgaatggaggaaggggcacaagcaaagcccagagactcacggccaatgatatctaagccctaacatcctccctctctttttagaaattgtgaccagggtagttggccctaa

SEQ ID NO: 117134 - DNA, 1452 bp, Homo sapiens
ggtggaaggagaggggcgggacttctccgggtcaaggccaggtctcttccctgctcggtgctatgttcctgttccacggggtggcgggtcctgggagggagaagcccagacccagtggacactgacattgtctctcgctgttcccagccttttccaggcgtgtgacttaatccgtttccacagccagaccttttctccgtgagttcctcagccaggactgctgccatgccggtgactgttacccacccaaccgtcacgaccaccatgcggtcccccaccgtcgtagggtcctctagggccctgatccagcccctgggcctcctccgcctgctgcagctggtgtccacctgcgtggccttgtcactggtggccagcgtgggcgcctggaaggggcctatgggtaactggtccatgttcacctagtgtttctgctttgccatgaccctggtcatcctcctcgtggagctgggcggctcccaggcccgcttccccttgttttggcgcaacttccccatcacctttgcctgctatgcggccctcttgtgcctctcggcctccatcatctaccccaccacctacttgcagttcctgtcccacggccgttcccgcgaccacgccatcgccgccatcgtcttctctggcatcgcctgtgtggcttacgccaccgaagtaacctggacccgggcccggcccggcgagatcactgactacatggcctccgagctggggctgctgaaggtgctggagaccttcgtggcctgcctcatcttcgtgttcatcaatagcccctacgtgtaccacaaccggccggccctggagtggtgggtggcggtgtacgccctctgcttcgtcctggcggccctcactatcctgctgagcctggggcactgcaccaacatgctgcccatccgcttccccagtttcctgttggggctggccttgctgtccgtcctcctctatgccactgcccttgtcctctggcccctctaccagttcaacgagaagtatggtgtccagccctggcagacgagagatgtgagctgcagcgacagaaacccctaccttcaacctcaataggcttgtatcctgggagacagaatgtgtttctggtcactcattctaacccaagaaatcaaggaaaataacagacttccacagaagctagactgaccaggcgatactgtgaccgggcaagcatggcttttgacagtaaatcccggagaggaacagagagatgcagatacttgatcattctttgcctataaacacaatggttacatacccccagatctgaccttgctgtagatccatctgaaaggaaggaatcaagcctctgtgttcctgaagtcaggtccttttcactcccaaaaacacaggttcatttgcggtgggtctgaggctaggtgctctgggttatctagtgcttcctgaagccctagttttgaaagaaga

SEQ ID NO: 117135 - DNA, 726 bp, Homo sapiens
agacattatagagccaaggaacttccaacagtcttccatgaatgaggcaatctgaatgaagaggccttttataacttcattttgaactctgcccacaaatcaaaggtcagcaggcccttcaattcaaagaggctgcaaaatgcctggaggtgctgctgtgccagttgttgctcctgtgtggtaggcagagggaaaaaagaaacaaggaagaggaggcaaaaggcaaaaagagggaactggaaaaagaaaagagggagagaaggaaaggagaagaaaaaggaagcactaataactattgtttgttgagcaccaccagccaccatgctaagtactttgcaaacttgatctcagtcctcacagcagccgtatgaggtagtactggcagtacttttgttttactgattaggatattgaagctaaaagaagataatttgtcaaaagtcatacagctaataagtagcaaagctgaactttgaacccaggtctgtctgccttcaaaatctagcactcctcactacaatgccacagaggaaacatgttcacctattaggatctgagagatacctaccactgacgatgactgagtgggctcttctgtggctggcccctggattttttttaagtttgtagacaagtctttaacaggataaagatcccttaattggatttgcctgttatccagtattgcacaccacatcacatgctgtgcttcagttccctacatga

SEQ ID NO: 117136 - DNA, 335 bp, Homo sapiens
tctcgctctgttgcccaggctggagtgcagtggtgcaatctcagctcactgcaagctccgcctcccgggttcactccattctcctgcctcagcctcctgagtagctgggactacaggcgcccgtcaccacgcccggctaatttttttgtatttttagtagagacaggatttcaccgtgttagccaggatggtctcaatctcctgacctcgtgatccgcccacctcggcctcccaaagtgctgggattacaggcgtcagccaccgcgcccggccctctttatgactatttttaaactatgatgaaaattagaatatataaataatcctttaatatc

SEQ ID NO: 117137 - DNA, 243 bp, Homo sapiens
ggtactgaccaccgcacaacaggagactctgtgtctttttctctaaccactgattttcccaccccaacccagaaggagcccccgtcggagggcaacaagtaaatgaagtgggaatacagacaagcctcctccatctcccctctgcaggctagaatgaggggaggtacaagagcttggagtggtggtatagcctggtggtatagcctggtgtatagtagtggtatagggtggatagggtggtat

SEQ ID NO: 117138 - DNA, 813 bp, Homo sapiens
cagattatgggagggagcgtctgtgacatgaagccctggcttaaatcttcccaaggttttaacgtgccttaccatatgaatattttgttattttatttggcagtatttccacaggaggccaggaaggagagcactgagtaagccaggggtagggcaaatctagagatgggagagattagaacagtattgtggctaatgagactaacaccactgaggtgtgtgtgtgtgtgtgtgtgtgtgtgtgtgtgagagagagagagagagagaaagtgctgaatcccctgtaatcctgtctcatacaaggccctggtgctaaaaccactgtaactgtttatgaattcactccagctacatagtgagaggaaggaaagagaataagaagaacccaatgctggaatgaatttatgcttaagagcttgtctcgggaatgcagctgggtttaagagtcgccaagccaagacaccctttttgggaaaagggaaaagaaaaggaaaggaagataaaaacccaggagactggagggacagtgggaggaagaggaaagaaaacgtgctgctcccagatggggaagccttgtctgagtgaaatggcattataggttgtctgggtgttagccccttaaagtggtttaatttcccactaaatagagatcactgtgaggactaagaaccaagcaaatgctttcgattgcgctatcttgattagaagccctgcattaaggcaagagcattggcagagcccgagagagctgaggcaccctgaggcatgcagcaaggtccatggcaggctagacttcaagtggctttgccggag

SEQ ID NO: 117139 - DNA, 645 bp, Homo sapiens
catggtggcttacccctgtaatcccagcactttgggaggccgagctgggtggatcacaaggtaaagagatcaagaccattctggccaacatggtgaaaccctctctcttctaaaaatacaaaaattagcttggcgtggtggcacacgcctgtagttccagctactcaggaggctgaggcaggagaatcgcttgaaccaaggaggcggaggttcgagcgattctcccgcatcagcctcccgagcagctgggaccacaagtgcttgccatgatgcccagccaatttttgtatttttagctttagatgaattttagaagagataatgcctaattaatactatgggtatatttgtctcaaatgaccttcaaatttacagagaaatgtcttcatctatttgcagccttaaatttaaaaactgatcttatgttgtagatatttttgaattctctacatctgtaactctcagctagatataaaaaagtcagtttccagcaagacagtgttccaacatcagtatttgttggatttatttctcttattttttctgctgtgggaaacacaatgcaaatatttgtgccctaaggcagactgtatcatggaagcagctattaaaattgttcaggccgggcatggtggcttatccctg

SEQ ID NO: 117140 - DNA, 428 bp, Homo sapiens
tgatgcagacagccttcgggggtggggattagtctctcaatcagagttcaaactctcagagcagcacccctacataaatcctatccaccattttagtggggtgggagtaggggacatggagagtaggggtgaagaatctaaaataaagaaatacagtgtaaaaaacaaaaagtacaaaaaggtaagaaatataaaagagaaaggagaaaaaatatgacaaaaaatgttcaatatactttcaaaacaatatactggtgattaaaaagaagagaaacctaatgcacttcaaataagtacaacaaacaaaaagaaacttcctagaaaatggttattagatctttggcctagaatcttatgacaaattagaaaagacataaaactaaggtaaaattactttttccataggcaaaaatttaattatcctgctt

SEQ ID NO: 117141 - DNA, 171 bp, Homo sapiens
ttatactccaccctctctcctccattctgggttcagctgggtaggcttcttgtgatccttgcttctttcctgaaagcctcagggatggagctgcccacaccagctgcccgtcagtctgggctctctttcatcaggactaagttgtagatgctacaaaacaacaatttcaac

SEQ ID NO: 117142 - DNA, 496 bp, Homo sapiens
ttcagcttaatgaccttgagatggtaaaaactattgtgcatatcaatattcagtttgtttttatttttgagtaatatttcatggtatggatggttaaacagtctgtttaaccactgtttttttcccaaatatattagtttacaggttttggttattgaaaataaagctattatgaataattgtgtatagatatttgtgtggacatgtttccatttccatgaaataaatggccagctgtgccattgctaggtgatatggccgttgcaggtgtatctttaaaaaaaaactgccaatgtattttcagactgaatgcaccgttttactcctctaccaacaacgtttaagagatacagttttgggaggggggagggatagcattgggagatatacctaatgctagatgacgagttagtgggtgcagcgcaccagcatggcacatgtatacatatgtaattaacctgcatattgtgcacatgtaccctaaaacttaaagtat

SEQ ID NO: 117143 - DNA, 586 bp, Homo sapiens
atcccagcaaccatacttcaaccactcttacactactgagtgttcaaactgtgctcaactaagatggtgtcagaagtaggatctgaagaagagacttaacaatccccaggagtgctgagtgaacaagcaaggtacctgcaaggacctacttttgtcccttgatctctcaaagtggctggggatcatggatggatacatgtgaccaagcattgcaagttaaagatatttctgaatcttggacctcttatttacagtgaagccccctcatgcatagtaaagcagagaggaatgtaaaaggttgctgcatggataatcaatttctgatggagtctcactctgttgcccaagctggagtgcaacagcatgatcttggcttactgcaacctctgcctcccgggttcaagcgattctgctgcctcagcctcctgaatagctggaattacaggcacccaccaccatacccagctaattttttgtatttttagtagagacggggtttcaccgtgttagccaggatggtcttaatctgctgacctcttgatccacccaccttgccctcccaaagtgcttagattactggcatgag

SEQ ID NO: 117144 - DNA, 720 bp, Homo sapiens
agcggaactgctgttaccaactcccacgaaggaggatctgccttctctaacatgtcactcagcatgggtgcccccaggcacaaatcacgtagtgccagcaggttggtggtggctagaagtggtgttccagcatcagccctcctctcctgcccaccagtcctggcacagcacccaggtcaacagtaaaaatcctacagatggtgtcagaagtaggatctgaagaagagacttaacaatccccaggagtgctgagtgaacaagcaaggtacctgcaaggacctacttttgtcccttgatctctcaaagtggctggggatcatggatggatacatgtgaccaagcattgcaagttaaagatatttctgaatcttggacctcttatttacagtgaagccccctcatgcatagtaaagcagagaggaatgtaaaaggttgctgcatggataatcaatttctgatggagtctcactctgttgcccaagctggagtgcaacagcatgatcttggcttactgcaacctctgcctcccgggttcaagcgattctgctgcctcagcctcctgaatagctggaattacaggcacccaccaccatacccagctaattttttgtatttttagtagagacggggtttcaccgtgttagccaggatggtcttaatctgctgacctcttgatccacccaccttgccctcccaaagtgcttagattactggcatgag

SEQ ID NO: 117145 - DNA, 184 bp, Homo sapiens
ctcacagcttctgctccttagctgtccttcgggcccggctccttcacagatggtctgctggccagggtgctatggagttggaatgtccagagcctcccctcgctgatgcattcactgctttggaacctgctggctttcctctggagtactgaaatagctttacctgtgttgtcggttcaggcct

SEQ ID NO: 117146 - DNA, 378 bp, Homo sapiens
agagggagacggggggcagggagggctctctccgggggcagggagagctttctctaggagcacagcacaggcttctgtgcttagccttgggctgttctgcatttccatcagttacttaactgatgatctaaaagtcatgcttatcaggtcagaatagattcgagtctgggagagatggacattttgccaggtgccagactctggcacactctggaattcacaagattccaatggcctggaagcacagacgaaccaacaaggtgaaatatcacaggcctagatggagaggccaaggtttcatgcaaaacctctgcctggggctgcctaagggctggaggggcagcctgcctgagagcagctgaaaggaagtgagtctcg

SEQ ID NO: 117147 - DNA, 812 bp, Homo sapiens
tatgaaaagaaaaccaagttccatatgcttctccctaccccaatatatttcataacttctccaggcatcattgaactctatcttctctaaatcactctacagttcaataatggctaacatttttttttaatctatgtcaggggttgttctaaaagttttacatattttaaatattttgatcctcacgaaagctataaagtaattactctatatgatttccttttacaagaaagaaaactgaaatatagaggagttaagtaacttgctcacaattacatgactagtattattagcaatcaagtattctgctcaatagggaaatatcacatatacatcacattggtatgccacttttcaaaaaataaactaaaattttaataagataactttttgcctttgatttttataattacaattaagagtgacactaataattataatgattgatataatgctaattttataagcatgagcaaatacaagatactttaattttaagtcctcgaagagaataatgactaatatttattaggtgctgctgtgacaatgttctaagtgctttattatgtatattgacttatgtaatcttaaaaacaacagcaaactcaagaaagattgtaatattattctcaatttatggaggaggctgggtgcggtggcccatgcctgtaatcccaacactttgggaggctgaggtgggtgtatcactcgagattaggagttcgagaccggcctggccaacgtggtgaaaacttgtctctactaaaaatacgaaaattagccaggcgtggttccaggcgcctctaatccca

SEQ ID NO: 117148 - DNA, 374 bp, Homo sapiens
acattattacccacagaaattgaaaggattataagggatttgccatgatcaactttatctcaccaaattagacaacttagatgaaatggacaaattcctagatacagatgatcaaaactgactctagaggaaatagaaaatgagaccttataacagttaaaatgaattagtaattaaaaatcttcctacaaagagaagcctaggcccaggtgtctccattggtgaattctgtcaaacacttaaaagaagcatgctgggtgcagtggcttacttggtgatgaacacctttagtcccagctacttgggaggctcaggtggcatgaggccaggagttgaaggctagcctgagcaacatagcaagactaccatcttaa

SEQ ID NO: 117149 - DNA, 484 bp, Homo sapiens
accgaatatgacatgatttgaccaccaattaattaaaggtggtgattaattatagaacattaaaaataggaatccatggtccatttttatgataaatctagatagatgatagatagatagatagatagatagatagatagatagatagatagatagatagatagatgatagagatagatagatgatagatagatagatagatagatagatagatagatagatagatagatagatagatagatagacagaaagacagacaaagaaaagaaggctgtcttgctgagtcctgactggtaaatatagaagttctgaagttggaaaaaaaaatcatcatttcgtaaccatcatagtataaaactggttcagacaaaagaatcatccatggatgttaactctatggggaaattttgataaggagaatgatatgtatttgcatgaccttaaaatgtctctctacattttgctaattggtaagagaaagaga

SEQ ID NO: 117150 - DNA, 720 bp, Homo sapiens
gactttgaagagcaagcggcgttgttcgcctgcggaagcagtgctgccggtctctggacaaatttctcccggaggtggagacaaggaagctccagcttcgctttcccttgtggcccagagtggaacatactgagctgcactgaatcatctggatgcactcgcaactttaggaactggtggcaatttgtaaaaagacagctctggaagttgaagagaccagtggcttcaagcaaaaagtaaattgaaaatgggagatatctttttgtgtaagaaagtggaatcaccaaagaagaatttgagagaatccaaacaaagggaggaggatgatgaagatccagatctgatctatgttggggtggagcatgtacatagagatgctgaagttctctttgtcgggatgatttcaaattcaaaaccagtcgtttcaaacattttgaacagagtcaccccaggctcaaagtcaagaagaaagaaaggccacttccgtcaatatcctgctcacgtgtcgcagcctgcaaatcatgtgacctctatggcaaaagccatcatgcccgtttctctgtctgaggggcgatcgacagatagtcctgtcactatgaagtcttcatctgaacctggttataaaatgagctcaccacaagttgtttctcccaattactcagattcgctccccccagggactcagtgtctagttggagctatggtctctggaggaggcag

SEQ ID NO: 117151 - DNA, 595 bp, Homo sapiens
ggcctgatatttaaggagtcggctatctgttagccaaaggcttcctctagagtacagtagtcctgccacattatgtagggtgtaaacagttaaatcattccccagggttaatttggaggcttctgggaccagcagagccaccgaggcaatggcttggaggcatgctggccactctttagccaccaaatcaagttccttacttagataacccactggttgagctggtcctccagcctgtgttaaaactcccagggctattcccttcctttctgatacatacagattgaagaccttccctacaggaaggctgagagctggtgccttgagcaagacttgctttagctggttaaaggccttttgagcttcaggttcccaggttaaaagatgagttttagctccctgagtttcttttatgaagttatataacagacgggctatttcaccatacccagatatccatagcctacagaatcatgtaataccccaaaatcctcttagttgcttgagagttttggggagggagaagtaggagataggcttaatcctctcttcccccaactccagtgctctggtcccctttgacagcttacattgt

SEQ ID NO: 117152 - DNA, 428 bp, Homo sapiens
gctaggtaactgaacacatgctacttcatctatctgagcctgggcatccctgtccaaaaataggaatgctaatggcagctacctattcgaatcaaataagttaatacatggacacattctaagttaagaatggcaagagtggcaggcacatcgtggatgttcagtagacattaactatggttattgatagtccagagtaaaagaaaatttgggtgaagctgcaaacctgggatcttagcaatctcagtgtcagcaaaactttgagtcaggatcaagattcaagacagagtccagacttctcagattcttcaaggcatcaccaagttcccactgttagttcctgatcagagcccagggaaggttaaaagccccccaacacaaggagcctctgaagaactggactataaatgtcacaagcgacatcaaag

SEQ ID NO: 117153 - DNA, 199 bp, Homo sapiens
taaagatgaaaaaaggtagtatccagtagttaaaactaccatattcttaagatgatatttagtgttggtgaaactgtaggggaatgtaaaacagaatatagcctttccagcaagtatcagattttcaaaatgtgcacagatcattcactgtcatcctcttattcctagaatacaaatcagactaatgaacatggcttac

SEQ ID NO: 117154 - DNA, 281 bp, Homo sapiens
ggataatgccacccttgacaatcatttgtttgagttaaaccttgtccttttgagggcatgcttttaaaaatattaattcctagcgggagaggtaatgcatgaagtttatatcgtatcagctccagagcgtggattagctcatcactttcccaccaggcctgaggccctgaacaggaagctgcagttggggagggagtggggtgattcagagcttggaatcctggaggaccgggtgctgagaggtgcacaggagggagaaagaaggttgaaaggatttgaaa

SEQ ID NO: 117155 - DNA, 658 bp, Homo sapiens
gtgagaacacgcaatgtgtgtctttctgtgcctggtttgtttcacttaacataatgacctcccattccatccataccattttctgcttttgtacaaggcatcaaggcataaaaagcagggcaatgggactcaatggattttccacgctgctctaacacactactgcaaacctggcagcttcaaacaacacagatgtattctctcatagttctggaggtcacaaatccaaaacgagtcttcctggactaaaactgaggtgttgccaggacccttggtaaaagccctagaggagaatccattccttgcctcttcggtggctgctggcattgtgaattgtgggcacatcactccaatctctgcctccacggtcgcatcaccttctcttctgtagtcgaatctcctctgcctccctcttcatctataaggacactttgtgattacattgcgtatccacacagataacccacgatagtctccccgtcgcaaatctttgaagtaatctcatccacagagtctcttctgccaacatcccattcactagttctggaggttaggacgtggacatctttgggggttatcattccccctttcacaggctatctgggctgtatacagaaccagagatctgagaatcatcttggcggcctcactctgtgag

SEQ ID NO: 117156 - DNA, 470 bp, Homo sapiens
tcttcgcttgctgcttctctttcctagctctggtttcagcttacatttttgttgttgtttacttctaacaagtccagcaatgcattaaacctatattttatgtagagaagccaggagaacagagaaaaaagtgtattttatagatttagcaaggatgggacaaattttctgaagaatgtaaacatcccagactttgagaaattttactttaagaactctactgaggaagtaattagaaatgccctcaaacatttatgctctgaggtattcactcaaatggtgtttcatataatggaataaaaaactaagcctttgagctagacctttctcactcatctgcctatcttaatcccaatttcatgcatctgtagcattaaaataaaatgaaaccaaactacatgaatccataccaaaagcactgtaaggtaaagcagatcattactgaaaatgtctggggaagagagaggact

SEQ ID NO: 117157 - DNA, 270 bp, Homo sapiens
cagccaagtttcagctctgccttttaatggatgtgtaatcttgaacaggtcacttcccgtatctaagcctcagttctctcatctataaaatggggacagctatgataccttctctatagggtgaggagtgatgaaacgcaacgatgttcataggaagccattagttcagggctttgtggttctggaaatgtgtctgttttgtttgtcctgcagatcccatggtagacataaaccagtcctctgggtctgtgtccccagtcctctcttaaa

SEQ ID NO: 117158 - DNA, 766 bp, Homo sapiens
gcagagtcaagagaaatctgcacatattccagatctctctttccccctcacccttcttactggttataggcaatgtgtttaatatgttcttttccctcttctgccctccaccagagggtgctcataagcaactaaatggcataaagctgtagtgataggaactgtgaaagaagggctattttaattcacagtgtggattattggcctctgtgaaaaaaaaaaaaagttgactttgaaacagagttcttgattgagctgaaataactttggtttaaagttgccttacaaataacatcttgagcacttacttacctgaggatagtacttttttatataggtaaagttgaccattctctctaaaaaggtatgagggactatgccattagacagtgttaggctggtctgggttgtatttcttattgtgtaacttaatgctcttcagaagtattttaatgacgtaaaatacttcagaacctcttctagtgtactcactaaaatcaataagtaatgaagtacaagaatattgatgtctgtgtttagttataaaagcatatccatttagaaattgtgctaattctgttacagtgagcagctctttatctcgctatgacataatctggttttaggggatgaaatgccctagaagattaaaaaaacaaacaaacaaaaaaaccttttatattgagcaacctctgtttgatagccaaaatctcaagataatgttgggacagtataaggaagcataaaagtgggtaattataatgtg

SEQ ID NO: 117159 - DNA, 652 bp, Homo sapiens
ccaccaggaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaagtaaggagggttaacaaggt

SEQ ID NO: 117160 - DNA, 156 bp, Homo sapiens
ctttcaagagattaaaggaacctcagtgatcatccatttcagcactttcactttatagtgaagaaactcaggcccagagaggtacagtggcctgcccagaatcagaaaggaaaccagtgcataatagctgagagcagcatacaggaatcccctctc

SEQ ID NO: 117161 - DNA, 648 bp, Homo sapiens
ggacgggatcagggtcctgtgaacggggtatcagtgtaaactcctctgagagatatcaggaaaagcaggaagaagcctctgggacccttcgggagggttttgctctgtcacccaggctggagtgcggtggcatgatcttggctcactgcagcctcgatctcttgggctcggttggtcctcccacctcagcctcctgagtagctgggactacagtctcacaggtccttccccaggtccaagaggctcttctgtgtcctgatgacaagtagctgcctagccgtggtggcacctcctatcacatgttaagggacccctccccagggccacacctggcagaaggtggcttatgatgttcgcagcttgaaagtagtgtaaaccaaagataaaaattctaagcccactcccccagccattcggaatggaccccctcctcttggccagggccactccaaaagttaacctgagaaaaccggttcaggctgtgacgaagaaaggtggaagtggacattgccctcaattttatggtccttcagtccgcgtgtttggcacatttcaagcgaaaggcttgaccgaggcgagttgaaccagtttaaaccaccaaggaccctttaaagttcctgaattacaggtgggcaattttaaccaaag

SEQ ID NO: 117162 - DNA, 614 bp, Homo sapiens
ctgccttctacttctattctagccacttaacacactaactgagataacaaaaataggaaacatcccagtccgtcactctgtagtcaaagaaaaacttgtcatagttaagagactaggaaaaagctgttgtaatagttaagccacacacctattcacaatgcctattctccaaatgctaggcagttaggcagcatgatgatatttactacaaactaggtaatgtcattcataggacttattcttagataaaataacatgttaaatataaaactaaaactctttgcccacccatccaataggagtactcactgtatgagagccatcaaagacgtatcataaacatttacagtgtaacacgctaagtgctataatgaaagcagagaggaagaagtgactaaatctgctttaaaaaagggaagtcaaggctggacacagtggctcacacctgtaatctcagtactttgggaggccaaggtgggcagatcacgagatcaggagatcgagaccaacctggctaacacggtgaaacctcgtctctactaaaaatacaaaaaaaattaggcggacttggtggcgggcgcctgtagtcccagctactcagaaggctgaggtgg

SEQ ID NO: 117163 - DNA, 708 bp, Homo sapiens
gagccaccgcacctggcctacattttattgataaacaaattatggctacagagtttaattgtggaacagcagttctacagtgcttgattggacattgttggtatatgaaattactgctccaaggtaccctctagcacaaataattccagagtggaaggaagtaagatggggtagcccccagagttgcttcatatctgattgatggtgtacagacctggccatgcggatccacattccatcttacatggcagaggtggatccccagcctggaactgtgaagaacagggacaggcagcatcccaaccatggggagcatttaactccagccatgggatctttgcactttgaaacaagcagtgtgggcagggcgatgcttgaccctctctatgaaaccttccactctcactccttcatcccctagaagtgtccctccaagaagcttagctggcttgggctctaaccggccctccttgacccctacctcccctggaagccttttctggttaaaaccactgggacgactatgcctggtccactcttctgtctggctgctcagtgagttctagttccccagtgttgtatgcccctgtagtccatgggcctcggccatttctgtaatgaacgtggaccaacctaggacatgggtagcagagtccttgctcccccctgcgcaggtatgtgagcagatattcttgagcttcataagag

SEQ ID NO: 117164 - DNA, 193 bp, Homo sapiens
attttcaactcaacttataaactcatgccctttgtctcaaaggcaaaggagtaaggaaatatttgtggtacaatgcaaaacgtattaacgctgaacagaaacaacaataacagcagcaaaagacacatatcactcctagaactgcttataccaagatacatatttctaccaaccagtcataccctcacttggc

SEQ ID NO: 117165 - DNA, 357 bp, Homo sapiens
ggtgcagcaaaccaccatggcacacgtctacctatgtaacaaaactgcatgtcctgcacatgtatcccggaatttaaaataaaataaaataaaattttagaaagaaagggaaccttaaagcaatcttagtttagatgacttggtaggctcacatatctgctacttctagcccatatatttgcttaatgtgccaaagaaagctctttgatgcactaaaacaaaagtctatttgtggatgacaactacctagatgacactatgatgaggaactcaatttggggggatccaaaacatatactcctactgtcttcaaacaataatcacttgattgccacaacatgcttgttgggtaaacca

SEQ ID NO: 117166 - DNA, 311 bp, Homo sapiens
ttacatgtaaccctaccagcagttttgtgggattgctatgatcatacccatttcacagattaggtaactgaggttttagtgccctggagatgaaggcattctctagtctcccagaagccctgaactcttgaacaaccccaaatgctaaactcagcagtaaaatggctggtggctcctacctgagggttcacagaggggctgcctgtgcttgcctcccagcccttccttcctgcatcccagccctttcttcctgtgtattaagagggttgcagctacttcagggccagtgtctccacgagtcatcatgacgg

SEQ ID NO: 117167 - DNA, 321 bp, Homo sapiens
cctgatgatagcaatctgcagtggcatcataagcacattaaattcagactgaaacattcagcgaagttaatattgacttcacaatgttctaagatgtaagtgaagctatgctctttttgccttataaaattagactgcaaaaaaacaatttttgaggatattcccagtcaattgacttggttacagagtgagcaggaaatcaaactctagttaagttcatagatactggtgttttattcatttggaaacagaagagaaaaagagtatgctgtagtaaattgtttataaattctttttaattctaaaggagggggagaaagt

SEQ ID NO: 117168 - DNA, 385 bp, Homo sapiens
aacactacccttacagactagaaggtcctagaggagaaaagcagaaacaacatttaaggttttaggtatgtttttgctccaccggggcataatgtagttttgtactgttaacagtatatattctgaaaaccaagtccaattgccttaccactcaaacccaacctcagttatttcccaaaatacaaagtcccatgtaaatggtgaagtatttaaaatagagtcctttttaaatagttacctgactgaaaacaaacctttctcataacttgagctaattaggagacctgcatgcttactggagaatcttaggcatgactacattttaacataatcccaggacaaactagtgtacagtggataatctcatacacacacacacggcctc

SEQ ID NO: 117169 - DNA, 554 bp, Homo sapiens
gtcaaagccaatgtgcacgtttattcttttgtaccaccaaataaaccgaatttttggaccaactttactttagtcaatatttggttatttgctttgaagctatttgtttgcaataatgcaattaacatcctcaacagagccaaagtctgaccctgaaatggcagcatcttaactaattttatcatttgaatagaaattgaaccctttgagggcatgaagtactatttcttttctctatacttcttgtttttggtttttgcttcaccaccgatttatgactaccaaaaccccacagatcctgtaattaactcacagctgccatcttgccaccgtagatagaattcaggagctggtgatgaatggggagagaatagaaaaactaatagactgtaagaattttagacctctgtggccttgcttcaccacgcccggccatgtgtagcttttaattgtggttcattaacccagtttctaagcaaattagaaccttctgtgtatctcccctagttctgtatgccccactggttcctgtagagctttatttctgaagggaa

SEQ ID NO: 117170 - DNA, 370 bp, Homo sapiens
aaatcagttttttatgtcgtttcccttaaactcacaatttccaaggacctatcgatgtcattaaatgaggacttactgtggtccaaggatcatgtttgctgagctcagtttgttccaggtcgcagggagaaacagaaaatagcagcagaccttaggttggaaccaggtcttcaacccattctgaaaggtgtgttttccatttgaagcttctatcaggtggtgaaagaaagaacgatggtactgtctgcctaatctctccctttcattttaatttcctttttttgccaaaagactgaattttaaaacataagattatgttttagaaacaaccagtaatacacctcacaaagacattcctattcgtggcagc

SEQ ID NO: 117171 - DNA, 502 bp, Homo sapiens
gctggcatggcgaggttggacaggctttgagacccggctctgggccctcctagctccaggacagcggttcccatcgcggctgccattgagatcacctgggaagttaacatcacctatccagggcctcagcccaggctgattcaaggctctgtgagaagtgccaggattttgaaaaactcccaggtgactttaacagccagggatgggaacccctgagctagggccactgtgggaacaggtggctttactcttgcagcctcagtttccctggctgtaaaactgttatgacaccagccttgcaggaagtgccaggtgtggggtgtggggctgccaagtgtggggagaaatgaccctcggggagccagctggccggggcctagggggtcctgagctgggggtgccgtgccgcctctccgctgagaccactacttccaaagcatccggagccaggctctgggctgagcctgccatttgcactcctgcattcaaccctcacaccatc

SEQ ID NO: 117172 - DNA, 254 bp, Homo sapiens
tccgctcggcttctctggaggcttcagtaaaattataatcatggcagaaggtgaaggggccgcacatacctcacgtggcgggagcaggagcaagaaggaggggaggcactgcatgcttttgaacaaccagctctcatgaaaattcactgactatcacgaggacagcactgaggggattgtgctaaaccattcatgagaaaccgcccccatgatccaatcacctcctaccagccccacatccaacactggagatt

SEQ ID NO: 117173 - DNA, 422 bp, Homo sapiens
gtgccctctttcatgtcctaagaaacacattgcaagaagacagcgttccttctgattagccaggcaggtctatgcaaggctgtcatctctagcactggcacctcatcaagagctcctcagtgaccacttttgacttttcctgctgggtctcatgaatcctccttgtcatccattcatacagcaaatattcactgagcttctaccctatgcccagattctgttctagagaaacaagctcatgaagctgctattccagggaagaaataccagggaagggtgttgtggggaaaatcagagtatacgtggagatcgagaatagcggtcagtgagagaagcaagacactgggtcggagtctctggtacaccacccttctctatcttacctactgctccatgccagatctacacagcacatcaattct

SEQ ID NO: 117174 - DNA, 421 bp, Homo sapiens
agcggagtcggtaggcggcggcggaaggaggaggagctccagccgtgctctctcccggcagtggctgtgcttcacagcgcttgttgggttccccaccccttttaaataagccgggctggtcaccgccctcgcagacgagtcagcttaagggaggcggcggcagcgcggcggtgggggtgcggcctaggcccgagccctgcccggggccgggccgcggggcgggcgggcgaaccgcgggcgaggcggcgtctgcttgcgcggtgcagccccagcgtagcccggggctgccggtgccggccgcgccattgttgggggagggggcggctgttgaggtcggcggagtagggggcgagcgaaggcggtggcagagaggagcggaggcttcccatggggaacacgctgacctgttgcgtgtccccca

SEQ ID NO: 117175 - DNA, 903 bp, Homo sapiens
accaggagaagcagaagaaaaagtggtgatcagtcaagagacttgcagttgagagcggtagcaactaatatcaccaacacacaaatacaagcaacagatacagataccacttctttcaatagccttaaattctcttcctccagatacacattatctgtatatcaatggtataaatttacgctcctccctctataaactagcctttgtataaaatgctgaagacaattacaaaaaaccatttatatcaaatacatattaagtcaatcaagtgtctggagagctactcgatggccacaatattcaaatctcccctacttaactttgttaagttcttcaaaaaggtaaaagaaatgaaatcaacatttgtattatacatatttgtattatacgtgaacctatatttacataagccaacaaaaatttgtgtctgcctggaggaacggagaggcctctgggcaaccgtcaggattatgaaaggaaaagctacagcctaccccaaatacgcttgtttcctttgcctccggaaggctgaaagagaaggctggctgagaggcaactctggaagccagagttggagttttatctcaaaagacaagttttaggccgggcgcggtggctcatgcctgtaatcccagcactttgggaggccaagacaggcggatcacctgaggtcaggagttcgagaccagcctgaccaacatggagaaaccccgtctctactaaaaatacaaaattagctcggcatggtggtgcatgcctgtaatcccagctactcgggaggctgaggcaggagaattgcttgaacccaggaggtggaggttgtggtgagccgagatcgcaccattgcactccagcctgggcaacaaaagcaaaattccatctccaaaaaaaaaaaaaaaaacc

SEQ ID NO: 117176 - DNA, 513 bp, Homo sapiens
ccagccacttagagatgacaaggaagtttgtttcagcccaggttctggatggggtaaggagtctcccataagaatttaaaaccaaagtcgtcttccttacatgggcttggtattcatttattctcaatccataggagatattactataaaaactggtcttaggatggagatatcccaggatgcctcacagaagcaaacacaatattgctttagtgtgacatgccctcaactcaggctgcacaacggagtcctctgaaaatgacttcacaatccaaaatcacaaaatgcatgaggaaacaatgtaccataagcaacagttaacacaatagcaagatcagatctctcaaaacgttagcacacacacgttgattaaacacacaaaagaagtttaaaatacgagaaaaggatagatttgaaaaacaaatacaacatctaaactgaaaaatatgccaggcacggtggctcatgcctgtaatcccagcactttgggaggccgaggagggatcatgaggt

SEQ ID NO: 117177 - DNA, 304 bp, Homo sapiens
ctgcccctcagcccatccccatctctcccaaggcttgcatctaccgccagcctggcggcttccaaatgcgcagcccctcacgggccgctatctagctgcctttccagatggcatctgacacatccgcggccagactcagttttcctccaagcctgtggtcccacagccctcccatctccagggagggagactccactcgtgctcagactaaagccctggaggcatcctggcctctctcccgcacagcccacaccaggtcctccaggaactcccatgctcattctctgaaatgggtccgcagctc

SEQ ID NO: 117178 - DNA, 260 bp, Homo sapiens
gagttgaggtgcccggcgctccctatttggctcgctccctgcacccaggggtggagaactcgcccatccctggcaggctgtgtccctctagctgagccctgggcagtaactctgtgacagctgtcatctgcctgactccccgtggctaccccactaatgtggcttacagaagaggaaactaaggcctagtaatgctaagttgcttcccaaattcacacaggtcaggtctgggacagtcccaggccccagtgtggttctgc

SEQ ID NO: 117179 - DNA, 421 bp, Homo sapiens
tacctggggcccttcgttgagacaacagcggttagtgcgtaagtgagggtaaaccaaagtgtgcagagatcacaggctgagaaaggaagcaaaagagcaaaaccaaggaagccagactccttttaacaacccattctcactttcaagggaactaacccattcccctgagagctagaactcactcaccctagcaggaaggcattaatctattcatgagggatatacctctatgacccagacacctctcactaggccctatctccccacactgccacactgaggattgaatttcaccatgggctttggtgggaaaaaaacacatccaaaccacagcacctcccctccccagactccaaagaacagaaccctcaggaaattgactgtgatgcatggtaagaactgccatgtttttctatgaatt

SEQ ID NO: 117180 - DNA, 967 bp, Homo sapiens
  misc_feature (182)..(182): n is a, c, g, or t
gctcgcttgagcccaggagtctgagaccagcttggacaatgtggtgagaccctgtctctacaaaaatttaaaaattagctgaggcaggagaattgcttgaacccgggagggggaggttgtggtgagctgagatcacatcgctgcactccggcctgggtgacagagtgagactccatatcaanacaaatatatgctcttggggacgggcgtggtggcaatgcctgtaatcccaaagtgctggaatattacaggtgtgagccaactcacctggccctaatgtgcatctcattattactaatatcacatttttcccctggtagaaactaggatgtaacccaaattggaatcttacagaattttagtcctggccaatttaaggaggactgttgctaaaaaaacagtgaagaaggctgtgtgcggtggctcatgcctgtaatcccagcactttgggaggctgaggtgggtagatcacttgaggtcgggagtttgagaccagcctggccaacatggtgaagcccgtctctgactgggaatacaaaaattagccgggcatggtggtgcatgcctgttgtcccagctactcaggaggctgaggcaggagaatttcttggatccgggaggcggaggttgcagtgagctgagactacgctactgcactccagcctgggggacagagtgacactccatcttaaagaacaaaaacaaaaaaacagtgaagatgaaagtatgctgttggaggcccagcgcagtggctcacacctgtaatcccatcactttgggaggctgaggcaggcggatcacaaagtcaggagttcgagaccagcctggcaaacatagtgaaaccctgtctctgctaaaaatacaaaaattagccgggcgtggtggtgcatgcctgtaatctcagctactcaggaggctgaggtggggggatcacttgagccccagaggtcaaggctgcagtgagcca

SEQ ID NO: 117181 - DNA, 207 bp, Homo sapiens
taaggtctctaggactcagcatatcgcacagcagtgggctccaattatgtcctattttaatgccctgtcacggagcagggaagagaaacccccttctcttattggttgagtgtattgtgagagggtggaagctgggggtcctgtgtcctggattggttgggagctaggacattggagagagagagagagagagagagagagagagag

SEQ ID NO: 117182 - DNA, 424 bp, Homo sapiens
aagagagcatacttttaaaggatttcagcacattaatggaatgcaaatacatactgctaataacaaatgagtctaatttagtctttgaaacaggtcttgtagtacctgtatttggtagcagatggttccaattactgtatatatttctaagttctgtgcatatttctttaccgtgtctattacttatattttgtggaatttaagcctactcattttcaccaatcactatcttattttagtctctaaagcatctatgtcaattattttttaaatgtataatctttttaaaaatgtataatctttaaaaaaagattattcttctagattttcttccaaggtatataccttgattcttttgtgggtttcttaaatagggttttataagtgaaacaacaaaaggcctttaagaatcaatttagacaca

SEQ ID NO: 117183 - DNA, 169 bp, Homo sapiens
agactgggaaggaaacccatttgaaatagtgacagcccagtgagaaggggatgctagtactcacacatttacttatttatttattattttttgagacagggtttcaccctccatgcctaggctggagtgcagtggtgcagtcttggctcactgcaacctccttctctct

SEQ ID NO: 117184 - DNA, 366 bp, Homo sapiens
tggacaataagcaaacccattagtgaatatatgattataaactgtgtgaagaaaataaccaggatgctacaaagggtattgaggcagggaccttcagatgggaagaagatggtaggaaaagcatctgtaagaacaggactttagactgggacctgagggtgagtggagtagggaaagcattcccggcagtaggagcagcatgtgaaaagtccctggggcagaatcaagcttggcatcttcaaggaaatgacagagaggcccatgttgcatgggtggagactggcatgagatgaggctggagaagggtcaggccacacagggctggataaagggctctgacttcattcttggtgtgatgggaagccc

SEQ ID NO: 117185 - DNA, 729 bp, Homo sapiens
ctcccacctcagcctcagcgtatgccctgctaatttttgtgttttttgtagagacagggtttccccttgttgcccaggcaggtcccaaactccagggcacaaactctatacccgcctcagcctcccaaagtgcagggattacaggcatgaatcactgcacctgaccccagctcattttcatttaactgccgaactatgtttcatagaaaggagggactggattatttaaatatatctttattggtagatatttaggtttgtttttctttctgttgtttttctattggtgaaacagatgcaatggacatccttgaatatgcatctttgggcatatatggataatatctctctataatagatatcaagacatggtataactgggttaaagaataagaacatttaaaatgtaagtaatgtgaagcaaaaaaaaaagccagacacaaaaggccacatattttatgcttccacttacctgtagatgaaatgtccagaacaggcaaatccatagagacagaaagtagatttagtggttgccagggaaagggagaaggaggaaattaggagtgactgatactggccaggcacggtggctcacacctgtaatcccaacactttgggaggctgaagtgggtggatcactggaggccaggagcttgagaccagcttggccacatggcaaaaccctgtctctacttggccgggtgcggtggctcacgcctgtaatcccaa

SEQ ID NO: 117186 - DNA, 6393 bp, Homo sapiens
cagagttcaaactctgtgtcttccacttcatctagagaagggcttctctacacctcagtgtggtggtgagggttctgtggaatgaggggtacgctaataaagcaattacatacacacatggcattactaatagattctcctataaatggtagctttaattattaccagtaataaaattataaagaaagaaatgaggttagcttagggtaacttattctcagtaaattcacactggcatccagtggagaagaaatttgtttctaaatatccatatatcattttttgatcattggttcttgtggtttgcatgggtttaatatcatgtatactgtcctggggtttctgccgtctattcttggctaaagtttgttatcccacatttctgactccagtccttgtcaaatctcctatatactgaaattcttaaatattactaatggtctttttattttcagaccccctagtcctgcgtataatttttttgagcatgtgaatatgaacacatggaagcagccagatatttctgtataatctcctgtgaggcttctcttcagctgaaaaattggatatggggttaagagctctggatcaggagtaaaaacctctaatactggtgttaatttgcttcttaactagctgtgtgacctgagatgggctgtttaacctctcttaacactagttttattccttggtaaaaataattggtttctaccagatgctgtccacgagttccttcttgttctaaaatctcataatcataagcaatctattcagaatataagagaaaccctttgaaatgtttatagggagggaacatgcatggaactattcagtaaacatacaagtttcctgtaatgactgagaaaattgtggtggcatgtatattctgtaggaattcagagaagagagggattcatgggtgtcatatttttgggaatggattatctggaagaagtataaccaaaagagagaatagagatggaaaagggttgatatcggagattgtttttaattcttgcaaaatgaagataaactgtatctaagctcttcccttgctccagaagcttagaagttctcttcatgctgtctgtgagtatagcagagtcaaaagagaaatttttggagtcatacagaccttggttcaaactctgtgtcttccatttcatctagggaagtgcttctctacacctcagtgtggtggtgagggttccgtggaatgaggggtgcgtcaataaagcaattacatcttgttgatgttttaatcctctccaggatgaatgttagtataagatggctgccgaccactctttagaatactgccttgacctgatctcagaaatgggcaagatggtgccaattatttccgagcacaccattttgagacaatatataattttagttggagtgaaacaacattcaacaagtatagctgttttgaagtggtcctctggcctcagaaaatttctgagtatttctttttagcaacttttgaaggcaaacaactcagataattgctactaagtttttgtttcttaatgttcaatcaaggttgagagaaaaaactgtggagtagtagatggcatcagcttagggtgctcttttgagggatgcaatgaaatatgatggttgggcatataggttctggacacactggttttaactgaataaagttagagaagtaacttaacttttttacctcagtttcttcatttttaaaatggccttaatataaaacccatcactattttgttagggtgaaatgtgttattacctacagagcttacactagttgttggattaaagtaaatgcctactaaatctcatttattattattcttagagtttttgtatgctcccacaaatgcatacacatgtcgttaaaagaaaacaggactttatgaaaactgatgaaacatacttatgaaatagtatgaaatgaaaaggagaaatgtgaaaaattctgggggtttctccaggcataaattatgatacatgggaccattatatatcctcctttatgtataggaggaatgactggcctctctgacagtcagtcccatcacatctccttactttttgaattgaaaattgttatgcaatttttaaaaaagatcttagaattttgagtgacctctctggaccttagaaatcattgtatcatatgactctaatcagtgattttatcatttaagattaatttgtttattatcattggaatgtcaaaatctaaacatcgttttgcctaacttgtgaattcattttagtagatcaactgtgtaaaggatttcattatacaataaaataataggaaatctgttttaaaatgattaaaaggattagctaaagatgaatgtattcctctaggagtttctggcagaaaaaaaaaaacacattattcccattaaatgggtgtaatagatcttcctctttcagaatttctgcaactctttcatcttgcgttaactcagctgtggaaatcaacacccaaaggatgtagtagggtgagacataacatgtgggaatgaagaaagcataaaaggcatttaaaaaactaggggtactgagtagaaaattcatctgctactgcagggaatcaactaactcataaagtgcttcgtgcattcttcattctgtagcagaattaaaaactagttcttcaactctttgttttctttttgaaggcttctgacaatcaattctctgtccactcttttttttcctctctctccataacaattgttactggggacaaaatagggtgctggaggggaacagtaaaaagaaataatggtttgaacttagttcagtgtacgtttagtataaggaaggaaagctcttggatggtgaagagtgcttatgcagtgaaaggctctttgcttggtatatttaaaatgggattatgtaaagtactagaaaacacatgccatgcaacaatgccactttggcaggaagatggcttagaggcctccatagaggttttccatcttaaagttctctattttggtagcacaagacattagttcatcaaatggtggagtggaaatattgtttgcttatgcaaaccggctagatttgaagaattgaaaacacagccaataaggagctacgacacaatggtttgtgtacaaaactaaaagaccttggtttcacagtgagcctcttgctggctgccaggcttagttctcttccaggtaggaagtcacctgtgaattgattaaatgtggatagactcaactttgtttatagagttggatgacaccgtagagaagacacatgcaagtatttgtcaccaaagtatttatttgtcaatcattctctactgtcttttttttttttccctcttgaaatacaacttggccttctctgcaaaacccatttttttctacttgaaggacagatcatagttgaaaagacacaacaaattccacatactatccttccacaaaaggattcaaaaccactgagtatcatggaaaacaaatttttataaccttttcaaatgttttgacttgtaacatccttatgttggacttaattttcacctcctgcctgattatccatcttcaccttgacaggaagagcgtgttctcctctgtgatcttctctcttaaaatgagtgtgaaaagtaaaggccacctgttaccatttagaagtacagtttttctttaaatccacttgacatttcaagccttcacatttgctactttgcaataacattttcctttatggactatgtggtttctagaatggtgccatgtgggtcaaaatctagccaggaatgaatggtgttaaaatccctaagcttgaggttgttttaggttttcatctcctacaggggaaagattatactatgtccttatgcagaaatacatgaagcagatttcttcttatataccaggtctgatgagttggaaatgactgcctggatggctgcattgagattggctatttatggacagccaagaaaaagtctgcaccaatttgggatgtgtgtcctgggttaggggttgggcagtgtcctgtattagcctttccttctttagaagcctcttccaggatgtcactgctatactacacccccccacatttttagctgagaaagtagcatggccatgggtgtgtggcaacaacttctgccctgctccttcctcctctttcccctatatactgccttagactgatggatattcgatccctgtgcattttccaaacaaagaggtacaattactggcctggattgaaaagcccaggcaatgtgatatgtgctcatcaagataaatatatatctgcaagccttccctctgagccttaggggggtcttagtcaccaaagaagtgcaggttgcagcagtatttgctcttggtgaattttcagaggctagggtaattcctcagcctgtaaatggagacaagcttcaggctgcagactgggcagcagttgtgggcagataagagtgtgtcattccgtgccagaggttaatgggaattgtcagtgtggtggtgatttttccaatcctttgttctcattttgacagaggttgtggtctgagccaaacctaggatcctatttccaagaacacctgttgcttcatggatcaaatgtaagagatccttcttgggaactcctattccaaatagcaccatgtctgtccgtcgcatactgtctacattcctgacatacgctttcccctggctgagcctttggtcaccaaatggctaatctctttgctgcatgttgttttcttgcaaagctttaaaaatacttatttcctttttgtttctgagtagtatataaatatacctagaaatatatttcaagtcagcacttaagtctctctgccggctttagcagagagttctgtgtaataataatccgtgaagtaatcaaagttcaagtttattttaatatttatatttagaatacaatcaatcaaatgcacataaacacacccactcagtacccaagtctcctctctctccatgaccggtcttcatgtgagtccaaacccgggaaaacctggcccctgaaattataaatcatttgtacccagtcactgaatgacttgcattagttttcagtagattttttttccttcagcttatctgaatagctgcaaattacttctattatttttaaaatgaaaatatttagtggaccaatctataacatgacaggttccatttagcctaaagagagcaatttacaataataagatcgtttcacctggaaaagagaaagggcatcttgagaaagtaaaaagtcttgttggctttgttttaaaggtattagcattgtgttatttgttatctcctacaataatgccatatcccatttattgagtgttcaccatgtgccaagcgttgagttaattttgcatgcatgatcagacttaatcttcacggaaattcctgaggcagttatagatttctagttgatggatgaagatactgagttggagtgagaaaggtgataaagcagcttaccagaggtcacacagacaagacgttgaactagaatttgaacttaggtctttctgcttccaatgtccttgttctttcctgcttcccaataaagcaaaagacctggccttcgagcaaacagtgttgagagatctctttccaattatttaatatctcaagtcttcttagttttctgggcttgcctaagatcttgaatataagtgtccctaacaaaaacgagcccttggtgagaagggtatagtgagggtccatatctcctggccatctaactcaagacattttctggatttcaccacctcttgataggaggtatgacattggcaaaccatttcataagaccttccttcgatcacccttcctagccaccttccatcctgccctcttttgttgcaaaactcatctgcagagaccaaatccctccttaacattttattgcacattgttttgttttttatcatgtttccccaaatagaacctctgtccctggagaagaagactttatttcactcactgttgtatcctcagtacctagaatagtgtcgtccatagtaaacccttgctaaatatttgtgggatgagggaatgaaaacataaggcttagttagatggttccattttcttgtgctcataggcatttggaatttagccaagagcctctctctttcacatagcgtatatgatgagctgtggatacatttttatgtactctcgggtttttgttttataaaataatttaatgcatcattagtatagtaatgtttcatattcaggacatatctatctgtaagccctgtccttttggaaactcaagccaatttgtaattaaatacgcttcagaaatattgctgtgatttatcaagcaacatcacagagcttgaaaaacatgttttcctcacctaccctctcaaaatgc

SEQ ID NO: 117187 - DNA, 1020 bp, Homo sapiens
agttcctaaggccgcctgcggccggcaattaccccctgggtcctctcacacttagcagtgggtgtcagatggtggaagggaacgctcagggaggccccgggcggtgagttgtccctcgggcggggacgccctcgtgggcagtgcggcgtggacggcgcaaggaagaacccggagagatcccaagccacgaggcaccgcttccggcgcattgtgaggtcccacctttcccgccgcctgaggtcgcggcggctgctctttcccggagcagcgtccctggaggcgctgccagggggtgaggcacccacgcgtgcaccgtatgtaccccccagcgcggcgcttagaacgactcgcatgagtcgctgccttgggttggaaccggttactccgccgcttcgtactggactgcaaagtaacaagtacttcgccgggcagcggtgccgaccccgtgtgctacggcgagaggtgcttagcctagagccgacgaaaacatgtccccaggactccctttccctcccagactgcgtcccaccagatggagctttccgtctgttttaaccaccagtgtattcctgatgcctgacccaggcgctgaaatatttgttgaacgaataaatgtgtaggttaggactgacgacagtccgcgaattctggaacacgggctgattttacttttgaacaaatgatgcactggaacttcctgacagagctgaccttttataggaacatcaatggcagtcaccgctggcattttagcaaaggttgtcttggtcataatttccccttgactgtgtttccagcccttaatctatatcgggtgggacctggaagtctaccttctcgccacccctcggcaaaagtttgagaaagtgtttgaggcagagcctcctctctcatatgccctccatctgcgaattagaacgaattataagttctacggtgtcacatagggggttagcggagaggaagagggaaagaatcaaatacaggacgctgccttaaccaaagttctaaactctaaat

SEQ ID NO: 117188 - DNA, 273 bp, Homo sapiens
ctgcttgtcctgcctctgaatggagacaaagtgtggagtatatgaaagttgaagactatcttcggtccaagcctacaaatggctaaaggaggtatacagaggcaggacaagcactgcttgtcctgcctctggatactaaactagcagctgctctctgaatattctttggcaagacttcaccttccatcttgagggcgcgcttgctgagtcaacatatgtggaactaatgaaaacagcaaactctgaaccgaccttcagaggcaggacaagcag

SEQ ID NO: 117189 - DNA, 269 bp, Homo sapiens
tgttggcattgctgtttccttccggaggctctaggtgagaatcccttttcttgcctttctcagcttctaacgctgcattcttggatcacggccccgttctccatctccaaagccagcagtgtagcatcttctctcctctttgccttctgtcttgctcttgtaaagaccccagtgattacatagagcctgtttggataatccaggataacctcctcatctcaaaatttttaacttcacatctacagagttccttttgccaaattaggtag

SEQ ID NO: 117190 - DNA, 414 bp, Homo sapiens
ggtgggcagatcacgaggtcaagagttcgagaccagcctgaccaacatggtgaaaccccgtctctactaaaaatacaaaaattagctgggcatggtggtgtgtgcctgtaatcccagctactccggaggctgaagcaagagaatcacttgaacctgggaggtggaggttgtggtgagctgagatcgtgccacggcactccagcctaggcgacagagcaagactccatctcaaaaaagaaaaaagaaaaagaaaaagaaatttaaatgtgaaatatataaaacggaattaaaattggctaattttgttttaaaattagcacattggccaggcgtggtggctcatgcctgtaatcttagcacttggggagtctgaggcgggcggatcacctgaggtcaggagttcgagaccagcct

SEQ ID NO: 117191 - DNA, 433 bp, Homo sapiens
agggcaggagaggaatgggtgggggaagggaagatgggggcagtggatggtcaccatgggtaaatcagtaatttactttttaaaaaattagtttctgatatataattcacctaacataaaattcactgttcaaaatccgtacgattcggccgggagcggcctgtaatcttagcactttgggaggctgaggcaggcggatcacttgagctcaggagttcgagactaggctggccaacatggtgaaacctcgtctctaataaaaatacaaaaattagccgggcgtggtggcgcatgcctacaatcccagctgctcaggaggctgaggcacaagaatcgcttgaacccgggagggggaggttgcagtgagccgagatcgtgccactgcactccagcctgggtaacagagcgagtctcagtctcaaaacaaaaaaca

SEQ ID NO: 117192 - DNA, 364 bp, Homo sapiens
aatgtggacacaggcctagtaggtagtctccaactacctgctattctggactagaatctaggtctcctgaacccagaatcctttctctttccgtgaggccaatcctctaagccatgaacaatagccttacaaaatgaggtcagagggttaaaataaagtgaacagtgttttacagggtccctaaaaattaaatcctaagtggagcatgcttaacactggttacagagccatgaaagaggtatttagggcaccagatcatattaatcataataagtagttagaagtcaatcccatctgccactatgccaggtctgcctgccccaaagtgtaaacatttattaagtcccacaggatttagctttag

SEQ ID NO: 117193 - DNA, 661 bp, Homo sapiens
aggccacaactacaaagccattaaaaatatatatatatatgattaattttttgtaaaaatttttatataaatatgtatttccctcctctttgataaaagctcttaatatcacagttggcttacttctacctggaagaactccccacctaagttggataaggtttagaagtgaagtcattaggtgagaaaattggcagcagtctcgaaatccttttcccagctatgtagcagttgcttaagcccctagcttcctttccatctttgtcaggtgaaatgagtgaatcaattagagaaactggtattatttacccaggtaaactcaagaaaaatcagttgcactaattgtaggctaaagatagaccacgtttgaaatctcccagttgaaaaattattttaaaaacagacatgaggctgaatgtgggtgtcacgcctataatcccagcacttcgggagactaaagtgtaaggattgtttgaagccaggagtttgagaccagcctggggaacatagtgagaccacgtttctgcaaaagaatttaaaaattaggtgggtgatggtatgcccctgtagtcccagccatacctgggcatcctggccaacacaacgaaaccctgttgaaaacaaataagtaaaaacagatgaaatgtaattcaccacatta

SEQ ID NO: 117194 - DNA, 1222 bp, Homo sapiens
agtgttgctctggtgtctgtattctggcttatgaagattatttgaaaaagaactcttactacattgaaatgcagacttttaaaaatttaaatattggattaggcagtcaaaaaaccaaacaagcataaaaggtcagtaagttgtaatcttaaaagtaaaggtggaaaactcattataaatggaagaaaagttttgatttccttttttgtttgatgggcagtatgccatattatatccaaagttggtttaaaaaatacttccatcaactatttttatttaaaataaacatttgagggaagttaccaaggcagcttttttcctcaaaagtaacctgttcctctttggaacagcacattttaggggcatggttaatacctgagatttttactcagtaaacctgatggttaccgtgtgtaaaatatctttaagtaggattgaaggcctctgtggggaatataatgttaccaaagcctataaaaataaattttacatgttcttttttatgacagagagcagcactggttctgttattttttaaaatgaataactgatttcttgacaggtgtttagtatttcttccctcactgctgattcttggatagaaaccattctttatatttgatagactgttttcagaaaactcttatcaacaagtgtacaatagttatctaaaactgtacatttagaatggagcagtttaatactagatctcagaaatttgaaaaatagcaaagaagactggatttggaaagcatggtctacaattgcttgtcaattctgaagctatgaagaataaatgtttcagctttggattatgaaaccccgtttatgatttttaaaacacacttgaaataaaaatgattgaactaaattttggtccggtgacatcattttgcactgcatagcccattatacattgtaagtctttttgttttaatttattactgagagttttctgtgaagctacagcatatctaatcagagaatttctgatttgtttccttatactgtgattatgttatattaaggcatttgtagtgcagcttaagactgaatttatgctttttgtaaacatgatcggtgtaaatgtcttataaacattctggagtatgtataactttaatgaatgaaatttaatggacctgattaaaataaagggatttaatctttgttaaagtgaagttagtggaataaattacctactggaatatagtccaagtca

SEQ ID NO: 117195 - DNA, 869 bp, Homo sapiens
agtgttgctctggtgtctgtattctggcttatgaagattatttgaaaaagaactcttactacattgaaatgcagacttttaaaaatttaaatattggattaggcagtcaaaaaaccaaacaagcataaaaggtcagtaagttgtaatcttaaaagtaaaggtggaaaactcattataaatggaagaaaagttttgatttccttttttgtttgatgggcagtatgccatattatatccaaagttggtttaaaaaatacttccatcaactatttttatttaaaataaacatttgagggaagttaccaaggcagcttttttcctcaaaagtaacctgttcctctttggaacagcacattttaggggcatggttaatacctgagatttttactcagtaaacctgatggttaccgtgtgtaaaatatctttaagtaggattgaaggcctctgtggggaatataatgttaccaaagcctataaaaataaattttacatgttcttttttatgacagagagcagcactggttctgttattttttaaaatgaataactgatttcttgacaggtgtttagtatttcttccctcactgctgattcttggatagaaaccattctttatatttgatagactgttttcagaaaactcttatcaacaagtgtacaatagttatctaaaactgtacatttagaatggagcagtttaatactagatctcagaaatttgaaaaatagcaaagaagactggatttggaaagcatggtctacaattgcttgtcaattctgaagctatgaagaataaatgtttcagctttggattatgaaaccccgtttatgatttttaaaacacacttgaaataaaaatgattgaacta

SEQ ID NO: 117196 - DNA, 394 bp, Homo sapiens
tatttggtgtttttaagaacaaatgtgaaaatgcgactgataaaattattatttatacactatgtatgtgttacatacgtatgtttataaatatatatatatgattgtttgtgtgtgtaagtatatttctcctaaatccctcacttcagtcttatttcttctataatctagtgtcaagaggtgaacattcgtaatatatccatggttgtaaccaaaatctctgattgtaattaatccatatattatttctttgttttttagtagattaacagaaaaaatattcaaataaattagattattccctaaatgggtcagaatcatttatatagaaggtcttatgaaaaatatttaggaaattcaggtttggaatttctgcattctatgaatttccaca

SEQ ID NO: 117197 - DNA, 924 bp, Homo sapiens
acagatggatcgacagcagctgtccgccaggatgcatgtgctctgccttcctaggggttgggcacgtgatcatgggatggtgtcaacccaagagaaggggtcttaacatgcaaacccttgaataccagaaaacggcagctgcaaagggaaaagataagaacaagggaaaatttagtattttaactttttgctttctgtatgggtaagaacaaaaccccagaaacagagggcaggctaattgggtgatcaaaggcacaggacaggggttggagcacgccaggagctgacagtcctgttagcagaagcatgtgagccggggagcagctgtccccagacccctgaggtgcaggatgtggggcattgcgaaccacacgggccccaccgtcctccccaccccggggcgatgacagtgtggactaaggctaacatgcttttcctccatcaatctttgaatgaaatgtggatactttgttcagagcctgtctttaaggctggtgtgagagcaggccttgggtgagatggctgggcagcgtgctgcccggcaggcatgtgcttttaggcagacactaactaaaacatcccaaacaaatgaacatggagtgaggaacatggctgagtccaggcctcagatcccagatatggctgtgggagaaaggagacccggtctgcatctcaggagggccagagcaagttctgagctgctctgtggccagggtgggctcattcatccctgcattccaactcccagccctgttcagaaacatctattgaatgagcacatgaatgacaacatgaatgaaatcacagtatattgtcccattcctggggtatatgaaaaacagagggaaaggaattccaagatactccttcaccgttccagcctgccctgttccactccaggcctcacgactgcactcggccccg

SEQ ID NO: 117198 - DNA, 276 bp, Homo sapiens
ctggtatcacatggtagtagcctatttagaaatttgtgaatctctaatcacaaaaagaattgacttccttaaaaatatattatatcacctggaaagttctgaatatattttaagtcagcgatgatgcatttgtaaaacatatacttcctttctttagacaaaggatctttatgattctagaagctctacatttctgtggacttgtattttattttttattctagcattttatgttaaatatgataaatgaatttcaagcagcaatgtaagcaaatg

SEQ ID NO: 117199 - DNA, 104 bp, Homo sapiens
ggtgtctgccatatctttgcatccttcaatgacacttttgtccatgtcactgatctttctggcaaagaaatcatctgccgtgtgactggtaggatgaaggtgaa

SEQ ID NO: 117200 - DNA, 3091 bp, Homo sapiens
  misc_feature (1)..(1): n is a, c, g, or t
ngacgagggaaccatcattaattgaagtgagatttttctggcctgagacttgcagggaggcaagaagacactctggacaccactatggacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccatgaaagaactttcaaagcctgggaagggctgcatgaaaattcagttcgtctctccagacagcttcggcgcatccttttgcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 117201 - DNA, 2683 bp, Homo sapiens
  misc_feature (1)..(1): n is a, c, g, or t
ngacgagggaaccatcattaattgaagtgagatttttctggcctgagacttgcagggaggcaagaagacactctggacaccactatggacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 117202 - DNA, 438 bp, Homo sapiens
ttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaa

SEQ ID NO: 117203 - DNA, 2799 bp, Homo sapiens
  misc_feature (1)..(1): n is a, c, g, or t
ngacgagggaaccatcattaattgaagtgagatttttctggcctgagacttgcagggaggcaagaagacactctggacaccactatggacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaagattatttttactgctggaatacttttgtagaaaaccatgaaagaactttcaaagcctgggaagggctgcatgaaaattcagttcgtctctccagacagcttcggcgcatccttttgcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 117204 - DNA, 1389 bp, Homo sapiens
  misc_feature (1)..(1): n is a, c, g, or t
  misc_feature (1169)..(1170): n is a, c, g, or t
  misc_feature (1187)..(1187): n is a, c, g, or t
  misc_feature (1189)..(1190): n is a, c, g, or t
  misc_feature (1196)..(1197): n is a, c, g, or t
  misc_feature (1199)..(1199): n is a, c, g, or t
ngacgagggaaccatcattaattgaagtgagatttttctggcctgagacttgcagggaggcaagaagacactctggacaccactatggacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttgttgnncacagagatgttggtgngnnggggtnnancaggtggtacctaagacagtataaaggcttaaggggggaggaaaaaaccataaggggtttgatgaattggaagaactttaggcgtagaacccatctattattcaggaggtgatgggaaaatggggcaaaaaagagggtgggtgtcggaaggaaaaagatttggaggaatcaaggttcatcacaaaataaa

SEQ ID NO: 117205 - DNA, 722 bp, Homo sapiens
gagaagctggagtgagcgggcatgctgccgcgggtgccagcaggcgctcttctgaggaggtgacatgtgggtgcacccgatggagctccaagacacggaagtctctgccgggatgcagtttgcctacacttcctgcctggatgatctgccacatcctctaaggagtctccggcctctgagcaccccctcggcacccaccctgttcctcacctttcttagagcagccagaatgatcttatcacctgcaccccacaccacagcttgaatctctgcaaagacttctgaacatgcttggcatgaagttcaaactcaagacgtgactcccaagagaatgcctgacgcggagaccatggtgtcttcaccagcatggagaaggtggggtcattgggggggaggcggagggtatcattctgccctctggtgatgcccgatgtcgctgagtgtgaaccatgagaagtatgacgacaagcgctcgagatcatcagcaatgacatcctgcaacatcaatctgcttagaacacccctgtgtcaaggtcatccatgacaactttgtgtatcgtggaaggactcatgatcagcagtccatgccatcatctggcacccagaagactgtggatggcccctccggggaaactgttggcgtgatgggcgggggctctccagaacatcatccctgcctctattgggctgcagtgctgtgggcagggtcgttccctgagctg

SEQ ID NO: 117206 - DNA, 648 bp, Homo sapiens
gaataaacaaaaagtggaaagaacccaaatgtccatcaactgataaataaacaaaatgtgatatagccatacaatggaatatgatttagccataaaaaggaatgaaatactgacacaacttcaacatcgatgaaccttggaagcatgctaagcacaaaagccagacacaaaaggccacaagttgtatgattccatctatgtgaaatgtatagaaaaagcaaatctttagagacagtaagtagattagtggttgccagagactgtagggagggcaaatggggagtaactgttcatggatatgtttttttttgggaggggtgatgaaaatattcagaaattagatagtgatggtggttataacagccttgtgaatataatttttaaatccactgaattgtgtacttgaaaatggtgggccaggcgcggtggctcacgcctgtagtcccagcactttgggaggctgaggcgggcggatcacctgaggttgggagtttgagaccagcctgatcagcgtggagaaacccccgtctctactgaaaatgcaaaggattggctgggcgtggtggcacatgcctgtggtcccggctgcgtgggaggctgaggcgggagaatccttgaaccgggaaggcggaggttgcagtgagccga

SEQ ID NO: 117207 - DNA, 359 bp, Homo sapiens
ggataacaggtgtgagccaccacgcccagccagccctgcacacttctaattagtccaatgacttaggcaagtttcttcatttcattaagcctttttctttttccctaaaaaaggttatggttttggaaatactttccccgtggggttgttgtgagagtccagtgaaataataaggagtggtgcttattacaaaatcaaacgctcaacaaaaataggattcaaagccatttttaaaaatcacatttccttttgttggcttgattaaattgggtaccaataagattaacaaatcttgattaggttaagattagtataaaagacctttcttccagggtattcaatcatttagagcttgtctt

SEQ ID NO: 117208 - DNA, 492 bp, Homo sapiens
aaattgataatatgcatttcatcaaaattaaaaacttccactcttcaaaatacactgttaagagaatgaaaagacatagatcaagaggacgtatttttaaatcacgtatctgtaaaggacttctatgcagaacatataaaacccttgaacctcaataataaaatgcaaacatgcaataaaaagaggaacgaaagatttgaacagacacttcaccaacagaaatattgatggcaaacaagatcaggaaaagatgcttaatatcattattcaataaagagatgcaaattgaaactacaagttgataccactacacacctgctagaaggtgtaaaattaaacagactgatataccaagtgatggcaaggatgtagagaaattagaaacctcctacactgctcatgggaaggtaaaaatggcacaaccactttggaaaacagtttggcagtttattaaatagctaaatacacctaccatatgatccagccattcca

SEQ ID NO: 117209 - DNA, 376 bp, Homo sapiens
caggaagtttcacaaaggctttcccttttttcacagaatgtctagtaggactggtgactccgaatgggaaaaacacaggacctagacctgccctgtccattagtgtagccccttggccacttagggccactgagcacttgaaatgaggctagttcgtttaggaggcactggaagtgcaaaatacgcacgggtgtcagttcgacgaatgtgaaatacctcactgatcactttttatattgattgcacgttgaaatattttggatatattgcagtaaagaaaatgtaagccgggcacggtgtctcacacctgtgatccagcactttaggaggctgaggtgggaggatcgcttgggcaggagttagagaccagcctggg

SEQ ID NO: 117210 - DNA, 219 bp, Homo sapiens
tgagaagcagttttcctgccttcttggaaagacctcagtcaacacaggaaacaatgggagaataacatttgatcctacctaaatggacaacattgtgtaatatgggcggagagggcttagaaattcagaaagagatcagtgtggaccagaataaaaggctttgagaaagaaaggtggaccttgaggaactggtaatatttaaatagaaatgggtactgg

SEQ ID NO: 117211 - DNA, 242 bp, Homo sapiens
gctctgtgaacagggatgggacaatcagatgaaacatcattaagtttcctggtagaaagcacgatgagccctttgttccaaggaaagaagacatttagattttatcctcttattttggagaccaggccagggtaaatcaaattctgactttacattctgccttttccaatgaaggaatgcagtctccaggagagaagtagcagagcagaggagtcaagaccacatgcatgcacccaggcaga

SEQ ID NO: 117212 - DNA, 450 bp, Homo sapiens
gtgaaaccctgtctctaaaaataaataaataaataaataaataataatctgagaagtcctgagaaataaactctgtggaaatgtgttcagtgcaaagtttcacaagctatttgaccacagatttgtttttgttgttgttgctgagatggggtcttgctttgttgccctggctggaatgcagtggcatgatcttggctcactgcaacctccgcctcccaggctcaagtgatcctcccacctcagcctcccaagtagctgatactacgggtatgcaccaccatgcccagtgaatttttatatctttatttggtagagagagggtttcaccatgttgaacaggctcattcttcatttaatacctaatgtcaagttgtgctgcagtcagctttaaaggcctgaatccacacaagtcattctcagggctttgtgagtggcagggtgcccttcttg

SEQ ID NO: 117213 - DNA, 189 bp, Homo sapiens
atctaatgctacacaaaaagggcaggatacaaaataaggtgtattggaagaaagagggtggcatggttgtccatccactgctttcagggactggactaagtgacctggatcagagggagggcaagagatctgcttcctgcctgagccctgtgaacagttgaaatcactcgtgtgtctgcaggaatcatt

SEQ ID NO: 117214 - DNA, 259 bp, Homo sapiens
cccacctgctcctatccaaagtaattcccagccgtgggacggggcctggacgggcccctcctacttccagagtcggcattcatttatgtatgtgtgtgtgtatgtatgtatgtatgtgtgtatgcatgtatagctctgtcgcccaggttggagtgcagtggtgcgttctcggctcactgcaacctccacttcccaggtttaggtgattctcctgcctcagcttcccgactagctgggattacaggcgcctgccaccagg

SEQ ID NO: 117215 - DNA, 510 bp, Homo sapiens
agttccatttacaacagactcatccacaaaaccgaagtggtagaaacaggtctttttgaagccaggcgtggtggctcatgcctgtaatcccaacactttgggaagcttaggcaggagtatcgcttgagcccaggagttcgagaacagcctggccaacatggtgaaactctgtctctacaaaaaaaactttaaaaagtagctgggggtggtggtgtgtgcctgtgtggtcccagttactcgggaggctgaggtgagcggatcacttgagcccaggaagttgagccacaatggcaccacggcactccagcctgggtgacagggcgagatcctgtctgaaaagaaaaaaaaaaagaaaagagaagaaaagaaaagaaaacaggtcttcctgggagcacctagacaaaggcctttgtaaagataaattaccgaggaatatttctagttgcctgttttcttcaaaatcacagtcaagtaagctgggcgtggtggctcacctctgtaatcccagca

SEQ ID NO: 117216 - DNA, 770 bp, Homo sapiens
tcctttccgtgctacctgcagagggatccatacggcgttgttctggattcccgtcataacttaaagggaaactttcacaatgtccggagcccttgatgtcctgcagatgaaggaggaggatgtccttaagttccttgcagcaggaacccacttaggtagcaccaatcttgacttccagatggaacagtacatctataaaaggaaaagtgatggcgtctatatcataaatctgaagaggacctgggagaagcttctgctggcagcttgtgctgttgttgccattgaaaaccctgctcatgtcagtgttaaatcctccaggaatactggccagagggctgtgctgaagtttgctgctgccactggagccactccaattgctggccgcttcactcctggaaccttcactaacgagatccaggcagccttctgggagccacggcttcttgtggttactgatcccagggctgaccaccagcctctcacagaggcatcttaagttaacctacctaccattgctctgtgtaacacagattctcctctgtgctgtgtggacattgccatcccatgcaacagcaagggagctcactcagtgggtttgatgtggtggatgctggcttgggaagttctgcgcatgcatggcaccatttcccgtgaacacccatgggaggtcatgcctgatctctacttctacagagatcctggagagattgaaaaagaagagtaggctgctgctgaaaaggcagtgaccgaggaggaatttcagggtgaat

SEQ ID NO: 117217 - DNA, 759 bp, Homo sapiens
taagtttgacacaaatcccagaagctataacataaaagactgatacatttgacaacatcaaaatgagatccacttcataagagtaacactgtaaacaaagtcaaaagatacatgataatctgagaaaaataatttggaaaaaatatgataaaaggagttaattttcttaatatacaaagagcccttaaaaataaataaaaagggtcattaattgaaaaatgggcaaaaggacatggatagaaattcacagaaaagaagtgtaagtggttcttaaatatatgaaaagacccacaaccctcttataataaaaagtacaaatcagagctgcaataagaaggcatttgtaacctatcagattggaagagatcaaaatatttaataatacactgatttggtgacagtgtaaagaaaaattactttcatacattgctggtgagagtaaatggatacgattgctttggaaggcaatttgtgatatttatctaaattatgaatgcccatctcttagaacccagcagttccactaataggtatctgtcctagagaaacactcacatgtacaatgttcattggacattattgtaatcatggaaaattgaagacaacaatgtaaatatccatcagtgggagatgggctaaataaaacctgggttgttcagacctttagtgcgtcaataaaataccttagtgggttttgacaccgtgtgaaacaaaagaatagaagataacggagtgcattgcacataatgtggctgaata

SEQ ID NO: 117218 - DNA, 901 bp, Homo sapiens
acggccggcggaggaaggggagggagcgaggagcgcgcgctgctctcgcgtgctctcgcgccgctcgcgtgaccggccggtgtgtgcgcgaggcgccggctcccggggcacggacggccgggcgcgcgcctctgcgaggggcgtccgggtccgagtcggcggtccgggccggcgcgaggtgcgtgcgggcgggccgcgggggtcccggacggacacaagcgcacacactcccggaggagccttcgaggctgctcttcctcggccagacggagagcggcactgtctccccgcccagcgctcactcgccccgcgtctccccccgcggcggctgctcctcctcggcaccgccagccccagcgccgctcccgggcgggcgggcggcggcggcggcggcggcgggacccgcggagccgctttgtgtgcagcccgactaggggcggcggcgcaaccacctgacagaggcccgggcgctcgatgcaccttccgcccgcatgaggaggagaggcggttgaaggactgtgaaccataagttgtcccccaggatggaccttcactgcgcaggcccaaggcctgcagatggcctctgtgggcgtcgtgaagtgccgaggggaagatcgttaacctcagggggttaaagagaatcacgaacaagaatcacccagcggacggaaattgctcaagcgcctgaaagaaatgggtcggttgaaaaaccctttattggaattctgggatcaaggacatcatgaaggatggagcacacggcaggtatattccccagtaagcctagtgcattttgtggagttctgagaatctttccctcagggaacccccaataaaaagaatttgcggtatctcatggagacagtggtgggtgagggggacaataatttaggatattata

SEQ ID NO: 117219 - DNA, 280 bp, Homo sapiens
tggataggaaggggtgcataaggacatcttctaaagcactggaattgttctctgttttgatctggatatttgttacatacacatatgtaaaaattaattgaactgcattaggtttcatgcactttattgtttataagttacacctcaatttaagaaaatgcttaaaaatatatgaagatgaagtgttcaaatgcatgggcctttgaaactgaataagcattgagttccagtcctagcttgctacttagctatgtaacccagagcaagtcactggccattg

SEQ ID NO: 117220 - DNA, 336 bp, Homo sapiens
ctcatctggatgtgactcgtgactcgagattccctctttcctctcactctcctttctgtacgacagtgggtttccagcatcaccttctgttgagccttcagaggaagcatggttccgctggcaccttgttgagccttcagaggaagcgtggttctgctggcaccttggttttggacttctggtctccagggccatgagaaaatacgtttctgctgctagaagccgtccagtccatggcgatttgtcatggcacccctaggaaactaacacagtttctaaagctctccttgctatagatgtgtatgaatagagtttgatgaccaatgtgtataagtt

SEQ ID NO: 117221 - DNA, 597 bp, Homo sapiens
gaacttacagttccacatggcttgggaggcctcagaatcatggcaggagtcaaaagtcacttcttacatggtggtggcaagagaaaatgaggaagatgcaaaagcggaaacccctgataaaaccatcagatcttgtgagacttattcactaccatgagaacaatatgggggaaaccacccccatgattcaaattacctcccactgggtccctcccacaacagatgaaaattatgggagtacaattccagatgagatttgagtggtgacacagcgccaaaccatatcaaaaatgttctataaaattaccttcaggttatgtgtataatgtatatatgaaacataaataaatctcatattaagacctgtgtcccattccccaagataccttactatgcagatgcaaatattccaaaacctgaaaaaaatcgaaatttgaaacactctggtcgccagcattttggatgagggataccaagtctgtatctattgttattctgcttttttagaatgtgaagttatattttgtgggatatgccccagctaacattgccatatgatgtccgatagctgaggttgcgttcttaagcattagagaa

SEQ ID NO: 117222 - DNA, 258 bp, Homo sapiens
agctaagtaacaaaaagtcttcatttatcaaggggcagaaacccagatatctatgagtaacagtgagaaggaagagccaatggttgggtacatgtttggcctctgaagaacatgagctttcataggaggatggtctagaagcagcagtggggagccaggagaatgtcacttccacaccctgattccagcctcctccagcccagggacgcatgagtgaggtgtgaaagtataggaagaaaacattagcagagcctgcaa

SEQ ID NO: 117223 - DNA, 307 bp, Homo sapiens
atgcccattaccaaattgagcaagttttattctagtgccagtttgctgttaatttttataataataatgtgataaatttgctgaatgtttttctacatttattaatataatcatgttttcccccttattctcttattatgggagactgcattggtcagcttttgaatgttagcccaacattgcattcttgatgtaatccaattggtcactgttatccttcttgtatatatattactgtattcaatttttctgctagttatttaagagttattcacctatgtccgtgatggccattatcctgtggttt

SEQ ID NO: 117224 - DNA, 505 bp, Homo sapiens
tgcagagagaacacatgtacgaagattctaaaaggaagagtattccatgatcaactcccttatgtaaaaggtaagagggatgcagaaagaacaggggaatctggtgtgaaatgaggcaggcaggagtcaggcagacaggccttacaggccagaccaagggtttttggtctttatccccatagcaatggcaagccagggccaggttttaagcagcaatatgatataatcagatttggtaattcttgaaggattttttttaaaacaaagacctctgctaaaaccaaaccaaaccaaatcaaatcaaataaaagctgcaagactcctgaaggtccctctagctctacatttttagtactttcctatgatatttatatatcccacatgctggttcacttggtcatctgagatgagactaatctgtgtccatctgggatagaaatttcttccgtacttggatgaaaagcagtgtagtcctgcaagatgtgagtctatttccccatacttt

SEQ ID NO: 117225 - DNA, 276 bp, Homo sapiens
aggtcacatgacttgcccaaggacacgtgaagattaagtggctgagctggaactttgctgccaatttgctttcctaagcagtctgaggtcacagcccttttttccccatactctcatccctatgtactgtgcccctacctctgcgtgaccctagcaaagggacgttgggtgcagagctggcccctgctctgtcttcacaaaccctcaataatgcattagaacacgggattcagaatgttaagataagaagaagagctgctaaaagtcacgaccctt

SEQ ID NO: 117226 - DNA, 376 bp, Homo sapiens
agaaaacaaacacgagcaggccagggacggatcctggagtttatgtcccaggggaaacagcatagtatattaagaagggaatgcaaaaaaaggaagggatgcaagagttcagggttactaatcggcagattaatgaatgagacaaccaacagagaacacaagtaaggcaataatgaatcttgcagggcacatgtttaattaaagtagcattctcaaggaggaatattagctttaaagagatgccagttcatttgaggccaattcgctgctctctttccccttttcactgttgctgccttaaagatatttatgtgactgcttaacagaggaaccagactatgtggatacagggactgatgggagatcaagttttaac

SEQ ID NO: 117227 - DNA, 882 bp, Homo sapiens
cgtgacactttctcattataggtccatggctctctttaataaattaaatcaatttatttttataagcaacttaccacccaagtgggcaattttttctcatctaaaaagtgattagaaaaatgaagataaagcatccttcatggtacaatgcaaggtaccaagctaggactactgcctagcaggtagcatgaatgatgctttctctctctctctctcttttttcttttcatactcttcctccaatgtagatggggtgccatggtacctgctaggcattggtcactcaagtgtgagtcatcttccacctttacccttgggtttgctatgtggacttaagtatttctattttttgagttttgttagtttagtggttagcctaatttttttgtttccttttccctggtcccacatatctaagggatataatacttatcaataatcaatcctgggaggggttattttggggtggagcagagaaaggaggaggagataggaaataaatatataaaagcccttcaggtgattgtgatatactccgtccttgacaatcactgaggggaagaacattcccattgctcatgcttattttttaatagtagtgcccttttaacaacaacaaataacttaattctattacctttccaccacttttatatttttatatttcctcttaacttttttatatgcatgttattatattaaatattagatgattattatgtgtcttgctttttcagttaacatgttatatacaggtttatacattataatgatgtcactttagtggctttattaatgaattgattcattcatatattcattcaatattgagcaatgtctatgtgccagatactcttccaggctctggggtacagcaggcag

SEQ ID NO: 117228 - DNA, 675 bp, Homo sapiens
gggcccacttggaccactataaaaggaagcaatgggcacctggacatattagcaccaatttcactaccctgggtggaaaacaaaaatgtctgtcctctaaaccacatatcctcatatttccccggtccataaatgaaattcccttccaccagtggcctgtctcttcctctttagtgattcctaaatccctatacccctgtctctccttggccagacacactgcctgagaatgactcttctaaggactctaacaaaatcagatggtcttatagctgcatttagcatatatataggtgacctaaacatattttcactaatttttatacacttaaaagttcctgtaaatacttgtattctaaccttactctctaagtgacttgcagctctgtgtaaatcacttcatctctctgtgtttcagtttcacgagtataaaaaagactggaaaatccatagagacagtacattagtgtttgccagggtctgggaaagggaggaatagagaacgctaacagagatgaatttttggcaggtggcagggggtaggggattatgataatgttctggaattcgtgatacaacagttgtgcaaatgggcaaagcactggtgtacttttaaagactaaaatgttatggtatttaaataatatctcagtttttaaaaatacctcaggaaaa

SEQ ID NO: 117229 - DNA, 848 bp, Homo sapiens
aaaagaaacaaccaaccctaataccaagttccactgtgcagaggccacaggccctgcaggaaacagagcttgtgctgtacaaacactggaagctccctccaggtggagactcatgtcctcagtacctccccaagccacaggctggtccttgtgttcaggttacacgaagaggcctggggcagggagtctggccagtggagccactctgccacttgggaggtcatgagcagctggtggtggtgagcagagtagggagaataggcttccctgtccttggggacagctcttctccctgcctgctctgctaaccctcacagcagcccggtgccacctggggaagccagaccaggaacccccagggcccagccttggaccagggaggctctgcaggttcaatgtgagattgcagaaaaagacaatcggaaaagcacacggctgatggctcctggggaatcagctagacttgggccatacgacaggagaaggggcagtgagcaaaacctcaccctgcagcctcagatctggttccccaggctgttaagggccccaagggagagtccttggccccctgctggcatcttacacttgaccagggctctcccagggcctcagccaccactgtgggttctatgggcacaggatcttctgtgtcaggctgggtggccaccatctgtacaactgtggctcccagtgtgagttagaacaaataccccttcttcctccaagacacacacacatgctagaagtttccattgagatgagaaaaccaccagacagaagggtacctgtaaatctacactttctttagacaaaggacctgattaggagaatggggaatggctgtggga

SEQ ID NO: 117230 - DNA, 425 bp, Homo sapiens
gggcacggtggctcacgcctgtaattccagcactttgggaggccgaggcaggcagatcacgaggtcaggagatcgagaccatcctggctaacacggtgaaaccccgtgtctactaaaaatacaaaaaattagctgggtgtggtggcacacgcctgtagtcccaggtactcgggaggctgaggcaggagaattgcttgaacccaggaggcagaagctgcagtgagccaagatagtgccactgcactccagcctgggcaacagagcgagactccgtctcaaaaaaaacaacaacaaaaaagaaaatggggactaagacacagaagaatatagctgtggggagtagcttcagggaactgaaataggtccagaggaagctcgaagtggccattctgaagtttatgcaaactgctggccaggagaggcga

SEQ ID NO: 117231 - DNA, 449 bp, Homo sapiens
tcccccatgaaattgagataaacatgaaacagtcacagttatcagacagaggaattcagcaggatttgtttgatttaggacttacatccttaagctgagtaaacagtaagcaatactgcacactgaaatctcagcgagttagtgtaattagggagtaagaaggataactcaagtcaaggatccatgtaaacagaaatcttcacatttggtgagctgtaaaccagagtaggtgaatgcagagatctctcaggttacactgctactgttctaatgcaaaaatgctcatgttccatgtcatcattggctgcttcctcccatgagcccacactggaagatgataaagttttccacttggccaaccaggctcaatttcttagtatttttccttactaagtattaaattttctagtttatttcagcagtacctgtagtcagttctacactgtaaa

SEQ ID NO: 117232 - DNA, 862 bp, Homo sapiens
gttcttttcctcctgggaacaccaccaggctacatttcccagccaccttacaattaggtgagacccatgagactagtccatgccaatggaatgtgaatggaagtgcatctaattttctggctcatgaaaacagcagcattttctctattttctttttttctttctttgttttttttagacggagtttagctcttgttgccgaggctggagtgcagtggcgcgatcttggctcactgcaacctccgcctcccgggttcaagcaattctcctacctcagcctcccaagtagctgggattacaggcatgtgccacaatgcctggctaattttgtatttttagtagagacggggtttctccatgtttgtcaggctggtctcaaactcccgacctcaggtaatcagcccgcctcggcctcctgaagtgctgggattacaggcgtgagccaccgtgcccggcaagagcagcattttctaaaagcaatcagtactcaacaccatcctgctgaggtagggcagcggcggactccatgttttgaaacttaggaacttagaccatcttttgtcaaattcagatggttttctcaaagtaaagatcattcaagttttgtttcagtaatgggccgtatgatcagatctgtgtgattaggctgaattcattattattgagacaaaaattgagttaaaggggattcttggtattggcctgcaaaacctgtcataacttaaatgtaaagtttctgatgatttagtcactttactctcagctcttagctctttcactcacctgtccttgttctacacaacctgcctgatgggtaacttgaatacatattttctctcttcaggggatgggaacgccctaa

SEQ ID NO: 117233 - DNA, 174 bp, Homo sapiens
tgctcacaccatagtctaagccgccattgtgcatggtgtagagagggcatgaccgcaacagtgaatgctgcgtttgatgaactgaaggacaataactaaaggactgtggcttttactgcaaaggaaagagagagaacagagggaggaaaggctagaaaggtagggaggggccaa

SEQ ID NO: 117234 - DNA, 484 bp, Homo sapiens
gttcaagctattttcctgcctcagcctcctgagtagctgggattacgggcatgtgccagcatgcccagctaattttgtatttttagtagagacagggtttctccatgttggtcaggctggtctcgaactcccgacctcaggtgatcctcctgcctcggcctcccaaagtgctgggattacaggcatgagccaccacatctggcccttgcagtaaactcttaattctaccagtggggtcaagaatgaaatagattgtcttaaatctacttaccaaacctcattttagcagataactttaacttcaagctttattccagagaggatgatgagggctttaacttcaatttgttcacttattgagtatccttagataagacatcatgtaaagctctatgggccactgaaaaatgaacattttttgccttcagagagcttccaatataacagagatgaaaaaaggatgtgcatgggcacacacacagac

SEQ ID NO: 117235 - DNA, 285 bp, Homo sapiens
aaggagagtgcctctctgtggttggagaggaggcaccagtatgagaatcatttggtctctagagtgctttttacctctggcatgtcattcatctataaacaatgacttgactgagggctggggagtcaggagatgaaagagcaggtacttgtgttggggacaaggttgccaatgaagaaggaggaagagagatgagtgggcttttcttgtgtcctgtaatctcccccacgataatcaatatcatgtggcattgagtgttacatgtgtcccaggcacagtaccagg

SEQ ID NO: 117236 - DNA, 3036 bp, Homo sapiens
  misc_feature (514)..(514): n is a, c, g, or t
  misc_feature (1415)..(1415): n is a, c, g, or t
  misc_feature (3030)..(3030): n is a, c, g, or t
  misc_feature (3032)..(3032): n is a, c, g, or t
  misc_feature (3035)..(3036): n is a, c, g, or t
aaagggcatctggaggcctagcctctgtcatcctgggccacctggttcttctgtgacttgttttctccatgtataaagtagaaggcctgttccttggagaaaaaggtcaaggcgggtggaattattacctggcagccagcggggctcacagtgcaggctacttcagaagcctcgtccctggctaacaccacaatggttataacgccaagcggggcagctgagactggcccacctggacacacaggcaatgagtggaggtcacaggaggtctggccaccagcttccctgcacctccacccctgcccccacactagtctctcctcagccccacagggagccaggggcctctagaatggcctctcctccacccacgtgcatgggccctggcacaggagaggcgctgaggaggaagctggaaggcacccagccacccactccagggtgaacggtgagcctgcccaagcatgagctcttatgaggcccagactgccagggggccagggtgtctgaggcncacacattcctcactctctgggagttgggagtggaggaccctcctccccttctctattctattgggaagctttccacgaccccatgtgggatcagagacctcttctgatccacagcctcatcatcctgtgttggtggcactcaaccatctttctctaccagactagcagctcggtggaggcaggcactgaggaagcgtgtgctgaaggcatcgcatgcaggcaatctggaagcctggggcttttccatctatacagaatgtacagcccaggacacaaaccctatttaccctccagcattctgcatacctaggaaaagcagtaatcattgaagccttgcttcagatcctccattcatgcaggaagtggggctctggtctgttctagtgctgtctagctgggtggcactcccacatccttttctccaggcatgtgaactagctcttgtgtcctctttctcttgccaaagacagtggtatggtaccaaggagaacagagccaggggccaggaggcctgggttttggtcccagctctaccccccgagctgctgcgtggctttgagtaagccactccccctctctgggcctcagcgtcaacaccagttgaggggttggatcccactgctccctgggtctgttcctgctttacttcactgccatgagccatgtgtctggggctggagttggaggagagtgctggcaccaggcagatggttctgaggacaggttcagagtctgcaaggctgggagggcacctgcctctgtcctgggtcccacctcctggcctgctcctcaggaaaccctgggacacatgaacttgggcctcagctttggctctgatcgtattgtgatgccatctctgggccaggccctcatctgtctacatcacctcacctcatctcntggtttacgaagccctttgtatatgtctcctcatttagttcttacaatcacccctgaggttcagagagggacaggatgggcccaggtcacacagcagtcagaggactatcaggcccagcattctccagcagccctgatatctcctccttgaaacaggaagaacacaggatgtgcagtgggaatcctgaccttgccccctgagcaatactgagtagggggggtggtactctctcagaaccactttgagccaccatgaaaatctaacagcataaagatgccaaaagcataggtgccagccagggcagcagcccgctggaacagaaagagcaccacgcagggagccccagagcccaggctccagttttgggttttcccatctgtcaaatgagggcaaggatgcctgccctgcctcacccactgaaggccagctgtgcacttgccacacttaccccgtcccaccttctacacagctgtctgtgcccaccacctcagccaggaggagtcacgagccccttccctatctgcacacagctcagcctggctcactgcaccaaaaaggcaggcctgagcatggaccacacacagaggtatgttcagacagacgtgcagacactcaggcacatgcacacagcgcatgtacttgcagatgggcacccgtgcatacagcaaggcacacaccacccacttgcacactcaggtgtgcgccacatactgaacatactcagacacgcatgtcatgctggacacacactgcagcacacagaccgcatacccacacatgcacagttggcttcatatgatgctcacacactgcagacaaatatgcatagattttcttgcctctcccatgacagccagatggtgggattctcccagagggctgccatttaatgctctaattaattttttaaaattctaggtacccaaagcctgggtttgttcaattggtccaggcacgacccagtctgaggccaaggcgggaagcaggacctaggacgagggtgtcccactatacccaggagaggcttccccctcacctggtgagtagatacctagcctagcaaggggctggggtcacaggcccagaatctgagcctgatcctggttccaacagtgctcctatgacccaggacagggagagaccccttcccagcagccctggcggagtggtctggccccaggtgcacacctcaggatgcagggcgctcagtccctgcggaggctgctggctctcctatcagactgcactgcagcgaggctttcctgacatggaggtgggctcggggctgcacatccaaatccaaacacacctttgctgagccctactgtgcagggcacacttcaaggcactgtgggaggacagcgcagggaacgggatgttcacagagcacagagctaccagagagttagtgctgagacagtgctcaccgcatctccaggcagtatgctccgagcaggccagaatttcattctcacccaggtctcctggggagccccaccttattctctaggccatgaggatcctggggggttcaggctagcaggaaccaagcatcactggccctccaggtctctcctctgcctttcctggggcaccgtctttgctgctaaatcntnggnn

SEQ ID NO: 117237 - DNA, 1789 bp, Homo sapiens
  misc_feature (1783)..(1783): n is a, c, g, or t
  misc_feature (1785)..(1785): n is a, c, g, or t
  misc_feature (1788)..(1789): n is a, c, g, or t
agtctcaggtctctgctgctggaagccaaaataatcaagcagcaggccaactgtgcgtgagggaccctgctagatgctggcacgccctgcagttagcttgaagaggaagccacttttaaacagcctgcccagtgagcactgctggctgcctgaagatgattccactcaccttggtttttcctgcaagtgaaccttcctcccagaactaaggtttggaagatcccagtctgctgcctgacatggccattctcccacaaaaacagatcctgactcggagggcagttggttgctagatcacgtctatcagtgcccgacataagggatggcacacagaaaatattcagtgaccgaagttcctcctccctttatcccagccgctgtggcagccccaccaccaggctttgtacacaccccacagggagccaggggcctctagaatggcctctcctccacccacgtgcatgggccctggcacaggagaggcgctgaggaggaagctggaaggcacccagccacccactccagggtgaacgcctcatcatcctgtgttggtggcactcaaccatctttctctaccagactagcagctcggtggaggcaggcactgaggaagcgtgtgctgaaggcatcgcatgcagctgtctgtgcccaccacctcagccaggaggagtcacgagccccttccctatctgcacacagctcagcctggctcactgcaccaaaaaggcaggcctgagcatggaccacacacagaggtatgttcagacagacgtgcagacactcaggcacatgcacacagcgcatgtacttgcagatgggcacccgtgcatacagcaaggcacacaccacccacttgcacactcaggtgtgcgccacatactgaacatactcagacacgcatgtcatgctggacacacactgcagcacacagaccgcatacccacacatgcacagttggcttcatatgatgctcacacactgcagacaaatatgcatagattttcttgcctctcccatgacagccagatggtgggattctcccagagggctgccatttaatgctctaattaattttttaaaattctaggtacccaaagcctgggtttgttcaattggtccaggcacgacccagtctgaggccaaggcgggaagcaggacctaggacgagggtgtcccactatacccaggagaggcttccccctcacctggtgagtagatacctagcctagcaaggggctggggtcacaggcccagaatctgagcctgatcctggttccaacagtgctcctatgacccaggacagggagagaccccttcccagcagccctggcggagtggtctggccccaggtgcacacctcaggatgcagggcgctcagtccctgcggaggctgctggctctcctatcagactgcactgcagcgaggctttcctgacatggaggtgggctcggggctgcacatccaaatccaaacacacctttgctgagccctactgtgcagggcacacttcaaggcactgtgggaggacagcgcagggaacgggatgttcacagagcacagagctaccagagagttagtgctgagacagtgctcaccgcatctccaggcagtatgctccgagcaggccagaatttcattctcacccaggtctcctggggagccccaccttattctctaggccatgaggatcctggggggttcaggctagcaggaaccaagcatcactggccctccaggtctctcctctgcctttcctggggcaccgtctttgctgctaaatcntnggnn

SEQ ID NO: 117238 - DNA, 428 bp, Homo sapiens
caggaaatgcttggagcagccagcagggtagggccaagtcatgatacacctaggagtgggaggggaggcctctttggatattacctggtttatcatttagctgttggggtggggaaggaggtgggaaagacagaaggctctcccaggaattggcaggcagccaggtcagggacaatggcagcccccacttgtgctagaaaggcaggcaggacgtgaccactcagatagccacatcaacaagtacaaatcacggttgccctggaaggaaatggctcaggtttttcccagtagctcaatgcctaggcacccccacctgtggtttgggcatttcactctattagctcttctgctcagtggcccattctgctagccacagctcacatttactccagttatgaaaaaggttaattttcccatattgagtttct

SEQ ID NO: 117239 - DNA, 406 bp, Homo sapiens
cataagaagtgatgtctgatatgtgctatgctatggataaaacttgaaaatactatgctaaaggaaataagtcagaccagaaaaggacaaatattgcataattctatttttatgaggttctagaataggcaaactcccaaggacagaaggaaagaggagcagcacgatagcagttgtcaagaacaagcaccttatgaaaggcagcaaagggagccaaaaaggtagttgatccattttcttagaaagattggtatgatgtgaaagctcctgctatgtccaagaaatatcagaaagacactaatcaccaaaaccaaggaacaaaaattgcatctgatggtctcaagggttatgtgtttgcagtgagtctttgttgacttgcagaatgatgaagttgcatttagaaaat

SEQ ID NO: 117240 - DNA, 151 bp, Homo sapiens
ctggctgagggaactaggtgtgttaccccccgcgccccatccacacccagctctggaaaacatgcctagctcggtgacccactcggcgtccagcccttgacagaaataattcacaagtgtctcagagcaagaaagtcacgtgggagtgggt

SEQ ID NO: 117241 - DNA, 361 bp, Homo sapiens
agcagtgggttggtctgtctgagatggggccgagttcccagggggaggggtggctgctatctttgtggtttggttgactcagccactccagcctgatggctatacaggcagtctggatgaggaagggttcccaccaatgcagcacacctgctgtatcaaaaagcagccagactgcttctttgtacaggtccctgatctcattcctcctgactgggtgagacctcagaacaggggcttccagtcacctcctacagatgcatgtgggccagcaacaggccaataacccccaggacagaacttccagaggaaggagctggcttccatctttgctgttttgcagacttcactggtgatacctcca

SEQ ID NO: 117242 - DNA, 428 bp, Homo sapiens
aagacagagtttccgtctgttgcccaggctgagattgtgccactgcattccagcctgggcgacggagcgagactctgtctcaaaaaaaaaaaaaaaggaatgactatttatgagttcagaaatgacggtgactttcttgaggctgttgtatccattggcagtactggcaccagctatatctgacgttccatcttaccagagggcatgtgctttgagtagttactgagtagttctagatgatgttggttacatgatagactgaagtattttattaactctgaattcagtctgagaattggaaacgtgctattatccagtgtagactgatggagttgatttcattttacttttcccctttttgttttcccttctatttaagagctctagtgattgataatgtctttccttatgggaaagattcatttttt

SEQ ID NO: 117243 - DNA, 360 bp, Homo sapiens
gttcaagcgattctcctgcctcagcctcccaagtagctgggattacaggtgcccgccaccacgcccagctaatttttgtatttttagtcgagacggggtttcaccatgttggccaggctggtctcaatctcctgacatcaggtgatctgcctgcttcggcctctaaaagtcctgggattacaggctttagccaccgcctggccctggcttacatttttatcacagatttcctgatttctaatctggagtcattggctttgaaccagattggaatgctcaagattctgattgtttcacactgatttcacaagaggacttggcttctgattttaaggaaaacttagggggagtagcagattt

SEQ ID NO: 117244 - DNA, 782 bp, Homo sapiens
catctcgcagacttcgggcagcgatcgtggcggccgcctccccggggctccacggccgacctgccgcctgccgcggccatccccggcccactcctgccaggcccccgaccggagccccggaggcacccgctctgagcggccgcgcagcccggctgcatggagcccagcgcggtgctccggctggccaagccagacacggcgcaggaaaccgccacccaccaaggcaagggcaggaagaagatggcggcggctgtggcggccgcgacagcggtggcctcagctcaatatttttttctcaaaggcatatcatagttttagctttgctgcagccatttcatccataatcatttgctgtggctgggtaaagtgatacacacatactggtttagagaaatacatgcgcacactggtttagagaaatacaaaacgcaatgcctagacctgaaatgtatttatttagatttgttagatggtgcagtcaagtaaatatttgtgttatgctttaagcttttaagaaatctcttgtatctaagatataagacacatatgtaaatgacatccaactaagctggatcaggccaatgtactgaaaaagggctaccatatgttgctacagggcctcacctgttggccaggctggtctccaactcctgagctcatgtgatccacccaccatggccttccaaattgctgggattacaggtgttagccaccacgcccggtctaaattctcaacataaataataaaagccagaagataatttgacagcgctgaaaggttc

SEQ ID NO: 117245 - DNA, 298 bp, Homo sapiens
gtggcaatgagtgtataattaggtctggggtaggaaatgggtcaaatctagcgtcatgggacagcctagccccaatcctgtttgttaaggtctcatcagcccagtcttcttgttggagtagctaattttaacagcttgatgttttcccccttctcctgtgaccacacagcattcctattttgtgggtgtttctttaattagagagtggaataattattaggtattctggaaaaggagggaaattcagggacccacctggttactgccccctttctctcttatttggctttgcccagaa

SEQ ID NO: 117246 - DNA, 620 bp, Homo sapiens
gcatctgggaaaaatgagctttcaaccccaggaaaagactaagagatggtcagtaaagaagctaagaaccatgagtctagactcatatatatttcagtgaaaacctaacttaggaacttacccatgtctataatttggttaagggctgttaatttgtcctgtggtaagtaggaataaaatgccttgaagaaaaccctcagagattcaaagatcttgtggctgggaggggagatgcaaaagccatgaagtgcatcctattagggaagcaacccaagaggaagaaagggaactagctcagggggtcagtgaatgggcatgtcgggggggcagtgctggaattccgaatccaaatttctcacacctagattctcctagcttaaggtggggggatacggcgggcaggatacatttaaaagcacagcataagcataaaaaatggagcatctgttttctagagtgtcaattttattccaagatttctgagaggagtaccctgtgatggttttatgtcaaagatacaggggtggttaaaatacaaaattcaaatggatcaaggtaaatcaaaagacttgagacttgaatcgattgtgttcactgttccaggtaagcattataggatg

SEQ ID NO: 117247 - DNA, 365 bp, Homo sapiens
gccaagggatggttagacacatctggagaagaggaggttcaaaagttgagcgtgtacagaggatgaattcagtcccatttggaggagcaacctgagaggagagagtggaggtagcataggtcgagccctggattaggagttgaacgcctgggctgcaagctcctcatggtcactgagaggacttgagcaagtcacaaccatctgggactaagctctctcttcccctgaatgagggattgggcagtttacttggaaggtcctctccagccacaaatttctgggattccaagtgtgtcatcacaccaggaagtgatgagttgggtacctagagagtgagacttggggagtttctgcgggcaaagaaa

SEQ ID NO: 117248 - DNA, 426 bp, Homo sapiens
caggggtgactgaccatgtgcctttcactttcttgcagactagatcaggcttgttcccatggcagcagtacagtttaaagagtgtgaatacaagcattcttaaggtctaggctcacaactggcacattgtcacccctgctggcctagctacagccatcctaaatcagtcagcctcagaccaacctgtcagctgactacagatgcatgattgaactcagccatgattaaccaagcctgattaggattagcagaaccactcagctgacacgtaaagaataataaatgcttattgctttaaactgcctgatttaggggtggtttagtaaataattcggtcgattattactgagttctaaatatttcttaaattattttatgctttcatttttaacctgatatttaacactgtgtgattttttttaaaaa

SEQ ID NO: 117249 - DNA, 451 bp, Homo sapiens
ctgggtggcacgatcacggcactgagtcaggggaagtgccctggaggtgccagagacactggcatcctggggccaggctttgtcaggcgtctttttactgaagctgtgtctttcaggatcattcatgggcaaaatgcagaagcatagtgacttcaagttacctttgctttgtgatgatgctggccacagtgtgccttcgtgtgacagggtgttttctttcaacatcttaaaactcacagttcttggccaggcacagtagctcacacctgtcatcccactactttgggaggccgaggcaggtggatcacctgaggtcaggagtttgagaccagcctagccaacatggcaaaactccgtctctattaaaaatacaagaattagccgggcgtggtggcatgtgcctgtagctactttggaggctgaggcaggagaatggcttgaacctgggcgg

SEQ ID NO: 117250 - DNA, 234 bp, Homo sapiens
ctctcagccccagcctcatagtcatgttactgattattcagtctgtgtgtggcccctcacagagttccctgactagcaggaaaatttaagcatcatctttaggaagtgtaaatgagaaaagaaagcaatcaggaaggcataggcattatactccaggaatacaggagcagagcttctctactgctggggttgggcaaggttacagatcccagcgcatctcctttatacaaatgt

SEQ ID NO: 117251 - DNA, 223 bp, Homo sapiens
ccccaatatctaaaactgggaaaagtgcagcagctcagtggagtcctgcctcccctccagacccccggcaattgcaagtcagcctcgttggaagcagatgctgcaatggagtttgacaggcagagtatttattagtgatcaatacctatgggtgggcaggggaggaaggaggattggatggaggctgacactttagccagccctgtggggaatgtatgggacc

SEQ ID NO: 117252 - DNA, 679 bp, Homo sapiens
ggcaaccggctcgggtcccagtccacactgtggaaggtttgttctttcactctttgcaataaatcttgctgctgctcactctttgggtccacactgtttttatgagctgtaacactcaccgcgaaagtctgcagcttcactcctgagccagcgagaccacgagcccaccaggaggaacgaacaactccagacccgctgccttaagagctgttaacagtcaccgcgaaggtctgcagcttcactcctgagccagcgagaccacgagcccacctggaggaacgaacaactccagacccgctgccttaagagctgtagcagtcaccacgaaagtctgcagcttcactcctgagccagcgagaccgcgaacccaccagaaggaagaaattccgaacatatccgaacatcagaaggaacaaactccagacgcgccaccttaagagctgtaacactcaccgcgagggtccgcggcttcattcttgatgtcagcaagaccaagaacccaccaattctggacacaaaacctcaagtagtccctccaccgaaagcacattataaggatcattttgcctcaaagccctcctacaggcaagaggagcttactgtgacttccaagaagaaaatgatgttgtggcatgaagcacttctctgatcatatcactgctgtactaaaggtacgttc

SEQ ID NO: 117253 - DNA, 941 bp, Homo sapiens
cgcggctggctcggcagctccaggctattccgaggaacagtcttcagagagcctggggtgctgatggggaaaagctgttgctgagatttgacaagtttggtcctgagatgtcagaaaggatttcagctcttctgccaccccaaggacggtggcgcgtaaatcacagtgagctggcttatgtcaggtcaactgtggaatttgatcctagcgcattgctccctcctcttccttgcctgcgtctctccctctctcagctctagtttgagatcagcacagattccctgggtgatttttgagaaaactgcctcctctttaggacttggcatcccctaacctgcatcaggaaagggtggcgacagatactctcacacccagggaggctgcaaggcccaccctctaccctccacctgggttctctggcgtcgagacttgtgccctacagttctgggccgttggggtgatgtcccagtgggaccagggtgagggtgcaggtatctgagggagtagtaggaccagaacctctaaccttagggaggcttcctgggagccaagcttggtgacttagaatgtgaatgtctgacccatatcccactaccttttggtgggtgctgcagaggacaacggagagagagtcaactttgaagagtggtcttgtggaagaggcagctggctggttcagtgtggcactggcagcctccctaaggttcccaggtagaagtttctgacaggtacgatttcagctggtgtttaaggaagaactttgaagttgtcagaatgagctgtcttgtgatagtgaagctccctggtctcccagaggcatgcaagccaggacactttcacttatgcatttcaagctgacctattgcaaggcgttggtggctaagtgctaaggagtgcagcagggagaaacgagaacccagtggggaaacaggcccttgcaa

SEQ ID NO: 117254 - DNA, 274 bp, Homo sapiens
ccacttcagaggggtcggtgagccttgccaccagcagaacagccatgggcatctgaactcaataacagaaacatccaacagcccaacactgagagctgctcccttacagcccacaagggacccaagtgacatggcagtgtttgaggtattgtgatgtgcgtattggagactacatgatttttgttgacaagtttctcttaacgctgaaaatatgagtggtcggaaggcttgcagttgggaagaagttttcagttttacaggaaacttccctggg

SEQ ID NO: 117255 - DNA, 540 bp, Homo sapiens
taagtaacttttaaccattgcttgtggctacctggagggctgtggccagtgacttctgacagctgaatcagaaacttgccttcatggatttgcaatgtctgaatgggctggggtggggcaaggacagcctcagattgccagaacaccatctctgctctttcattgcttttaagacagtatttttcatacttcagtgaattatttacttatataaaaatacatgtacttgtatttatttacaagtacttatgtagtactttctatattccagacagtcttctaggggtcttataaatattaactcttttaatctttataacaatattgaagcagaggttgtttttatcttcattttttaagtgaggcaactgaaacacagagaggttgagaactttgcccacagttgcacagctggtaaatggcagagccaaggcagtctgtcttcctaatttgtgtcaagctgtttatatggggtatatataagttaatggcaaaataaagcatatcaataaaaacaaacaatgtattaaattctggtta

SEQ ID NO: 117256 - DNA, 196 bp, Homo sapiens
aaaaaacctaaaaatttaaataaataaataaatacatacatacatacacatgtatggcatgggtaatgggtatttacacatattttatatatatatatatggcaaatacttacctgtgctatataggttttgaatatgttatgtttaggtttctgggttgggtttgggttggtttgctagtgaacattctctcttg

SEQ ID NO: 117257 - DNA, 350 bp, Homo sapiens
gtcactcttaggattaccagtggtaggtttggtagccaacctgaccctgtacgtcactccatttcatcctcatctgttcatattgaactgccacgggcaaagatgaatatgacgcagtcacctctactgtctgggaactcagtggtggggcttaggggccatgtcagccaattacaaactgaattctggggaggtaagtgctgtagaggaggcagacagctggttgaagggagaggggtcaccacagagccgccgaggagtctgggccgacttcatggggccggggagaagccagctggtgtggaaggccagggcggtgggtaaaatagcaacatggtgtgacataaata

SEQ ID NO: 117258 - DNA, 88 bp, Homo sapiens
atcctcggtcaggccaagaagcatccgagcttgatccccctctttgtatttattggaactggagcttctggagcaacactgtatctct

SEQ ID NO: 117259 - DNA, 170 bp, Homo sapiens
cctgttattgtccccaaaactacagccactaagatcaatatgaagaagcttcccagtcatactaggagtattttgccttcaggcatgtgtattgagcatatcagtaacaatctagatcctaagtcttagactaatgtactttaaaagttggctggtcacggtggctcacg

SEQ ID NO: 117260 - DNA, 320 bp, Homo sapiens
ctccaactccattataagcaaacaaaaacatgggcactcaagtcgaagtatttatttatataatggtgtttttttaatccaaaacagagttatgttaacttttagattacctttgaaataaagctacaaaactaaagattttttgtgagaactcacaaatactaaagaatatgttagtgggccactagggatttaagaagcaagattatgagcgtaagggttttgaatagctaagatctgcaattttatctaaccgaaacacatgcaagcttcagtgccctttgaaaaaaatgcagtattttaaaaattacttctacaaa

SEQ ID NO: 117261 - DNA, 385 bp, Homo sapiens
ttgggagcctggctctgttaggaaggtgcgggcaaccctgttcccccgccctaggattgaaccaggatgaagacatatccaggaaagccgctgtggccagcctgagcgtaagagagactgcgactccctgcccagtggaaatacactatactgcaagatgccaaaatgagccacttgaatcctttttttcgggaagtcaaaagtacggtgaggcatgagaagaaggatctccagctccaagttgttctccctcttgtggctgaacacactgttaccatatgcttatgaaaccatttgcatatggtacaagcccatgtgggagaaatgagagctctgacaacttctacctgtcttctgtcctctcctgacaatgcatctccatcac

SEQ ID NO: 117262 - DNA, 348 bp, Homo sapiens
agaccacgtatatgacagtaggtcccatcagattataatggaggtgaaaaattcctatcacctcatgatatcactgctgtcctaacatcacagcgcaatgtgttactcaagtgactgcagtgatgctggaataaacaaacctactgtgctggaagctgtataaaagtctagtacataccattatatacagtacataattcttgataatgataataaatgggctagatgtggcagctcacacctataatcccaacactttaggaggccaagacaggtgggtcacttgagaccaggagttcaagaccagcctggccaacagggtgaaacctcatctgtactaaaaataca

SEQ ID NO: 117263 - DNA, 330 bp, Homo sapiens
gagtcacctgccttgtgcgactgcttgcaggatcacacacgatgatggatggtccttggcgcctagagagactcacacaatggttgctgctgttgtcagcaataacactcattctagaccagctggcagctgctgtaatggacagtgtaacaatggatatgtgtgtgtcagtgctgtgggagctcagcagagggacttctctcagggatgggaacaggtgttggtggccagggaagtacccacactatagcacgtctgggggcagcttggaggctgggtcagagtttgccaagtggaaaaggcacagaggcacgtggatcagcatgggca

SEQ ID NO: 117264 - DNA, 362 bp, Homo sapiens
gttaccatatgccctcatgaaagttacttaaaattaacttatctgagacccaatttcctgctctgtaaaatgaaaataccaccaacccacctcacagatatactgtgaggactaaacccatgaaaatatacttgtgccgggcatggttgctcacaccttcaatcctagcactttgagagctgaggcgggtggatcacttgaggtcaggagttcaagaccagcctagccaacatggtgaaactctgtctctactaaaaatacaaaaattagctgggcacagtggcgcacgcctgtagtcccagctacttaggaggctgaggcaggagaatcgcttgaacccgggaggtgggaggtggcagtga

SEQ ID NO: 117265 - DNA, 297 bp, Homo sapiens
aagaaagcagcatttgagttgaattgagacagaaggtatcatagtcctctgccagcctctaagtcaagtaaagagattccaggccaaaggaccagcagtacaaaggcagagagagatggaaatatggagtatgcaaaaaatgatcaccttttcaccttaatctttctaactagtattagatagagcaaatacatcatttttttattcaaccttgaatctcaaggctaaagttagatgacttaagaattttttaaaggtccaattatttcatttagggctaacattgcagctaaatta

SEQ ID NO: 117266 - DNA, 279 bp, Homo sapiens
ggcccttgtccacactctccaagcacattacagggtacctgattgctacacgttcagaatgcatttgctgttatcctgcttggcctggccaggcctggcacagccctggcttccacgcctgagcgtggaggacacgagttagttgtagtttggcttgcggtggggctgacttcctgttggtttgagcccttttttgttttgccctctgggtgttttctttggtcccgcaggagggtgggtggagcaggtggactggagtttctcttgagggcaataaaa

SEQ ID NO: 117267 - DNA, 261 bp, Homo sapiens
gtgttcgtctactgtctctttcctactcagtggcattgcttctgcagtttcttcctctctctgtttgtctgttgttggtgtataagaatgcttgtgatttttgcacattgttctttcgagggattttgcattaaaaagaaattaatatttgcatgctgatgggaacactcaggtgagaaagaaaactttataggaaagcagagagaggaagaaactgcagaagcaatgccactgagtaggaaagggactagattcagagca

SEQ ID NO: 117268 - DNA, 859 bp, Homo sapiens
caatgggaaaataattctagggagaaaataactatgtaggaaaaaatattctttgtcttacatcttacaacaaaataaaatctaagaggcttcacaaggtaattaaaaatatatatatatttaaaaagagctagaagaaggaaaaagagacagaaaataaaatagtttagttgaaaaacagatctccacatggagatccactttctaaagaacaacaatgcactttgggaggccgaggtgggcagatcagctgagaacaggagttcgagaccagccttgaaaccccgtctctactaaaaatacaaaaaattagccaggccttatggtggacacctgtaatcccagctactcaaaaggctgagggaggagaatcgcttgaatctgggaggaagaggttgcagtgagccaagattgcaccattgcactccaatctgggtgacaacagcaaaactccatctcaaaaaataaataaatgataaaaaataaaataacaatggataaaaatcatgaagggaaaacatctatatatttcactacttaaaaatgtaaaattttgttaataagaccccataaacaaagttcaaataggagaaaatattaacacataaatagaaaaatataacaacaacagacaagtcacgaaaattttctagtctaaacctaaaaactcaataattttaaaatgaaaattacaagataacatattttctatcaaattactaagacttttacattaatagcacataatatacttggtatattgcaagtgtttcataagtatttgttgtatgaaggagtgatgaagtatattaaaagttagctactccaggccatgctcagtggctcacgcttgtaatcc

SEQ ID NO: 117269 - DNA, 142 bp, Homo sapiens
actcttaccttctctactctccgtcttccacgacatcatgactagtacaacccctgcgcattcagttgtttctcaaaaagacatgcaaaatattttttgtatgtcttgataaatgtgtgtaggtacctctatggactagatt

SEQ ID NO: 117270 - DNA, 465 bp, Homo sapiens
gttttcccagggttatccagttaatacttttgctaaaagctataattttaaggaaatacaaaaacactgtactttgaatttaaagatatttaggcagaagccatcagctcattatcttaatttaattaagcttttcatagccccatttgagaagaggaggaaccattaaagcaaaaataagttgattgttaggacaagttaatgttggtagaaaaagtttttttttagttgttcttttccccctttcttgtggcccttccaataaattaagattattaccatttgcttcatgagaatttgctttatttatttatttatttattgaggactgagtttcactcttgttggactgaattgttataattggtaaatttaaaaacttctgtgttgtgatcaccaaatatctacagtatccaaagtggctcctggatagcacagatgggactcagggcctgtggaaaagta

SEQ ID NO: 117271 - DNA, 938 bp, Homo sapiens
  misc_feature (780)..(780): n is a, c, g, or t
  misc_feature (874)..(874): n is a, c, g, or t
  misc_feature (900)..(900): n is a, c, g, or t
  misc_feature (910)..(911): n is a, c, g, or t
aattcataccctatcattaaatccaatcaactctacattcaaaataagtccttaatctgaccacctcatctcctctactaagaccacctggccaagccacattacaacccaccaactagactattgcaacagcatgctctctagtctcctagctttcacttttaccactctataatccattccccatatggtggccagagtgactttttaaaatttgaaagaaagctgcggaaaggcatagtacaaagaactttttcatactgctttgaagtacattatcttctccattatttatagtaatcctgagaaataactatagcaagtttactttctttttcatggatagacaaggctcagagaagtgcactgatttgcccaatattacacagcgaataattggcaagatcatgactggccttctaaatactatcaattatgccattcaagtccctctgcatgtatgccacttattaatcaccctcataaatcctaacatcctttcaatgcccagaattacagtaatgtttcaaaagaacagctagaggtacagaaacactatgattttcaacccggcctacaaatttctttcctgctaaaagcataatgcatgctctgactacaggtctaccacatggcaagtgtttttgtaaagaattaaaggtggccgggcgcggtggctcacgcctgtaatcccagccgggtgcggtggtatagtcctgataccacctggatctgaggtaaactgaatactgtaatcaacaaactggcttacagcttgcnattttctattgattatggtttcctcagtaaaacacagatgtaagaaacaaaaaggactactactcagcaataaaaaagaatgtattactgattnacacaataacatggatgatctcaaantattaacaanntatgatgtgtatagcgatcctctaggc

SEQ ID NO: 117272 - DNA, 265 bp, Homo sapiens
gagatttttaggcagctgattttgtgtcttttttctccagctattcatcaagatcatgaggctgggtgtggtggctcacacctgtaaacccagcactttgggaggccaaggcaggaggatcatttgagctcaggagtttcaggccaacctgggcaacccagggagaccctatctctacaaaaaatataaaaattagctggttgtggtggtgtgcacctgtggtcccagctactcaggtgggaggattggttgaggccagaagttt

SEQ ID NO: 117273 - DNA, 586 bp, Homo sapiens
tccttacttactccccttcttcggctagagctcagggagctagagatggtcctggttagagaactaccttatttcctaaaagtcctattctcattctgctggagtcccctctggctatgcaaatgctgaggggaaggagttttggaggacttaggcagtcctgatgtaagacactcccaacaggatcctatcatcattttgggtagtgggaaatttaccagggcccagctcttctctggaacccagcaccaactgctttaaccaacagttaaagggaagagcttgggaaaagccctgcgtttctccttgggtggggaaatccttccttaagaagaccatctgagttacattctgcttcttcttcttctttttttttttttgagacagagtctcactctgtcgctaggccagagtgcagtgacgcagtctcggctcactgcaacctctgtctcccagcttcaagcgattcccctgcctcagcctcccgagtagctgggactacaggcgtgggtggcgggcacctgtaatcccagctactcgggaggctgaggtagagaattgcttgaacctgggaggtggaggttgc

SEQ ID NO: 117274 - DNA, 177 bp, Homo sapiens
cacagtcaggcccacagcaagtgcttagaaatgctgggagggtaggtggctgggaggcctgtctcaagtttacttttgtgcctactatatgccagacactgtgacttaggggagtggaacaagctttgtcacacacacacctaggttgaagtcctgctccaccattaactttctagc

SEQ ID NO: 117275 - DNA, 253 bp, Homo sapiens
ttatttgagagatggctgttctctcacctgagcggaaattgaacacacagcttgttttattctatatcataggttctatgggcttgtcctctctttataggaaataatagaaaaccttcaacagatcggccgggcacggtggctcatgcctgtaatcccagcactttgggaggccgaggcgggcggatcacaaggtcaagagattgagaccatcctggctaacatggtgaaaccctgtctctactaaaaatac

SEQ ID NO: 117276 - DNA, 276 bp, Homo sapiens
aaagctaggtgtagtggtgcatgcatgcacgtagtcccagctacttgggaggctgagacaggagcccaggagatcaaggctgcagtgagccatgattgtgccactgcactccagcctgggtgatagagcgagaccctgtctcaaaaacagaaacaagtttgtatgagatgctaggctgtttctgagactatcacaccccctttcctatgactcctgttacggtgaggaaagacagaaggctgttattactgagacctcaattcacataacatgaat

SEQ ID NO: 117277 - DNA, 2574 bp, Homo sapiens
tctctttctcctccacgtggggacgcaggatggcggcagcagtggcggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaagaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaacta

SEQ ID NO: 117278 - DNA, 1002 bp, Homo sapiens
  misc_feature (44)..(44): n is a, c, g, or t
tggacaggcccgcgcgtaaatcggacgaggggcggcagcagtgncggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaagaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtgggaggacggtcccaatcttgctccagacggacacaagctgagaccagacggggggcgactggagccggccgggaacaggcccagatgatccggcggcgacgggcaggtaccaacaagcgcaggggagccgcaaccgcgcggagggtggcactcctgggcggaagagaagacaaaggctcaagcaaaggaaccccgctccgcgcgccaactcaa

SEQ ID NO: 117279 - DNA, 2853 bp, Homo sapiens
tctctttctcctccacgtggggacgcaggatggcggcagcagtggcggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaagaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaactagcatcttgctccttcttaccctcctccacccttgtctgtgcttttgggttttgcgcgtcacctagctgtggtgcttggcctccaccttgcacatatctgcagtgaggctacataagaagcgaacaaaactatcagccactgagctccttggtgccagctgtttgtctgctgtgctctcagactgcaccaggcctggaaggttctcaagctccaaaacttttgatgaggaaacaacataagaaatgattagcccatgccctcacatctagtaagagaaag

SEQ ID NO: 117280 - DNA, 2709 bp, Homo sapiens
tctctttctcctccacgtggggacgcaggatggcggcagcagtggcggtgggtgtgcgtggatgggggcggggggcgtcgccgcggggcgctagggcccgggtccctgaggcctgagagaggcgaagtggggcccttctgggcgggcgaccagactgactcccgccccacttgctcgcgcaggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaagaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaacta

SEQ ID NO: 117281 - DNA, 2603 bp, Homo sapiens
tctctttctcctccacgtggggacgcaggatggcggcagcagtggcggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtaaggacagctgcagactcatggagggggtacctggccagtggctctggagacaccaccgtgcgcttctgggatctcagcacagagacaccacatttcacatgcaagggacacagacactgggtccttagtatatcctggtctccagatggcaagaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaacta

SEQ ID NO: 117282 - DNA, 2611 bp, Homo sapiens
tctctttctcctccacgtggggacgcaggatggcggcagcagtggcggtgggtgtgcgtggatgggggcggggggcgtcgccgcggggcgctagggcccgggtccctgaggcctgagagaggcgaagtggggcccttctgggcgggcgaccagactgactcccgccccacttgctcgcgcaggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaagaagctggcctcaggctgcaagaatggccaggaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaacta

SEQ ID NO: 117283 - DNA, 1019 bp, Homo sapiens
tctctttctcctccacgtggggacgcaggatggcggcagcagtggcggtgggtgtgcgtggatgggggcggggggcgtcgccgcggggcgctagggcccgggtccctgaggcctgagagaggcgaagtggggcccttctgggcgggcgaccagactgactcccgccccacttgctcgcgcaggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggtacctggccagtggctctggagacaccaccgtgcgcttctgggatctcagcacagagacaccacatttcacatgcaagggacacagacactgggtccttagtatatcctggtctccagatggcaagaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaacgagaggctctgaaccgatacaactcctgcgggcaggtccaaaaagctgtgtctggccgagattacttttcctggggcccgcaggaaaagcctccc

SEQ ID NO: 117284 - DNA, 616 bp, Homo sapiens
  misc_feature (1)..(1): n is a, c, g, or t
ntatcgatgccacctttctactcctatctctttctctacttccttcaaggctaataactcttaaatttgtccttttgaggctattttcttgatcctataggtgtgcttcattttttttattcttttttcttttgactcttctgtgtattttcaaatagcctgtcttcaagctcagtaattctttcttctgcttgatcaattctgctaattaaaggatgatgatgcattattcagtaagccaatggcattgttcagcttcagaatttctgcattattattcataattattttaatctcttggttcagtttatcagatagaattctaaattccttctctgtgttatcttgaccttttttggagtttcctcaacacagctatttggaattatctgtctgcaaggtcacatacccctgttcctccaggactggtccctagttcttattgacttctctttcagtttactaataacatcttcctgttcaaactgaattttaatttcattgtgctctgaattccagatatcgtattttcagtactagaatttccatttgatttttttcacatatccaattatatgataaaattctccattatttcatctattttatttctctt

SEQ ID NO: 117285 - DNA, 389 bp, Homo sapiens
tggagatgtacatttgaaagttgtgtgtctttgctatacaagccatgagactgggtgggatcaactagaaaatgagtctagaaagagcagagaataagtctggaggctgggaaatgccaatgtttggaggttggaaacgtgaggaagaaccaatgaaggaagcttcttaaccttgtgctcttggatgttgtaccatcaacctcaagctcttggatgttgtacatgatgatcacttaagcagatcaactttttggttaatatcactgaattttctatatctagttttagtttaggattccaatgaacctaggaaccaaaatttggaggctattactaggtgctaagtcacacattcggataaggaaagtattaagcttatttccgactag

SEQ ID NO: 117286 - DNA, 413 bp, Homo sapiens
ccttgagtgaagtcctgggagaccttcactcaaagtctcctagtcactcaataccttcacgctagacccttggagccccatgctactggacaccccaccagagggagatggatgcctagtgctggctgcatggtgggaagggcctccccatggaaggaaggttggtcaaggcttggtggtgagagcagggcctagcagtgctctactctgcagacattggctgtcaggcccttccctggaagttggctgagcatctcagcccaatgtgaggtgtgggcaggggtgggggtgatgcaggctctgcccatagaggcttgcagtctcagggcagacagcaaccgaaatggagaccccatcgtgtggggaagtgggaggtgctatgggccgggagaccccgacccagaccaggaggt

SEQ ID NO: 117287 - DNA, 329 bp, Homo sapiens
cccccctggtctctgaacttaggcctggtctggacatgaaggtttggcagcaaactgtcaggacccccggagagaaccctgactcctgtgccaacccaactgtgtctggctcaacgctcgacgctcaaacacagcaaacggcaagaaggcaagtccaggatatacgttttggcaaaaatggcagccgtgggggtggaggtggaggaggacatgcacggagggcttaaacagggctgtgtttttttttttttcttttagatggagtctcactctgtcacccaggttggagtgcagtggcggatctcggctcactgcaaactccaccccct

SEQ ID NO: 117288 - DNA, 436 bp, Homo sapiens
cttctcacgcactccaagtgcagccggaatgagctttgcaaaatgcaaatcagagcctgttgttcccctgctcagcaccctcctggggcctccccagttctcctggtaatccccaatcccacctggtctcccaggcctgcagggtggtctcagccacccacaccagcccagacctcaccgccccttcctgcctagctccctcctcagggtccccacaggcccgtcgcgcctggagtccccctgagatgtggtcacttgtttcaacgtccaacttctggacacccgacattccccaatgactgaggtccctgccccctccttcagggagcaccacgcctgtgccagtcctcccacagctctggcctaaatcagaccctccaaaggaggaggaggctactgcctccgtctgcctgtccctaagtctggcagcggcata

SEQ ID NO: 117289 - DNA, 345 bp, Homo sapiens
aggagcacggggagggctcagtgtagccgaggcagagcaaatgatggggacagtgacaagaggcagggcaggagggacaggaacagtcaggccacgcaggccttggcacccatggcgaggagatggattttgttccagaaggaattgggaagcctttgagagctcttaaatgggggaagttgtataatctgattgacattttaaaggatatttcaggctatgcttgggagaatcagtggtgatgggccagaatgaatagaggacgccaacgtggaggtcacagtggtgagcggctttggagatggggaagtaagaaagtgctttctgaacatatttaggaggctg

SEQ ID NO: 117290 - DNA, 325 bp, Homo sapiens
gccaaaatatggaattgctcttaactcttcccctcctatctcccaccaggtctttccccacccactgccctaaataagcactgggtgtggtcagtgctgcttagaaccacctctcacttccattccctctcagtcccactgaggccaacctaattcgggtcttcctcatctctcaggtagatctgtattaccaaatagtatccttactggtgtccatgtctttaatctttgtatgttttgttttttttaatgacctgttttaaatacatgaaacagtgaaaaagattttcttaaagcacataacccaacacgcagatcaactgtt

SEQ ID NO: 117291 - DNA, 223 bp, Homo sapiens
ctatggaacatggactttgaacctctcttctttttcgtctccttgctttgatttaatccatcatttctaggtgcatgacaacactccctaacttaacccccctgctttcccattttaactaccatcacaataatcttaatactggcaggtatctagcacttggcgattttcaaagagcttccactagttccttgctcggaatcttgtgatgcaggcaggatag

SEQ ID NO: 117292 - DNA, 483 bp, Homo sapiens
gcttggccagacgtggtggctcacgcctgtaatcccagcactttgggaggccgaggtaggaggatcacttgggttcaggagttcaagaccagcctggtcaacatggtgaaacctcgtctctactaaaaatacaaaaattagctgagcatggttgtgcatgactgtaatcccagctacttaggaggctgaggcacgagaaccatttgaatccgggaggcagaggctgcagtgagccaagatggtgccactgcactccagcttgagcaacagaatgaaactgtgtccccccaccccccagaaaaaaaaaaaaaggaattggctctaatggtgcaatgactcatcctgaaattcgactaaggttctaaatacaaacttggaattgtcatcccagactcaagagtgagacctaggacctagggttagttcttttttattcacattttcacatggtacccatgtgtgcagaactgactaaaccagata

SEQ ID NO: 117293 - DNA, 262 bp, Homo sapiens
  misc_feature (45)..(45): n is a, c, g, or t
  misc_feature (71)..(71): n is a, c, g, or t
ggcttctcatcccctagtacacaaagcatcaagccttggcctctnggaggctctgggaccccaccggaggncaggaccatcaccccctcagcccccagaagaccaggaggcctctcaggtcagcccctctggtcagtcaaggaaattgaggtccacggaagcagcagggcccaaactcatactcccagcccttttcctggaaccagcagaacatgaaccctgctggggaggggcggaccagctacaccaggagaccaggacc

SEQ ID NO: 117294 - DNA, 677 bp, Homo sapiens
tcggaggcacttgcagccaacaggttgcctaagcaaagccagccagtttatggcagcattgactgggagcccagtgggagccctagggagctggttccttctgtaccaagtaatgagcaactgacatcatccatgggtgactctggaaaatctcaggctctctctggtggtttagcaactgctcaggtccctcaaggtgatgtttaatagcttttttcagcaacaggggccgtctgccatagatacggaaaggcactatttattaggatgcttgttaaatgaagtgctgataatcaagaactcatagtaggacaaagctgactgtattttctaaaacactcataaaatatcccagaacctcatgctgttgcaaaatcctgcagttctccgatcaacagatggagtcttggccgggttgaggctcacgcctgtaatctcagcactttgggaggccaagatgggaggattgcttcaggccaggagtttgagaccagcctaggcaacttagggaaaccccatctctacaaaaaatttaaaaattagtcgagcatggtggtgcacacctatactcccaactactcaggaggctgaggaggcaggattgcttgggcctgggaggtcaaggttgcagtgagccatgatcagaccactgcactccagcctaggaaacagagtga

SEQ ID NO: 117295 - DNA, 1003 bp, Homo sapiens
ttagataagtgctaaataatccccagctgtaaaattctaagaataattaaaacttcctttcttaacattcttagtgaacaacttacaggttaaaaaacaaacccaaagagattatttcctgcaaagagcctttagtatggtagcacctacttctagaaggcctgtcataaactgtcatctagtgaaagtgatgaagaagagtggctgggagtcaatcttatcaggagctggaacaggtgaagccctcaccagtgaaaaatcttgacagatgcagctactaagatttcctactacaaagaataacagcagttagaaaagcagactccctgtggtggcgaccagtatcttcaaactcataccagagtaaagccttatccatttggagttctttctgatgcattatgtgagaaaaacaagcaaacaaatgaacacttatttgtatttgaattgcactaaatttatacatgaaactgaaaaaaactgatatctttatgaagctgcataatcctatccaaggacagacgtctccttccatttgcttttgctttactaatttgaatctatgttatttgttttggatacatctggaattgacttttttgcatggtgtaagaaataacagttcttcctggatcagccctctcccgtctgtcatctccaacagatacaaagccagctttaagaagaccaaacctacaaaaatcattcatgctttctgcctccatgtttttctttccaacctagttcctccagaaaatgtaaaagagcaaccgaaccgtcaactggtacaatgacttctacacatcagacctcggccacgccacagtcatcagattattctatcacagggtctctcaaccgtggaatatggtctccaagggaaacaagccacagagggctcaggagcattgctataaagagtaggcaaatggaaatctttccccaaagggcacactgggattgttaggcgagggctgctcaatccattaaaagtttaaactcg

SEQ ID NO: 117296 - DNA, 484 bp, Homo sapiens
taacacccacttattgtggcttagtccttgtacatataacgaaacacacacacagaaactggagtttcaaggcttattttcaatatgtataatcctgactctgaagttgtgtcataagtcaagaaataactttcttcaaaaccgtttccaatattgctattattttctgtgaaaaaaggtgaattttcttctacaattatgtttatttaactcaatttcaaaagccttttccaccttcctagtgtacatttttctatcaggttaatatcaaaggccttaatcgtatgtttgctttacgaagatccaaggtatctgtctcttatttttctcattccaggtccttaaatatgactaaatctttagagacagttgtggtcgtatcaatttttaataaccaaaaagtatgtttcattgaagttcttgaaatataaattatgtatcactgtttaccactgctccaaaggaagagctaaaaatcaacagt

SEQ ID NO: 117297 - DNA, 454 bp, Homo sapiens
caggggtgtgtcgtgcgtgggctgtgtgtgcaggggtgtgtgtgcatagcggtgtgtgtgcaggggtgtgtgcgcgcaggggtgtgtgcgtgtgcacatctgtttatgtttctgtgcacatgcctgcacatctgtgtgtacaggggggtgtacaggtgtgtgtatgtatgcatgtctgtgtgtgcctctgtgtgcatgtcggtgtgtgtatgtgtatgtgtccgtgtggggcatgcaggtatgtatgtgtgcatgcaagtctgatacttgaatccagtagaaaccagagaggaggagaagctggtgttagctctctcttcatgactcccagctctttccttttataatgatcagagaaggactcttccaggtctctttggcatcaggaagggacccacgcacacagccctgcacacacacccctacgcacacacacctctgccaggaacccacg

SEQ ID NO: 117298 - DNA, 644 bp, Homo sapiens
caggggtgtgtcgtgcgtgggctgtgtgtgcaggggtgtgtgtgcatagcggtgtgtgtgcaggggtgtgtgcgcgcaggggtgtgtgcgtgtgcacatctgtttatgtttctgtgcacatgcctgcacatctgtgtgtacaggggggtgtacaggtgtgtgtatgtatgcatgtctgtgtgtgcctctgtgtgcatgtcggtgtgtgtatgtgtatgtgtccgtgtggggcatgcaggtatgtatgtgtgcatgcaagtctgatacttgaatccagtagaaaccagagaggaggagaagctggtgttagctctctcttcatgactcccagctctttccttttataatgatcagagaaggactcttccaggtctctttggcatcaggaagggacccatgctttggcaggccttcctaggaaaggaggggcatttacaccaaaacagtacgggattgtgtctgttgccacgggtagctgatgccagaaacagccagatctgtgagctgcaggaaaggctaagggacagccacagtcgatatggagtccccctccactgctccttcccttctttcatcttagtctatgtggaaccaggctaagcctttggagtcaaacgtagttgcagctgaagtcacatgtagtt

SEQ ID NO: 117299 - DNA, 303 bp, Homo sapiens
ccattcattctcaaggtgcctgaaagaaaaggctggtgtattcaaaccagtttgaggagtgcttcacaacgggacatttctagggggaccagcagggtggaaggaagccagcaaggcgtacggcaggcctgggggttaaggggatggcgaagcattgtcggggagggggctgcctagtttcactgtagaggcagcagagaagggaccaacccaggctcttatgcctcatgccctctgcccactgttcattgccctgatcagccaaaccccacaggagccctcgatgtgccactgtgggtgagt

SEQ ID NO: 117300 - DNA, 1662 bp, Homo sapiens
accgcctccacttcctgtgtccacggctgtcgcgagagcccggggcgagtgggcctctgctcgtgggtggttctcgtggaggtcagctcccgcgtgtctccgctcgacagggtgcttgggcagagcccatcgggtaggcgcgggccatggcgcagtacaagggcaccatgcgcgaggcaggccgtgccatgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaaggcgctgcaggggctgcgcaaggacttcctggagctgcgctccgccggcgtggagcagctcatgttcatcaaggaggacctcatcctgccgcactaccacaccttctacgacttcatcatcgccagggcgaggggcaagagcgggccgctcttcagcttcgatgtgcacgatgacgtgcgcctgctcagcgacgccaccatggagaaggacgagtcgcacgcgggcaaggtggtgctgcgcagctggtacgagaagaacaagcacatcttccccgccagccgctgggaggcctatgaccccgagaagaagtgggacaagtacaccatccgctaacacccgcctgccagagcggaaaccgggggtggggggagacactcatttctaggccccatcaccagtcacttgatttcgtgaccttgatttcttcccccaaatttaataaagacagagggttctcatgattcacattggttgtgctattgctgatgttatgctttggttgcttggttggtcttttctgagtattttagtgttgccacctggatttgctgcattgctctgctgagctgtattgaaaccatgactgggcccactgtcagacagaaattagaataggaggcacattttttacctggtggttatgagcatggacttgggggccacagtgactgagtttgattcccgacacagcctcctccttgctgtgtagttttgggtaagcttattaaacccccatgcctcagtttggtcacctgtaaaaggaaataacaagagcacttactttataagattgatgtgagtattaagtgaattaatatttgtaaaacgcttagctcttaataaatgtttctgttgttattaaaaaaaaaaa

SEQ ID NO: 117301 - DNA, 1964 bp, Homo sapiens
accgcctccacttcctgtgtccacggctgtcgcgagagcccggggcgagtgggcctctgctcgtgggtggttctcgtggaggtcagctcccgcgtgtctccgctcgacagggtgcttgggcaggtaagggtccgctcagtagcccaaccctctctgtatgcagctccccaaattcagcgctgcgctcaggcatggcagccacccgttacgtggggccgttcgcatttgcatttattgaggtcaaataaaatgctggaaattggtgcctggtgacactgtcaggttggtggttaccctagcaggtcggcccagcccctgaacgcttccatcactgccgaaagccctgtgaggaggcgcagagctgagcattccccgccgttgcgtgggcccccctctacctgccgcgtttttcctctttgctgcagagcccatcgggtaggcgcgggccatggcgcagtacaagggcaccatgcgcgaggcaggccgtgccatgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaaggcgctgcaggggctgcgcaaggacttcctggagctgcgctccgccggcgtggagcagctcatgttcatcaaggaggacctcatcctgccgcactaccacaccttctacgacttcatcatcgccagggcgaggggcaagagcgggccgctcttcagcttcgatgtgcacgatgacgtgcgcctgctcagcgacgccaccatggagaaggacgagtcgcacgcgggcaaggtggtgctgcgcagctggtacgagaagaacaagcacatcttccccgccagccgctgggaggcctatgaccccgagaagaagtgggacaagtacaccatccgctaacacccgcctgccagagcggaaaccgggggtggggggagacactcatttctaggccccatcaccagtcacttgatttcgtgaccttgatttcttcccccaaatttaataaagacagagggttctcatgattcacattggttgtgctattgctgatgttatgctttggttgcttggttggtcttttctgagtattttagtgttgccacctggatttgctgcattgctctgctgagctgtattgaaaccatgactgggcccactgtcagacagaaattagaataggaggcacattttttacctggtggttatgagcatggacttgggggccacagtgactgagtttgattcccgacacagcctcctccttgctgtgtagttttgggtaagcttattaaacccccatgcctcagtttggtcacctgtaaaaggaaataacaagagcacttactttataagattgatgtgagtattaagtgaattaatatttgtaaaacgcttagctcttaataaatgtttctgttgttattaaaaaaaaaaa

SEQ ID NO: 117302 - DNA, 634 bp, Homo sapiens
ccagggcttttgtttgactcatttaagtagtgatgtatgatatcagaatagtcttttgctcgtttgtggcctaatgttttaaaaaacatgtgatcacccaggcactgtggctcacacctgtaatcccagcactttgggaggccaaggtaggtggatcacgaggtcaggagatcgagaccaccctggccaacatggtgaaaccccatctctactaaaaaattaactggacgtggtagtgcacgcctgtagtccccactattcaggaggctgaggcaggagaattgcctgaacccgggaggtggaggttgcagtgagcagagattgcgccaccgtactccagcctgggcaacagagtgagactacatctcagaaaaaaaaacaaaaaacaaaaaacagtatgctctcctccagttcagtcaactaaaagcagttgaactcccacaatgtaaacagcaatgtgtatgtagtgctgtgggtaacccgggatgttaaatggcccttccctcctctcccccgaccacacagaacatatgtccttgttgggaagatataacacatgtaagtggaaatacaccatgaaccccaagagtgtttaaaagcagtatgcaatgagatccagaaagtcttagatgca

SEQ ID NO: 117303 - DNA, 292 bp, Homo sapiens
ctaagcggctctccaggttcttctcatttccctgtggtgtctgcacacatcctgcttaggattttcccgcccgatacctgtaccccgggttttgcgctgacacatgctccattgcttcctcgtgagagctttgcctttatctcaggcggggtgcgttttccgtgttttctgtggcaccctgtagaaacacgtggcacccttgccctctgtggctacagctgagcagacgctgggcggtgctgccctctgcacctttgggccaggttagctggggcggcctctctgccatcgg

SEQ ID NO: 117304 - DNA, 614 bp, Homo sapiens
ctaattttgtattttttttaagcagagacagggtttcaccatgttggtcaggccggtctcgaactcccgacctcaggtgatctgcccacctcagactcccaaagtgttgggattacaggtgttagccaccacacccagctccaaggcatattttctatggaatatatcaagacaataaatctgggggatctggaattagcttttgtttgtctacggccacccactaataaaatactttttgatttggcacttctaggacatatctctagtaactcacttatattcatttattcttcgacatacaatgttgtctaaaaatcactggacatggagttagaaaacctcagtgcaaatcctggctttgttatagtgtaaccttgaacaagtcacttggcttctacaaatctcagggtttttttgtttgttttgtttttttgagacagagtctcgctctgtcgcccaggctgaagtgcagtggcacgaatctcggctcactataagctccgtctcccgggttcacgccattctcctgcctcagccccccgagtagctgggactagaggcgcacatcaccacacccggctaatttttgttgtattttttagtagagacag

SEQ ID NO: 117305 - DNA, 417 bp, Homo sapiens
ttcaacctctgtcaccagaatcatatgattcaaatgatcctcctgcctcagcctctcaagtagctggtactatagtgaaggaaactcatgttgactgaacacctcccctgggatgtgtgggacctgggatgagaactttcacatagctgctgtgttcatgtccatcaccaccctgtgaggtggatcccagcaagatgacttctaccctacaaagaggttgagaatcctgtttcaaatgctggatggatccctgtgaatctgtcactttaagaagggagactgcccagtgaaagcagtggaaagaaaaagagcgttaaaagatgaggacactgaagcaccgagaaggaaacagaagattcaggacaaagccagctctgtctcctgtaccaaccttgcatgaaaaacaaccaaggaaat

SEQ ID NO: 117306 - DNA, 713 bp, Homo sapiens
aggctccaattcctcctgattttgttctgtttttcccttcgggcatccaaggcagccacctgcccaggcctgggcctgttcaaacactgtctccgctgtactccctagctccttgaacccctacattgtctgcattcaggaagttttgtggctttttaggattttttttaaacacagggtctggctctgttgcccaggccggagtgcagtagtgtgatcatagctcactgtaacctcgaactcctgggctccagccataggaagcttttaataaaacaacctttgctccgaccgcaccctggccttgctggataaagccaggcctctctcttgggttacagcaggcccttcaggacttggctgcccctctctgttccagcttctcctgatgttcctcgctcaccccagaactcctttcccaaaactgagggaactccagcttgtccttaagatctcagctctgcccagtggtctccttagactgggtgtgagggtcccgctgtggactccctgagcttagggagagggcagatttgttcctgctctctcaggcccagtttaggcctcaagacaagagcccaggttgtctcctcagagctcagaatgctgccaccacgtgtggtcagaccactattggcccagctctaaccagtaactggagcaaggcttaggattgctgagaaagattgggggcagcagagaagcttctaaga

SEQ ID NO: 117307 - DNA, 659 bp, Homo sapiens
gttgatcactgacagcaacccacgtggttattgggagtttctgagttaaagaaaaaagggtagatctgtttaccttaacattaagatgttacatttatggaattatacaacaaaaaagataaaacgataaatccaccaggagagaatattttcaagatgcgacggtcaaaggattgataactagaatgtataaagaacctctctaatgaaagaaaacaatacaacatgatgtaaaagtgagcccagaacacaagttgacatttcatagaagaaacacaaattgccagtagacatgaaaaaatactcagttccattaggaacaaggaaaatgcaaaattaagccacaaataatagactattatttacccatcagttgctatgtgctgacaggaatgaggtacactgctggtgggaatagacattggcacaaccattttggaaaataatttagtattgtctttcaaatttcaaccttcataatttctgtgatcctgttgaaatatctgtacatgtataccatgagaccttttagacatgtttaaacaccattattctcttaaaagacttaaggaacccagaagaccatgagcaggggattgcattttttaaaaatgtcatatacatggccgggcacggtggttcacacctgtaatcccagc

SEQ ID NO: 117308 - DNA, 428 bp, Homo sapiens
atgaggccacagttcccagaaagaagggaatggaagagcagagagttcagttcactctttggctccacttttcccctcatggcatttgccaatttgaaagtggaagacaagaggctaagaagctgaagggctctggacagcctctcaagactggggaaataaaaactggaattcagaaatatcgaagagaagccctggtaaatactccaaactcttgagttgggacccagtgaaggaaacaagaaatataccactccttaaaaagactgatacgttaggccacaaaataagtcttaataaattttcaaagactgaaatcatataaaacatcttttctgatcacaattaaataaaactaggagtcaacagcaaaagggaaactagaaatttcccaaatatgtggaaattaaacaacatactcaaaaaac

SEQ ID NO: 117309 - DNA, 243 bp, Homo sapiens
tcatatttcactcctacaatattctccagtcagctggtaagaaatttggaaaagtctctttaggagaactcatatctctacacactaacattgtgggggccccagcctaataaatcagctcccagtggtgtggtagtaaaccagctctctgggaggaagtatgctcttgcttgaagaattttttggccaggagttcaagaccaacctgaccaacatagtgagacttcatctctaaaaaaaaaa

SEQ ID NO: 117310 - DNA, 542 bp, Homo sapiens
atgttgaaagtatttcaattcatctctatttcatagcatctcagagatgtatcacagccactccaattcctaacaagactgagcaaaaaccagaagcttctgggtaaaagggatttaaagtgtttagaaccctttctgagaattttaaattgaggtataaaaggtataaaaggaatctattttttataatctctcttctcttgtctaagtctctgaacttttaaaggagggtgatagcccatgcagagtagtagtcatgaagggtcaaaggaccgcgagtcagaagagctggatgtgaattctcaccccacccctgagtagctatgcaagcttgggcaagtgtctcaacttcccttagtgtccttgcaaaagccatctttgcaaaacacttcctgaccaagtcttcctctgcttgctgtgtgtccccaaggctgtagatcatttagaagcccagttgacatgatttcctccatttactcattggtagaagatgtcaagaacaatacaaatctacatgaccttcattgtccacacaaagctct

SEQ ID NO: 117311 - DNA, 265 bp, Homo sapiens
agaattgcttgaatccgagaggcagaggctgcagtgagccaagatagcgctgctgcactccagcctgggcgagagagcgagacttcctctcaaaaaaaaagaaaattaaaagcctaagtgaatggaaagatctcatgttcacggattggaatacttaatattgttaaaatggtaatgctactcagttgatttatagatcccacacaattcttatcaaaatctcagctgtctttgttgttgttgcagaaattagcaagctggtcct

SEQ ID NO: 117312 - DNA, 817 bp, Homo sapiens
atcctttgtctcagagccatcatgaactatcaggtaagggggaagcactagccataggtgctctacttcttctgcctcatctgcaaaaccaggagagctaggagggcatcagcttataaaagacaggtttgctggtgggcctacggtcaaggagattggctgggctcccccttccccaccatcaaggtcccctccttctgtcctttcccttgcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagag

SEQ ID NO: 117313 - DNA, 338 bp, Homo sapiens
atcctttgtctcagagccatcatgaactatcaggtaagggggaagcactagccataggtgctctacttcttctgcctcatctgcaaaaccaggagagctaggagggcatcagcttataaaagacaggtttgctggtgggcctacggtcaaggagattggctgggctcccccttccccaccatcaaggtcccctccttctgtcctttcccttgcagtacggattcaacctggtcatgtcccacccccatgctgtcaatgagattgcacttagcctcaataacaagaatccaaggtgagttccttccctcccctttcctccccactctgtccagggctct

SEQ ID NO: 117314 - DNA, 177 bp, Homo sapiens
actactttgaatgaaaagaaaatgtgctaatgtgctgtacaaaacacacgggtcccaggaagaaaataaaatagcagcccatattttcaagtgatagcaggttgtaccctgactcagcaccaatccatccaaatcctttagcagctttaaaatgtggatgtcagccgggcgcggtgg

SEQ ID NO: 117315 - DNA, 355 bp, Homo sapiens
ttcactgagccttgtgggctggagatttgagagtttatggctgaattcttacaacaataagaaaacccactattggtttgttgtatcatccattatacctgaaggccaagttagtgaagaacagagacagcatcattaccaaatgaattaagacattcattcatttgttcatttattcaggcaacagttatcacccatgccttttaaccaccaagtccttgcatgctgtacactatgctgaacacttaaagagaaataagacagaatcttgggggaggaaagcagttgtacaaagggttgattgaaatgccaaggtagagtgctatgatggaggtttgcacaaggtactgtggac

SEQ ID NO: 117316 - DNA, 218 bp, Homo sapiens
aatatgagcggcaccccctggagttagttgtgcagtgtgtgacatgcacagtgggagacttagccctgcaggactcttggtcctggggcggggacagccctagaagctggtcttcctctttgagggtcaaataaaacggcctcaacatgaagatgagataaaaagcaggacacctgggagaaatggggagcctgggatcttggggacaggggccagcc

SEQ ID NO: 117317 - DNA, 291 bp, Homo sapiens
tttaaacattttaccgtaatagctatcgaggtctcaaggttgtaataaactcttttcctcttttctgaattcacaagcaagtgagctattgatgaaagagtcatacagatggaagctgaaaaagcttctaatttctaaaactgggctggagtatgtggctcagagatgtagccaccatgagtcttcctactactcccgccccattcatctgtgatttttctactggctggacctgaatggcatacgcaccttaggacaacctgaattctaaaagaggagctaaagatagat

SEQ ID NO: 117318 - DNA, 562 bp, Homo sapiens
ggaagagacacgaagagaaggttgtgcatagttagtacttttatctttctccaaagagcaacctaagccaattcctcagagtattggggtgacagagtttgtccacactctttggaaagatggacttgtgcagaggaaaaggtggagaaaggtctgtgttggaagaggcagagtatcccagttgacctacatggctgcccttagccaaagccggaagaattcagtttaccttcctaactagattgtatgtgtaggttgattgccaagacgactcagagaacccacggaatcattttaagaaaggtgctaggaaagggccccaggagaacacacctaatgcttccatgtgaatggaaagtgggaagaaccaactttgactcatgcagttaaagatcttcttttgtgatcacaattccctttgttcttttgtttttcttgggtggtttttgaactgcaagtgcagagctcactcatctgtgcaaatcctctggtatggatttttaaattaatttttcccttcatctccgatcttttctctcattctcctacacacacatcatag

SEQ ID NO: 117319 - DNA, 348 bp, Homo sapiens
gtaagagctggaattcaaacccagaacgctccgcctgcaaaacccaagtgtcttcactttttccagtccaataactctgttatgtctttagcccgacctaaattccagccttagccaatgtcttagagtagtcactggcaccctatattcctttgatctcatggccttctgtgccatcagtcagccagaggtctgccccccgcactgggtcttctgtcctgctgtagtgctcaagatgtctgccaaagaaattcagagattcttccagaagtggctttttacaaagacaggatactcaattacatttagacaaagaatgcccagtccaccactcacatagcaccccag

SEQ ID NO: 117320 - DNA, 461 bp, Homo sapiens
tagttccatgagcaaggtgttaaaaaaaaagaagaaaaatgtattagatctattcacagtttaagaagtttgcaaggcacacactatagcatgttatgggtttttatggagaggattattttacttgtaggttggagaggaaattatacaattgacttgatatcaaatttaagaatttgaacagaaactagtttttaattaattaattaatttatttatttatttttgagatggagtctcgctctgttgcccagactgaagtgcagttgcgcgatcccggctcactgcaacctccgcccccaggttcaagtgattctcctgcctcagcctcctgagtagctaggattacaggcgggcaccaccacacccagctaatttttgtatttttagtagagatggggttttaccacgttggtcaggctggtctcaaactcctgacctactgatccacccgcctcagc

SEQ ID NO: 117321 - DNA, 666 bp, Homo sapiens
agcagcctttccctgggaggagttccctgtttaccctcccttgctggggagaaggcagagcatcgcaggggacttggcctcacaaaggacacagtgagatgagtccttcagggcagggctgccaggaaacagccatagctttgctggaagagggacaggagacaatgacaattgatcgaagcctccagcccctcctgggagagtttggctgtttctttggccttgtcctgatctttcctggactcacctctgtcatccagctggatttgcagtgctggctcaaattgctacttgaaaccagggccagaccaggcatgtgggcacctctggcgagcttgtaacttgacatgccatcaaaataaggcactttaaatgtttgcacaatgaaaacttactagggccagacagaaatgacaaacagatttcctttattattccttttcattggccaagcaattcatgtccaaaaaaatttttaaatcaaaatatctagtaaaacatgctccattattttcaataattctccttctcttaagatatctttcctgtagtttcttacaggaggtaactcttaggaggcatatccaataatttgaaatataaacaagaaaactcattcttaattcatagcagcacatagtacttagtgtccaaaatttctactgg

SEQ ID NO: 117322 - DNA, 230 bp, Homo sapiens
tatggagatgaacctagagccaggttctgtgggaaccagcctggtgattgagttatcctaggctttgagtcctcagggatcctaagtcaatatagaccagcttggaaccaggggttgtaagtgctggcctagagcctggaaccacatgagccaacctggagtctggagtcactagtgctggtcgggtgctgaagtgggtctaaagcctggttctgtggatgcaaccctag

SEQ ID NO: 117323 - DNA, 667 bp, Homo sapiens
gcacgagcctaatcccagaatccagaatggtccaaaattcaaaacttattgagtgcctacccgatgctcaaaggaaatgatcattggagcatttcagattttggatttttggattagggattctcaatctgtttaacacaagtattccaaaatttgaaaaaattcaaaatttgaatgaattctggtcccagacatttcagatattgtgtcttaagctcattatattattaggaaattataggctattatgtaaaattgggctgtgataagttaaagatgcatatttaaaccctagagcaatcaccaaagatttaaaacaaagaaatatagctgataaatcaatagaggagataaagtagaatactagagaactggctaggcatgatggccaatgcctgtaagtaaacactttgggaggccaagggaggaggatcacttgagtccaggagtttgagaccagcctgggcaacataatgagaccctgtatctacaaaaaattaaaaaattagccaggcatactggtgtaaacctgtagtctcagaggctgaggctgaaatgagaagataacttgagcccaggaggttgaggctgcagtgagccatgattgcgccactgcactgtagcctgggcaacagtgtgagaccctgtctcaaaaaaaaaaaaaaaa

SEQ ID NO: 117324 - DNA, 320 bp, Homo sapiens
ttgagcccacaccctctgatactccacgtcagcaagctcctgggctcggccttcaaaatccctgagtttacactttctcacccccattgctgcagcctgccctcgtccccatctcttgcctggagcaccacagagcctccagctgcccctgccctgccctgtccatgcacctgccagagtgagcagcgccatcctagccgcccctgctctttgccccatggctttctgccttggactgggctctgcggggcagggctgccagtttggggtttgcatgttgattttgtacatccagcatctcaggatggctcgccacgtca

SEQ ID NO: 117325 - DNA, 230 bp, Homo sapiens
tcagggccactgccacagaggccacacatctcaccaacttcccagtaaggagcccagtagaacgcttgctatgtggctatgtgcctgtttctctcgcactatttcactctcttgcttccagacccctccgggtagcattcatacccggcagctattccttaggacaaaagggctatttaactattttaaaatctttttcaacaatactttttttcctaacaatgaagatg

SEQ ID NO: 117326 - DNA, 809 bp, Homo sapiens
atctttagagtgtgggacagtttcactctttattttttatttttattttttccttggtagagtaggtatgtaaagagtgtattcccataattattctgaaaaacctaacaccgttaaatagtgttcacttagtcctctgtagagatatttttccttatcatgattttatatcatcttatgttgagccatgctaaatactcactagttgccatccattcactaccagataaaattaaatgatccctaagatattctctcagaactttcttttatcactctatagtttttctatggatgtcttccattatcattgtttcaactattatttcatgaatataagtatcaagatgtactttgtacttttaaggcaaaatatgcatgtttttcttttatttaaacttgcattttcaatattaaacctcttacctctctacataaagtcattctccatctacactgtaacagtgtgttacttgaaaagttcttcaaaaatgtttattgatttatattgttaaagcaaactaaatatggcctgagaatgactacgcccttgtggatgaactgtaacctagcataactggcaaaaatgaaaacctaacttaatagtatgcacctgtaacaataactgagtgttggccaatcccagtggccgtacttcagccactcatagactgctgagtgttcaaactatgttcaagtaaggcaaatgacgagctgtaaccaatctgtttctgtatctcacttttgattgctgtacattactttacctttttgtctataaatttgttctgaccacgagacacccctgg

SEQ ID NO: 117327 - DNA, 166 bp, Homo sapiens
gaagcgacaggccgagaagagaggtggttgtgggaggtctgaagattcaatacttgaaattctagactcgaagggaaaccctccacacttcgcctgcacttacgggacacccagcaagagcagcccccgtctccccaacacacgctcacgccacccgctccccgcc

SEQ ID NO: 117328 - DNA, 338 bp, Homo sapiens
ctaatccctgctcacgtggataggcatgaggcttcagagacagcacagagagtgcctggcagagcaggtaggcagctaacagctgccatttgtaccttcactgggttatttatatctaaggtcattctccctgtgagatgaagagcgctttgagggcaggggtggggtctttttggtatcccaggacttagcataggttgaaacaatgaatggatgaatgaagtgtctggggatggtcagggtacactctgagaagtctgcccctcaccataagattctggaaaacatccttcacccctcacacccagctgtgctcagccctcaggccctcctctcca

SEQ ID NO: 117329 - DNA, 263 bp, Homo sapiens
tgtgcctgcagaaatgccaacctctggggtagaagaaacgtcatactttgatcatcttccacattgaataaggaggaaaagcagaagaaaagaaactgagggtaccaatgccagacagtcgctaggtagtaaatgcagaagaatttaaagaaagtgaaaatcaaaggaaaataccacgttttgttgacaccctattcctcacccagccccttaatgtctttctacagaaatcagattcctggcgcaggcagttcattgtttga

SEQ ID NO: 117330 - DNA, 469 bp, Homo sapiens
gcacgaggtaagtttagacaaaagtaggggattgggcttctggatggtaaattgtgaaaaggtaaatatatggagattctaatgaaagaaaaggattatttagtaaggtttgttatgcataccaaagttggtgtcttctccattgataagcgtcatctctggtaaagaagtgttgccctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggagcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactctgtctca

SEQ ID NO: 117331 - DNA, 177 bp, Homo sapiens
aataccagaaatgaggaagcaaacctagtaatacttagtatttacttttgcacggcaatttatgactttaaaaatgttttgtctgcctcatggcaactctgtgaggtggaaagaacaagtagccttatcccccttgaccgataaggaaactgaaacctagtttgagacaggagctcc

SEQ ID NO: 117332 - DNA, 417 bp, Homo sapiens
atgactgcacactgtcagtgtcataaatgtcagctgctattttttcttccacctggaagtcccttcctgcctctccctaccgtctccccatacttcaaggcctagcttaaatgccacctcctccaagaagccttccagactccacccagccataagtcatctctcctgcctcctcatggtctatgttgttgtttttctcagtggaattcatacatttgtacctattttctctccctatcagacagacgttcctcaagggaagatcctttacactctgatctcagaatcttccaagctactgagtatgtagtaggtgcccaataaatgtttgtcatatgactagagagtaaccatttttcttgccagaccaatgagtggcttcacttcccagctattcagtgagcactttgttctaat

SEQ ID NO: 117333 - DNA, 288 bp, Homo sapiens
attctaatgaaacctactgaggagaccctacaatctattgactgttgaatctcattcatattagtaaactccagaaattgtaggatcattgaccattttgtataatgaatggagaaaagcatcctgttttttataatatacttgagctatttgaaagggtaaacaagcaccaggaaaaaagcaagaaacaatttgtttagactttcaaggagtcaaaaagtttcacaatgctattccaaattgtgttaccatggtattaggagggaaatttcaccacaggtaggtatt

SEQ ID NO: 117334 - DNA, 254 bp, Homo sapiens
cttcagtttgggctagaaccttacacccacataaactaaagctgtatggggtcctcagttttcaagcacataaaagtattctgtatccaaaaagtttgtgaaccactgccctagagaaactttccatggcgtgcaagatgtatgtaagaatgcccagtagagacataataagaaaccagaaaaagtggaaatctcaatgcctgtcatcaagagagataaatgcagcgtggtctatttctgttctcctcacattg

SEQ ID NO: 117335 - DNA, 795 bp, Homo sapiens
cacaaaatgaaactgctgcaatccaactttagaagcaaagaatagtcttacattgttaaatatagaaaatatataactattttaagaatagtgttagaacctctgatatgtaaaacaaatattaggaaaaaactatggtattatttgatataggctgaagtaagtagatgaaaattctataattcctttttgcctgcagcaaatttaaatttataagtaattattttagtaaatatggagtgcctactaattatctaatttatttcaggcataccatgcaaattctagcatattgtcctaactgtataaatctaaaattatagacaaatttgatatagaaaatagaaagtaaaaatgtatagggagagtgacatcagtaagatgaaaagactaaaagtgctcattttcatctccccttacagcaaaacaatgtcagccttccctggcatgcctttattagagaacgagacattatggctcacacctgtaatgacagctacatggtacattaaggttatggaactgcttcaggccaggatatggagaccagcctgggttatgtagcaagacgccatctccaaaataatgtctctaagagttatttgagatccagggttgcagttgtgaaacactgttaaagcttaagattgagaagtgttctattcagaaggcaggtcctcattcatgtgggaaactacaggaccgctcttcctggctacagaccaggatcgggttcacccaacttggtcccagtaagaattcagaacttactctgtaaccatcccaaattcctcc

SEQ ID NO: 117336 - DNA, 561 bp, Homo sapiens
ctcgtatttctacttctatttaaggggttttgctgacacccctgctcctcttcagactggaaacaaccaactgttttgtgtgccatgggatctcccttggggcctggcacgggacctggagtgtgctggaaggtagaggaatagctccaatgcgatgactaatctcagcccgtcaccatagcaataggtagcccagaggccacaaggatggccacccgggttccaaacctttgccacacccccagtctggatgcccacatcctctccaatttcggacatcagcccaatggcacaaccgtgatgttcatgcactcaacactatgtggtttcctggaacaccaaggagtggccactcccaaagcccttggcactaaaaacaaacaacaaacaacacactccttgcatgtggcacttcccataatagtgactctcaaccctggctctacgctagaatcagctggggaggtttcaaaactcctgaagcccgagtcttaccccagactccctggggactgcatccaaggcgagtgttgttcatgctccccaggcggttcgccaggc

SEQ ID NO: 117337 - DNA, 217 bp, Homo sapiens
ggtgacagagcgaggcctcatctcaaaaaataaaaaataaaaaaatttgattaaatccatattttgaggcctccagtaatcagtattaatctgttctatcagttgactggtggcaaaatagggttgactggaagcttagacaatggttataaggaggaaaggagtaatgtttccatgagcagaaatgatcaatagaactgatttgcaaggtatgtag

SEQ ID NO: 117338 - DNA, 278 bp, Homo sapiens
gatgggtaggtagatgggtagatgggtggatggtgggtagatggctgggtggatgggtgaataggtaggtggatgggtagatgggctggccagcgagctggctataccttggagcagtcatccttgcctttgccaaccctatgaggcccaggtgactgcactcccctgtaggccctacatgggcttatttatttcatgtttttgaaaagcactttttctgtgacttcccccattattaagataatacacggttattgtttaacattttaaagttacag

SEQ ID NO: 117339 - DNA, 743 bp, Homo sapiens
gtgctgggattacaggcgtgaaccaccacacccagctacagccaattttaaactaacaacatgacatcactaaacatagacttgtgaagacatgtgaacagtcagctctacatgccagtgtaagtcagctccaacacaccactggctacaacttccacttacattgttattgtttttaatagtagccttttaaagatgtttaaagaaagatagatatgaaatatcttttaaagattcattatgcacatctaatgttcattctgtctggtgtcctttatttcttcccactgggtttctgtctgttttattctctttctgaaaatatttgtgatagtaaatgtctgctggagatgaattcttccaggttttgtctttctgaaaatgtctttgttttgcttttacttttgaaagatgttttcactatatattgaattcctagttaaaaattttttctttcaatgtgttaaacacggcattccatttttttctggcttccattgtgtacagcgagaagtcagccataattcttgtcatttttctctgtatgtaatgtttctgtttacctatggttactttcaagattttctctttatatctgtttttcaacagtgtgtttgtgatgcaccaagtttggttgtctttgtatgtatcttacttgggattcactgagcattttttatctatggtttggtgtcatcagcttggaaaaattgttggccattgtcttttcaaaaatatccttg

SEQ ID NO: 117340 - DNA, 321 bp, Homo sapiens
aacctgaaacaggttaattcagcaatttccaaattttgggcaactgtaatactctcttaaaggttcctctaacctctaaagagaaaaaaacattgcatggcatgtgaatatgaatgttaatggaaattggggtaaacagaaaacaatttttaaagtttcacattctcaacatgtgacactccatggaaccataaaatcagatccggcaataactggtctgaataagcagaaaaatgactatgaaaggcactaaaccaaaacctgtgccatagtcagcaccatacagtagccaaaaggttatgtcacagggcaatgttggaa

SEQ ID NO: 117341 - DNA, 353 bp, Homo sapiens
tatatatatatatatatatatatatatatgtttttcaaatttaaaatttctggctatgtacaattttagttctccatgaaagatttgtcttcactatgacttgcagcatttctgctaaattttgtataatgtctttgcaacatatttaaaaattcttttgaaatgtttgtgtaccatttgcagcagtgtatggaagttactatgagaattaccttaaaatttaaaacagaagtgaaaagttttgcataattggaaggactttctgatatcaagtttaaaatgttaggattttaacataagctatatctatgtgtgtaggtctgttcttatttggatataatttttgagattat

SEQ ID NO: 117342 - DNA, 581 bp, Homo sapiens
ccattggaggttagagttccactgtcaaaaattagtaattatcattcttcttacaagtttaagactcaaatggaactgactttttcagcctatttgttgtctatggtaaactaacagcaaacagctggatgttcttctgtggttacataaccttaatggagattagttccttttatccttctatactgcttccctaccaaatgattagattttttgaggggcagatataaaccccttccattgtttaaaaaacattgttaataacccttcgcactacacaccaaagtgcagcctttaatatagttgccagaagcagttctgagtgaaacactgaaatgaaaagtaaactcatgtcatttggtctatgataagcattcacagtttgaaaaaccccaaacagggatagttaagttgcaagcactatttccagaatgagagttgaaaattatatacataatgtggaaacaatagatcaatgaaagggagtatagaacaaaagagagaagaatttccatagccactccatagaatattaggtctatagaatgtcaagaggggttatgtccaaaacagggttctag

SEQ ID NO: 117343 - DNA, 459 bp, Homo sapiens
cctgccccagcatgggatggtcgtgggcttagcaggcaggaggttattagggagtgtcttggggtccacaaccgtggaagggaaggtgaggaggcaggagtgggtcagggagaagctgtgctgccaaggaggccaaggccagcccaaggacactttgcagagctagaggagtccttcagcacagtagcgggagagccctggggcttagtactcctgggatgtacttagtactccacagtgatggctgtggcccgggaagagctcggccttgcaccagtgactctctgcagctgagggcctgccagctgcacttccagcatcggggtgagaggttgcttctgggtggcatatcctaacacccagcactttttcaactgaattttattcccaagagtcctgaccttttgaaggcaaaattgctctttctggttcaaagcagtcatggtgtttcatgctgac

SEQ ID NO: 117344 - DNA, 121 bp, Homo sapiens
agtgtccttgttggttcatctcactgatctacccactcaggacctcagttcctcgagggatgtcagtcctaagacctgtgatcacacttgctttcttcttgcctgtgggtttgtatgtcag

SEQ ID NO: 117345 - DNA, 212 bp, Homo sapiens
tccactgcacgataatctgtatacaggtccgtttctttcatcagactgtaaataacatgaggacataagaatggcatcttggccaggcatagtggctcacacctataatctcagcactttgggaggccgaggcgagcaaactacctgaggtcaggagttcaagaccagcctggccaacaggatgaaaccccgtctctattaaaaatataaaa

SEQ ID NO: 117346 - DNA, 286 bp, Homo sapiens
ttgaggtgccagcagggttgaagatggagcccccagccatcagctgaaccgtggatggggcacaagtaaaatagcctacctacaagcataattggaatcagaacttactctttaaatctgtgactgtgtgcctcaatttctcataccagctttctccataggttggaaacattaccacctagactcttatcattccactttcactaatcaggagagattgccctctttccttagttccaatttttaaaatcctcagaaaggagtctgaatggttcatcgtgggtca

SEQ ID NO: 117347 - DNA, 497 bp, Homo sapiens
tctgtgtgctatggttgtgagtctcataaatacccacaacgattctatttcccaagccaagtggggtcaatctctaatcggtcacactggtttatggcccactagggccatttatatccactgtcaccctgggccaagtctccttcatttccactttcatttattactccttgatagctgacacttaagtaaatacttaaagagaacaaaaaaacgggcttttctgaaagcagttattaatattttaaggacctaataaattcatgaacaagaagatggaaagaaagaaggggaggaaacatatttataaaatttagcctaagttgtattttttataaataattatttcttttaaagggaatgtttgagaagcaccaagttattcttataccagaaaacaattcttccccatcacaagctaagtaaaaactagcagaaatgatcaatgaaaatgaggccacatggataagaagagttcagctctaccaaatatcagt

SEQ ID NO: 117348 - DNA, 357 bp, Homo sapiens
tgtcaggtgctgcctcatatatattacttaatccttatcacaccctatcaggtaggtttactcttttataaatcaggaaactataaagaagttaagaaacttaacagctgcctgtaaccccagcactttgggaggccgaggcaggcgaatcacctaaggtcaggagttcgagactagactgaccgacactgagaaaccccatctctgataaaaatacaaaattagccggacatggtggcgcatgcctctaatcccagctactcgggaggctgaggcagcagaatcgcttgaacccgggaggtggaggttgcagtgagcgaagatcatgccactgcactccagcctggcaacaagtga

SEQ ID NO: 117349 - DNA, 511 bp, Homo sapiens
cccttcacctgttcatttgcccagtgtgtgtctaacccagccatccacagctatgtcatgaagacctgtgcatggatccccacctgcctttcccatgttacctgcgagcttaccaaagacttgggatttttccagcatggtgaaagatgaaaatgtgcttgggtttactttgtcatttccagggctgggttaaagccatcatgtaatgaagccagatccacattaaaatgtggttcatggccaggtgtagtggctcatgcatgtaatcccagcactttggggggccgaggcaggtggatcatgaggtcaggagatcgagaccatcctggctaacacagtgagaccctgtctctactaaaaatacaaaaaattagctgggtgtggtggtgggagcctgtagtcccagctactcgggaggctgaggcaggagaaccgcgtgaacccgggaggcagagcttgcagtgagctgagatcacgccactgcactccagcctgggcgacacagcgagac

SEQ ID NO: 117350 - DNA, 321 bp, Homo sapiens
gggcctggggacgtggagaaaggagagtgattcctaatgagtatggggtttcttttttgggctgacgaaaatgttttatattagaaagtggtaacagttggccaggcgcagtggctcacacctgtaatcccagcactttgggaggccaaggcaggtggatcacgaggttaggagatcaagaccatcctggccaatatggtgaaatcccgtctctactgaaaatatatatttaaaaaaaatgagctgggtgtggtagtgcgcacctgtagtcctagctgctcgggagactgaggcaggagaattgcttgaacccaggaggtg

SEQ ID NO: 117351 - DNA, 468 bp, Homo sapiens
caccgtgcccggcctagaagtttgtttaatcaaatccctgtgttagagatctcaacattcaaattatgtatctaattaatgtagttctgctttaatatataatggatctgccagtaacctcagtatcacaggaagtttaagaaattttaaacattaggaccaaaagtactagattgttcatctcttacattacttgaagcttcaaagcttcatcttttagtagaaactctagtatctaagaattttcccagcttttgcccttttggggttgagattcacatttcatgtttcacatgcaaagaatatctacatcattataaatatatattttatttagaatgattcagctagaaatattgatgtaacccaaagtctgtgttacttcctggcatgaatttcatctctaaggctactgctctaaaagtaattttgaaggcatagggtgatatagattcattttctacataa

SEQ ID NO: 117352 - DNA, 751 bp, Homo sapiens
catgaatgcctagaccttgtctgtggtagtcactatatttctagaatctagaaaaatatatggcacatgagtccaaggtatatctaattacttgtctcttgaaagatttgtattatacaagttctgagtagggtgggagccatgtgtttgtataggctaggcatttacgtggagcaacttcaagcagatactttaaagattaattggatatgggtggtaatgggaggaattgaaaacatctgagatgtctgtttatggaagtagttcctcagtcacctggaggtgggggctaggaggggagagaaacagaaattatattcttctaaaggtagacgggggcaatcagaggagccagttgacaaggctgggttttaatcattttgatttttagaaaaaatcatttgttacaaacatgtcttcatcatagatttcaaggtataaagatgagattggtattctgaatacttcaggtaagaaaaggttttgacggtggtagttgcatcaccagtgttaatacttgtagagaaggcaaggatgatgagaactgagggggaaaaatacttttatttttcttcctgagacagtttcactcttgtcacccaggctggggtgcaatggcgcgatctcagctcgctgcaacctccgcctctcaggttcaagcaattatcctgcctcagcctcccgagtggctggaattacaggtgcctgccaccatgcctggccaatttttgtatttttagtagagatgggg

SEQ ID NO: 117353 - DNA, 317 bp, Homo sapiens
gtgtctgaccactactcctggctcctagaccttgggcctgcagactgatcttgccacatatgaacatatcttctaaaggttaacttcctgaactcctggtatctacccatctgaccgaagctctggaaggagtgaccgattgcccttgggcattgtttttcctctgtcgtttttcctctatctatttaatagctgcttctccaagattgacatcagtgtatgtagagggtcatttccctccacacctgttggaccaagacatgtcaacccaagtctctctgtttatgccaaatgaggagaaggaatgcgccaaagca

SEQ ID NO: 117354 - DNA, 371 bp, Homo sapiens
agatcactgtgagggttcaggacttcagtggaggagggactgtagaggttttagaagcagcaagagaactagaatgagaaggacttggagatgtgactgcattgtcgctgtctcgcgagaaaactttaacacgtgaggagttgcctctgaagggtgagcaggggagttgcttcagttgcgctctagtcccagtgaagattctgtgaacctgggggtaatgaggacaaagaacttggaacagcccggaacctcggttgatgaagccgcggccgggttgagaggaccgactgcagttctgaaagacgttctgctgtgggtaatcaatgctatcagacagcatcacgccccacagagaaatctttcatgaaagg

SEQ ID NO: 117355 - DNA, 119 bp, Homo sapiens
attttttagacaagtactatagtcaaagtatttaaatggctattctttttcttttctttcttttttcttctgcatctttactccaacaagcaacaacctttagggaatttttttttttt

SEQ ID NO: 117356 - DNA, 444 bp, Homo sapiens
gagatcagcttcctttagttccactggggcgcaatttctgcctcaggcctgacccgggccaggtctgtaggtgcatcactttctgctgccttcttgcccacagaacatcccttgagtaagaatttgttctttcagtgcacttttcttgggttaaggaagagagaattgttgagtgtatttctgtcatggacccagggtatcaatttagatccttaggcctcttctgggagtgccttgggcatcttgcactgtgttattgactcaccgtagttaatattttattgtgtcttgagcattgagcaaaggcccctgcccagggtttcaagtctcagataaagcccaaacaagaagtgtaggaagggcctgggcagccccaggacaaggtgggaacaggaagaatggcctgcacgaatgatttatatcttcacttgagtttggctgctt

SEQ ID NO: 117357 - DNA, 291 bp, Homo sapiens
atgatgtagtgtctcatgggccatggtgaaatgtgagttttactctgagtgggtgggagccataggcgagttctggacagaggagggacatgttctgatttggcctttagcaggactcctctcactgctaagtcccacaccgaggaggttggatgtgttttgcaggcagtgggagccatcgaaggtgttcggggacttacagaatcactctgggagcccatgtggaaggaaggtgggttggatgtggctggggttagagtttagaggggcaaaggagcaagtcagaaatgt

SEQ ID NO: 117358 - DNA, 495 bp, Homo sapiens
aacattactccagcaaaatcagtctttgtgtagcattaattcatccagctaatatttactaaaatgtcgctttgtgccattcatttgactgaacttagaggatctaactagtaagagagatgtacccctaccctctgagagcctacagctcagtgatacatgcagaaatgtatagaggtgattgtcacccagcgcagcaagtgctgtgagaggggaagtgcaggacgctaggagaagcctgagggagattctgaccccaaactagagatggtcagggaaagcttcccaggggaagtgataggtcaggtgagacttgagagaaataaaggaggtggccaggccaaggtttgggggtagagtgcagtgctggtggtccctgccaggggagagatatttgcatgtagccagagtctggcatggtcataggtactgcataaatgtatgtcagatgaacaaatgcgaaggcctggtggtaaagagttgatggggagggga

SEQ ID NO: 117359 - DNA, 356 bp, Homo sapiens
ccagatcacacaatttacaaaagaaatgtgagatataaacactggaaggaaaaagacacactcttatttaaaaagatgatatcgtcatctacaaaaaaccaatgaaaccaacagaaactaataaaactactcagaggagtaacaagttataagagcaacctacaaaaatcagatgttatcctcattaacaataaccaaatagaaaccaatatggactataagatgttacaatagcaactaaaaccattaagtagctaataattagcctcccacaaagacacatcagacccacaaaggaaaaattttagttctatcaaagaaactaaaaagaggtgtgatcaaatgggggagattta

SEQ ID NO: 117360 - DNA, 219 bp, Homo sapiens
gtacgtatgctttctcaggctaaattttagtttgatttcagaattccacctgtttggtcggcctctcagttttgagagattaacctaaattctgagcatgggcaccactctcattacagttgtaaatgactcctttgttctgagtatggaattcacagatgacaatgtgaaactagctgaataattctttcttacttacctagttgaagtgagaccatt

SEQ ID NO: 117361 - DNA, 400 bp, Homo sapiens
tcccctcacaactgtctttcaaggcagtccctagtgggactatagtgcaacagtagtttatttgcagtttgtaccaatgtaccaagatgacctatccattaatcaggcccaggtttattcctcgtttcagcttgatgtaggaaatgcccctaacgcttgttcttgtcatctctttcttacttgggcccaattccaatatacctgcttccattttatgatgaattgctgttgtactctcctggtcttatcacttcatgggtgtgatagcacttagctcctgatggttagctctggttgcacagtcccttgatgaccatcagtcagatgctctgtctcttccagggcttaataatatgccaagagtagtatgccatactttacagatgaggtataatttttg

SEQ ID NO: 117362 - DNA, 739 bp, Homo sapiens
gtactgctacacttgattaaacttctgtcatattttcagacatcaaagtgtgtctgtgaaagaaagtggcttttgtcggattttctgatctatttgtgatgagtggctattttatgttttatcattacttacttaacagtaataacctgtcacttggcctgtcatatagtagacaatccatcattggtttaacgagagctacaggttttatttacataataacaagttctggtatgtatagcagaaagtttcctatttgtgtatttttacaattatttatcaaacagagccccccaaaaatgccctgaaataagacaaaagctaacctatgtttaggcaacttagctatatcatactaacattgaaacagggctgtttttctaccactaatgatgtttggttgtgttcacattctctcctcttcttctcttctccccatccacatcaataggtgattttgtggataacttgtggagttataaaacttgatgctttgatctgtgcttgagagagattaatttgcaggatgttttacataatttaagaaatataaaatcacaagttggatagtttttaaaatcacctttactgaagtataatttatatacaataaagcataaagtttgaattttgatagttgtgttaatgacagtcaaaacataaaacattttcgggccaggcgcggtggctcatgcctgtaatcccagcactttgggaggccgaggcgggtggatcatga

SEQ ID NO: 117363 - DNA, 417 bp, Homo sapiens
ggggggaagggaaaaaggtggaggaaggagaaggtagacggaaaggcaagtacttaagttactggttcagtaaaggaggatggcattaaagacatcaaccaaccagttcttcactcactttcactgttaaagaagctgtgtttctcatacaactttctggccactcaattcttctttatcctctaatgtacgtcaacataccacaagaccactaatgctcatcactgcagattctgaaatgctgaaatgtaccaaaaataaaccccacctactatttggttatcataacctccaaacttccaacactaggtcaactacagctaaccgacaaagaatggtaccagaaaaccagataccataccatatcagtcttcaaattacgttatcttagaatctttaacaactgaggagagagag

SEQ ID NO: 117364 - DNA, 382 bp, Homo sapiens
aatgctagggaagacaggcagggaagaacaaagagggctaggagtgagagagtggcactgttttaaattgggtggtcagagaagataatacaacatttgaacaaattgccgaagaaggtgaaggcatgagtcttactatggttggctgggggatgagcattccaggtatatataaatgttagttgaaaacccccatggcaggatcatgcctagacttaaacacaataagaccaatgtaactgcagcacagtcatcaagggcaaagtagcagaagacaaggtcaaaagatgctagggatggggcaggaggtggggtgggtagagatcttgtagagccttgaaagcaattataatgagtgtttgctcttagactgggtggaata

SEQ ID NO: 117365 - DNA, 690 bp, Homo sapiens
caaataattgagttcctcatttgttactatcttgtctcagcccccattacttaaaaagattcccattccgatttacaaaaaaagtttccaatagccctgcaatcagtcataaagttaattggaattcaacttctgtaacatttctcttcttcttaaacccacctttgatagactactctcatggaattaatgtagtatctcttcacaagatgacagcgtagagatgcacatgtaattaattatatgcatcactcaaaactcttcatatgaagatcttttaggaggaatgtttcagataataaaatagaaatgcctacataagttttctggttccatttaataggtaagaagtttttcctgaaatgtttataggctaatatttaacttttgactttcttttatagttgaaaactggataccattttagaaaagggtattaatgatacaaatatgatgtgtggagtcaggttaaagaccaaactactttcctcgctcaaatactaaaggattatctgcaaggagtttacttagaagctactgaaacaggttactgctgcatttagtttataagcaatggatggacttctgtaaaacttcttaattttaagtagttgcattatatttgggatgttaaaaaagtcttcaggataatataaaatacactgaaacatatgtcctaccaaatgaaac

SEQ ID NO: 117366 - DNA, 285 bp, Homo sapiens
aacctgtatgacccccgaaaagagggatggcccctcttggcacctgggagagggcatgggccgagtgtatagcctcagccggtgcccctctgctgctgcagcccgtgttgctcagtcctgttggtgacccagccccacctggtgcttctctacccaaaggacatacgctcctagatgcaaacaggcaaagtaagaaaggggcctctaagcgggccatggaaaccagtcatctgcttggtaaagaaagggtaggtcagaaccatcgggcagtgagtgctgttttga

SEQ ID NO: 117367 - DNA, 288 bp, Homo sapiens
ccttggcctcccaaagtactggggttacatgtacatgtgtgagccatggtgcccggccgctctctttctttatttgtaaaatggaagtaatatttgtccagcccttcttgtgaaattgttatgagactcaaatgaagaaatatatgtgggggcattttgttaccttgtatgtactgcacaaatacatttttactgagccattgctatcctttgtaaaaagatgaatacttccaaattatttgagtcaagattgataaagaagttctaaaacaatattaaatatatgtt

SEQ ID NO: 117368 - DNA, 117 bp, Homo sapiens
ttggaaacatagaccagggtcagagccatccagggaggctggctgtccttgaacttaagatgatcagggccaaagggaagggctgttaggtttggaagacactggcctagcaggagt

SEQ ID NO: 117369 - DNA, 799 bp, Homo sapiens
tgcatagtaggtgtatatattgatgggctacatgagatgttttgatacaggcatgcaatgtgaaataagtgcatcaagaaaaatggagtatccatcccctcaagcaattatccttcgcgttgcaaacaatccaattacactctttaagttatttaaaaatgtacaattaagtaattattgactatagtcatctcttgtgttatcaaatactaggtgttattcattttttctatttttttgtacccgtggaaagatcatttattgccctttattaacagttcatctttatcacttatattcccacagctgtggatacattcgtaagaacaattattagtgatgacatcgccacatgattttctttttaaattatatgcacctgtgttgttgtatttttttctgtgtcgtgtctgatgtctttctgcaggacttaattttgttatttggtttcctctctttctacttagcagtaagtctcaaaaaaataggttcgtcttattctcgtattatatactttagccaaaaatctatagtttaaaaattggtattgaatttatcacagaagtataatttaactacatagcaagaaatttagaaataaaaggaaagagaacaagatcatctatccagcttcctcagggaaaaggagctgatctatgttgaatcccttctgtgtttctagagctgtgtttgttggatttaacacccattatctcatctcaatccagcagatctctttgtccattatcttctcatatgcagattttcccatcccatctccttcatctctccacatgtt

SEQ ID NO: 117370 - DNA, 543 bp, Homo sapiens
cccgattatttcgcggcgtattagtcccaaccttggctaggcctgaaactttttggaggttgttccatgtctagggtactccgactttggagttttggagagccacgtaacgagggtgcggctaagatgaggaaaaggcacttccgggattagatttcgttcttgcccagacatcgtctttacggacccgctcctggtggttgatttggtttgttatgagagaaattgttctttagaaaattggagcgtaagtctagaggttatgtgacagctcctaaacgattgtctgcccaagataggctcggtaatgctccctaaatttagactgccagttaaacggagctttcgctaagtcatctgaggttaggaactatttctaagagcatttcttaagggtggtcttctgtgtttttaagagaaacttggtgatgtttgtgtatctcgatctaaatcgctgtttacagatacctagcacaatgccttgcagttgtaggtgcccgctaaaggtttgtatgaatgatgttgctagaatgaaagcgagga

SEQ ID NO: 117371 - DNA, 300 bp, Homo sapiens
gacttggtagtaccacatttcaggagttaatggtaacgcagaaagggattcacagattccatcagtttcccactttgtggcagaatatttgacatctcttatcagtacacttcatcataagttcatgaattcatcttgctcctttctttgctgagaatcacagtgagagaattggagtttggctgagaggaggagtgaggaaggaagaaggaagagtaagtttttttttgttttgtttttgttttttgagatggagtctctctctgtcgcccaggctggagtgcagtggcaccatctcgg

SEQ ID NO: 117372 - DNA, 602 bp, Homo sapiens
gatcaatgcacatgtaacctttgactctcccaaaacttaactactaataacctgttgactgaaagtcttagtgataacataaccagttaacacattttgtatgttgcgtattatatactgtgtttttacagtaaagtaagctaaagaaaatgttgagaaaatatatttactgttcattaagtggaactggatcatcacaaaggtctttattttggataggaagaaaagggattgggcttgcttgtctcaagactgacagaggcagaatgttcaaagccacgttgttcaagggtcaactgtattggagaaagtcacattgatggcttttgatttggtagcttccgtttaagctttggggtgtgttcttagaggaatgtttcagtgcggcttcctgtttggctttaaaaactcatacaagccctaactatattatttcttctcctaaattcattttctctatcagcttcctttaaccttttgacatttgtgtttgatttattcatatcataaattgggctgtgccagaaatccagactgagttttatcatcctaaggtaaagttaaattaaaatattgtgagggcaaaccctttcaataaggta

SEQ ID NO: 117373 - DNA, 187 bp, Homo sapiens
tgtccctctcatgaccaaggacctctggcttgtcgtgagtgttctggccagctgcacagcacggattaatgggccaaagggagccgctctctgatctgcgctaagcttttcaggttctgtggccaccgccatcagccacagatttaatgagatccgaggcttaattaccacagtgcagggctgccag

SEQ ID NO: 117374 - DNA, 378 bp, Homo sapiens
tcctgatccaggggttttattgtgtgtgaaaacataatacaaaaggtagttatttcacccacagattaaacacagaagacgcctcaataccaagcttgccaatccattgaaaacattcaacgtttcaagttcctttacacccagcttcaggaatatgtgcatggcatctcttaagcttctcctccactgcgggctgctttgctgcaagacagtccacttgcctttgggttaggggagaaggcagtttcactttgggaaatatcctaacagataaattaaattcagagatgaaacctttcttccctgactgcagagcacattagcaacagagtcaagcccagatcttgtcgccccaggtttgcttccttgtaagacttg

SEQ ID NO: 117375 - DNA, 594 bp, Homo sapiens
caagactctgtctcaaaaaaaagaaaaaagaaaaacagagtagagcaaatgagtaaatatatactgttaggtaccagggttctctctgtgggaaaagggccttctcatatggaatgggggaaggcggtggattggagttggggccatcattatgctcttttgatggtataaatatgcaattgacaagtcataaccatagaaagaagagcaagaagccatgtccccctgtagcaatgcatgtatctagtgcccacatctctctatttcttgatgccagtctccatcagaaggagccaggtctccttggacaagtggaggatgccaggcatgaggcagtggaaagtaaaatgcaactagagccctttgtccttccagaaagcaagaatgcattcaaagacagatgggtccaaaagacccaggcactggctgaaagggactcctgctggcaaagatgggacaattgaacatccaataaaataataaaagaaatgggtgattcaagggggaaaggagggcctgtaatcccagcactttgggaggccaaggcgggcagatcacgaggtcaggagttcaagaccagcctggccaatatga

SEQ ID NO: 117376 - DNA, 452 bp, Homo sapiens
tataaatggtttttccagtacattgtggccattcatttctgatgctaacagcatgtgtcgttccaacacatgctcatcttcgccaggggacttctttgtttaaaaatcaggagtgaagcagattgcccaggttcccctcaatgatgtatttctccaggcttccttgtagctctaagtttcatattagaaggataccaagaaggaagatgtagttttgaaggactattgtgtcaatgtaaaattttcaaaaagttaaaatatgactcttgtacaatatagaatgaacacctgccaaagctttatctcacccatttatgaggaaaccagtaaatagtaaaactggttcaaaaaatgctttgacaaatgatgtatttgtagtcaacttagaaaggcagtctgtgataagtttgctgagttaaaatccaaactggtaacatcctacaaggcaataa

SEQ ID NO: 117377 - DNA, 748 bp, Homo sapiens
cctgcactactctgtcaaattaaaaaatataatagctatctttattctcattttaaagcatgataatcatcaaaatgttgaagtttatcacagttctacattaaaaataagtcatttttgtaggtgagttatccaatacagcaaaggccatcaaagagaaagccaatactttcatggagagctcagagccttaatagatcccagcagcaatgcttcaaccattcccaactccatgttccttgctagatgctcctcaccccaaactcctgcaaatttcaagaatttctgtgtatgtgtgtgttaagggaggagttttaaagtatctctgtattcaacaagatacgtcagcttgtaagcagcagaaacctacttaaactagcttacatgagaaaataacattataaagacataggagtgtttctacaccaagaactggaggtattgtttggtttcatgaaggattaaaatctgtaattcaaaagtagactcaggcagctgcacatcaatctgtgtcttttctctggtactgtggactctatcctgtctgacttgctttgttcctgggcatcattcttgctctggaaaacacactttccctgctcatttttttattttaatgcttaggttcaatctgctcatttttccctacagcagaagacagcttactgtgttccagcaaacaacagagcctgaccagctctctgaatatggggccccattctcactcacaagtattcttaacctgggg

SEQ ID NO: 117378 - DNA, 1000 bp, Homo sapiens
gtgggaggatgacttgaggccaggagctcaagaccagcctgagcacagtgagacctttttttctacaaagaaaaaaaaaaaaaccctaaaaattaactgggcgtggtggcgcatacctgtagtcctagctattcgagaagctaaaggtgcagtatagcatgagcccaggagctcagggttacagtgagctatgatcctactactatacttcagcttcagtgacagagtgagatcctgtatctaaaaagaaataagtaaaaacatactaccaaatctgaaacaagagtggaacaaatcgggatacaggagggagaacagaatgggagatggacataaactttgtaatattttacttcttttttaaaaaaaatctgacacaagtatggcaataatttataaatctgagtattggaaacatctcagttttttcgattttctgattgaattataacaaaaaggatatatgaatcaaaaagaagaaaaagtaaataggcctcacaagaatatgaattccacagggcagagatctttggtttgcttggttttacttatctgtccaaagcactgagaacaatagccagcacccagtaggctacacatagatactttttgaaggttatggtactcatgtcactgtttggaaattgagatccaacatcatacatgtagggagtgacaaagtggggatcaaacctaaggtctggaagttgcctagatagattagattctttggtttttgtttttgtttgttgttgttggagacagggtctcactctgttgcccaagctggagtacagtgatgagatcatggctcactgcagccttgacctcctggggtgaaggaatcctcccacctcagcctctctagtagctgggaccacggatgcacaccaccacacccagctagttttcgtattttttgtacagatgaggtttagccaagttgcccagacaggagctcaagaccagcctgagcacagtgagacctttttttctacaa

SEQ ID NO: 117379 - DNA, 499 bp, Homo sapiens
tagctccggagcgcgccaagttgaaggccaaagtcgaggttgggatgcccgatgcctggcgcggggagacggaggaagcaaagtgctgctgcctggtggaaatacagtattatataatgacatgctactatgcatctctacctaactcctcgtctggtgatgccatattgaaatcagccatactgagagtatttacacactgctgaagtcagtaaatgctacaaatcaaggcttgaatgtaacctacatgagaaagagttgccttgctcactgccgtatcccagtatcccaagaaccttggagatgctctatgaatactgaatgaatctgagaggaaactagcccgaagggggaaggctctggaagcaagccctcatggaccaacggagagtgagtgtcatcattttatgttttctccaaatcttgtaaacaatgtgttttagtcttagcctgtcatatgcagctgaaatctggggcaaataaaatcacatagatgcaa

SEQ ID NO: 117380 - DNA, 590 bp, Homo sapiens
taaatgctgagagataggccaaagcagtaagaaggaggcattacttattttagaataagcgccatgtcattaccttattgctgaaatcttgaagctcaggtgttgactattactacgattaggtctgatggtatcgcacacccaggatgccaacagcgccaactcccgctgattgagttcccactgtgtgccaagaaagaagacactaggccttcatgtacattgtttcattcatcaaccagcaccctaactaactctcttttcttggtatttcctgtatgtcagaaaaggaaactgaatcttggggagattaagcaactctttcaaggtcaaccggggagcggcagaaccagagttcgaaggaaacctttctgaatctgacgtctgccccttctaaattaggactctcatctatcagcctgtgagaaaaaatacagaaagcatcattcaggcaacacatgaactcaagacactgagacttcgctaaccttcctcgcacacaaggtcctaaaggaactaccacacgcatgtccacatttgatgcacataacagactctcaccgcattgaaataaaccccagtatgatcat

SEQ ID NO: 117381 - DNA, 695 bp, Homo sapiens
tagctccggagcgcgccaagttgaaggccaaagtcgaggttgggatgcccgatgcctggcgcggggagacggaggaagcaaagtgctgctgcctggtggaaatacagtattatataatgacatgctactatgcatctctacctaactcctcgtctggtgatgccatattgaaatcagccatactgagagtatttacacactgctgaagtcagtaaatgctacaaatcaaggcttgaatgtaacctacatgagaaagagttgccttgctcactgccgtatcccagtatcccaagaaccttggagatgctctatgaatactgaatgaatctgagaggaaactagcccgaagggggaaggctctggaagcaagccctcatggaccaacggagaaaaaggaaactgaatcttggggagattaagcaactctttcaaggtcaaccggggagcggcagaaccagagttcgaaggaaacctttctgaatctgacgtctgccccttctaaattaggactctcatctatcagcctgtgagaaaaaatacagaaagcatcattcaggcaacacatgaactcaagacactgagacttcgctaaccttcctcgcacacaaggtcctaaaggaactaccacacgcatgtccacatttgatgcacataacagactctcaccgcattgaaataaaccccagtatgatcat

SEQ ID NO: 117382 - DNA, 431 bp, Homo sapiens
gagggctgactcttcatgatttcattacttacaaagttacagtaaccaagacagtgtagtaaagggacaggcacagatcaatagaacagaatagagtccagatagagagccacataggataattaattgtagggcccaggcatttcaatggtaaaaggatagtcttttaaccaatggtcttggtagccgggcgcagtggctcacgcctgtaatcccagcattttgggagaccgagacgggtggatcacgaggtcaggagatcgagaccatcctggctaacacggtgaaattccgtctctactaaaaatacaaaaattaggccaggtgtggtggctcatgcctgtaatcccagtaccttgggaggccgaggcaggtggatcacctgaggtcgggagttcgagaccagcctgaccaacatggagacaccccgt

SEQ ID NO: 117383 - DNA, 397 bp, Homo sapiens
gctaatggtgtaattgaagtgtcaagacattataggtacaactgtttctagctcattatgatagaaaatggactaaggcaagggtccttcatcttactttcattaagccacacactacctttgcagtcgaattccttttcataagacattttaatcttcgctatttgttgttcttcataacagccttagatagctaggcttaatattttagctattttatataggtggaagcttagagaaagatgtggaggttaatgcaactccatcttggatgctaatccaccatattggtttctgattaaccccagtttcaggatggcctctcagatgtccagtttatctatttttccttgtgtaagagcatgtacgtaccataattccagaccttaggtcaaag

SEQ ID NO: 117384 - DNA, 215 bp, Homo sapiens
gcaaaaaaaaaagctataaaagacaatttggagatagttggggatgtttgaatatggattgcatgttagatgatattatggaattggtgttaattttcttaggtgcaataatagttcattcttgtggttacctagaccagacaatccttattctttggagatgtggatattggaggtgaagtgtcatgacatctgcaactttcagctgtgtcaga

SEQ ID NO: 117385 - DNA, 793 bp, Homo sapiens
agggtttctctttctttttctttctttttttgagacagagttttgcccttattgcctaggctggagtgcaatggtgtgatctcggctcacggcaacctcttcctccagggttcaagctattctgcctcagtctcccaactactaaagagacttaggcaggaagatttccttgagcccaggagttcaaggttatagtgagctatgatggcatcactgcacaccagcctatgtgagacagcaagaacctgtctctaaaaatatataaaaaataaataaataattgaaaaagcatcactacttaccctgcctcccattatagaaatcttttttttttttgaagcagaatttcgctcttgttgcccaggttggagtgcagtggtgtgatctcagctcgctgcaacctctgcctcccgggttcgggcaattctcctgcctcagcctcccaagtagctgggattgcaggcgcgcgccaccacacctggctaattttttgtaattttagtagagacagggtttctccatgttgatcaggctggtctcgagctcccgacttcaggtgatccacctgcctcggcctcccaaagtgctgggattacaggcttgagccatcgcacccggccggaaatcttggaagttatcttaaacttcttcctttctctttggtcacacatccaactggtcatcaaatcctgctgattctaccttgagaaatgtttctcaaatcaaagtcctttcatcctttcccattcttttttttttttcttttttcttttttgagacagagtctcactct

SEQ ID NO: 117386 - DNA, 93 bp, Homo sapiens
ggagtatgactaaagtgatttcccgtttcttgcttggatgttgtgttagagtacaggccaaacttccatatcaaagaggccctggaatgtaag

SEQ ID NO: 117387 - DNA, 234 bp, Homo sapiens
ataactgatttcttctaaacttgaatgccatatagagtatattttgagaactaaatcggcttttagtcgaatgttttattcgatggtatccagctccccatattgttactttctgccaagggctatgggatgcacttttaccacctttcttctaccccttctccaacccccctaagatgattagaggagcctccattttacagtgaggtaactgcctcaagtcttatagctggt

SEQ ID NO: 117388 - DNA, 217 bp, Homo sapiens
aagagggtacatagttggcacacagattccccttaaagcccttcacactccaggaggaggggttggtggctcatttttaatcacccagtacacctggctctatttccaacctgatggactttgccccctcagtgcagcgcggaaggtgagagacttagttgagaaaatgactccaagcccagtcatgaattttgagcttggaggtcttctttgtagt

SEQ ID NO: 117389 - DNA, 328 bp, Homo sapiens
cgcacacggagccgcagcacaggctctattcagcggcgctggctggagctgagatggaagttagtttctatgtagcagaaatatgaaacaaatgaagcaaaactgcccagagaggggaaatgccccaaggatgggtctcactcacgcgcgtacacagacacacacgcagagagcactctcacgctgggcaagctcgggatcgcgctacccttcccgagttgaatgatagtgtttggtttctgtctcttgccatgtgcatgtgtataaatgctgcggattggcatctgtgtaagtcttgtcctgcgttatttctgcagcctatgcaagt

SEQ ID NO: 117390 - DNA, 413 bp, Homo sapiens
aagctgagggtgttgcaggctgtttgggatggatctggaggtgaggagccaggtggagttggctagacctcaccatgctagggtccccagagtggcaacaaggcaattttcaagtgtgtgtgtggacacggacagagccagacaatggtctagaggactgctctgtttccctgtgtgcgatccttatgtggtacctatgccagaggttttagacagaaaatagatgttaattgaggacatggagaagcaagattgaagcctccacaaatattacgtgagcatggcagaggaaaaggcccgttatgtgccctttggggaaaaggtctctgggctaggctttccagggacctgaatccataaggttcacaagagagcaatttctgagctaccaagaggaatggggcggacctggg

SEQ ID NO: 117391 - DNA, 539 bp, Homo sapiens
gtctgttgtttcttttccagttgaaatgaatttggctgtggcctgccctccctttattctttagagagaatctttcctttccaggctagggatgtagttctgcctgggtgcaagacctgatacgctgaagaagaattataagggacaaagaatcaagcagaattaagaaaggacgtgagatgacctagctcagctccctcgtcgtggggatgatagggccaaggcacagggagaggaagctgggactttggtatcagacacacttgaacttgtgtcctggctctactatttaatagctgtatggcctggggcgacttatgtaacttagctgaacctcattttccttatccgtaaaggaaaataacactgttatctcaccaggttgtcaggattaaatgaatgcctgtaacacatgtttattatatgtaattttcttctcccttttcaaggatatataaaaagataagggcagagtgggtctagaacccagatgtctaggctgccagctgtcagtcctgtcctcttgtcagaagggcccg

SEQ ID NO: 117392 - DNA, 283 bp, Homo sapiens
ttttgcatttttaatagagacagggtttcaccatgttggccaggctggtctcgaactcctggactcaagtgatccacctgcatcggcctctcacactgctgggattacagacgtgagccaccgcgcccggcaaagcaagtgcatttacatggataaagattggaagataagaggaatgaaaactgtgtaaaagtattgatatcacgtggtgtcaccatccagtttgtctgctaagccaggagcctctgggtcatcccgacaaccccagtctcctcttccccca

SEQ ID NO: 117393 - DNA, 985 bp, Homo sapiens
ggaatcccactctggctatgtctgcagggatggtagatgaagaacacagaacaagaatcatagaagataaggagccacaaaggttcactctgttttcaaaggtgcagtcaaaatgttacacttctaaactgtggcaacgagacacaccctgaagaaagagagcgttacaccttcacaagaaaacagagaaaccaagataccttgtgatgtcttgtacataccaagaaaaatatgtcctaaccttgaaagcccattttgggtgtgagtggaaccacatcattacaaaaccaaaaagctgtatctttctcatccactataccccttcttttccaaatggacacctgagactttgagctacttcatacaacagagtttcacactgggacctcccacgtctacctgcatttcaggcccgaatctttcctggcatcagatttatcatcaagaacctttctgtggttcatttcttggggcacaattctctcgtgatggggactaatcccgtcaaatcatccatttttgttaacattaattgtgatatccattccaggtatctgctttgtgtataaaaaggaaatttctgaagataaaaaaaaaaaagaaaaaaaaaaaatgaaggaaataaaaaaaggagagcagacacacaaaaggatacaagacaaagagaacatggtacacaaagcagatccgagaacaacagaaacaggacaacgaggacacaacgcacagaaacaccatacaagagacgcaccaaaacaaacacgaaaacgcgaagagataacacacgagcacatcaagtacaatgggcgagaagaagaagaacacgcagcaggaaagaaagagacagcaaagacaaacaacaacacgacagaacgcagaacgacaggcacgaaacagtagaaaacaaccaagaacacagacagacaaagacacagcaacacccaacacaaacaaagaggacagacgacaaccagaacaaaacaaa

SEQ ID NO: 117394 - DNA, 395 bp, Homo sapiens
gttaggtaacttgcccaaggtcacaatgctagtgagcagcagagtttggtctcaagcccaggcactctggctctagatcagcacaatccaacagaattctctggaatgaggccaggtgcggtggctcacgcctgtaatcccagcactttgggaggccaacgcaggcggatcacgaggtcaggaatttgagaccatcctggccaacatggtgaaaccctgtctctactaaaaatacaaaaattagccagcggcggtggcctatgcctgtaatcccagctactcaggaggctgagacgggagaattgcttgagcccaggaggtgaaggttgcagtgagctgagattgtgccattgtactccagcctgggcaagaagagcaaaactccatctcaaaaa

SEQ ID NO: 117395 - DNA, 399 bp, Homo sapiens
ttgtctggtaaaaagctggaagttgcctaaattcttgaagtctggtgatgctgccattgttgatatggttcctgtgcaagcccatgtgtgttgagagcttctcaggctatccacctttgggtcgctttgctggttcgtgatatgagacagacagttgcggtgggtgtcatcaaagcagtggacaagaaggctgctggagctggcaaggtcaccaagtctgcccagaaagctcagaaggctaaatgaatattatcccttaagaactttaaacacagtggagtgctacactgtatggtttatgtgccctgctgtctaccaaagggcctgtatcatcagattgttttggtttggacatgcttcaaatttgaacttaaatagctctttagaacattatcgagg

SEQ ID NO: 117396 - DNA, 580 bp, Homo sapiens
ccagcctcaggaactgggactcgaagggaagggaggttctccccagtggggacaaagggtctccaaactcagagttaatgaggtttcccgtaccccaccagagaggacacaaagacgtgcccccttcacccagcaagggtgatggtggaggggatgctgctgggcttgagcgctgccaggcacagaggggagccctgtcctttgcacccctatctggaggtgaggccctccctccagaaacagcgtccgcatcccaggtcctctaaggcagcccctgctctccacctgctctggggccaaatgtgcagcctggtgtacagagaagcccaccccctgcctacgggctgtgatgccacatgctggggacaagagtgtggggtctgtggcccaccccagccatcagccagctgagaaggacaggctgcaacatggtgccttcacgcaacgctgactttccaacactgtgaggggctggcagtttcacagcagatcctggtcctggagaatgggcgtgtgctctgcgtcctggcagtcttaagaaccacttctcccagagaaggataagactcttcctgctctc

SEQ ID NO: 117397 - DNA, 211 bp, Homo sapiens
ggaatggctgctggtttccctttaagggctataacctgtcaactcattgtttgcttctcagactcccacctagctgtagaatggagggggaagggctgacctaaatcgcagggaaacaattaggttcgctaattctccgcctccattacttgggtttctgatggtcttaaggggttcttctctcttctccactcccaccacttgcacactt

SEQ ID NO: 117398 - DNA, 387 bp, Homo sapiens
tataggacctaattgtaatacgtttaaatattaagtctccaccacaaaataacatgggtcatatgttacatgcatatttgttgaatgcacatgggtcaggaccaccttcatgaatattcctagcccctcctgcaacctgttaaatatgtaagttcagccaacatgttgtcatattcccacaggacctccaagcacgattgataggggagaatgtgcactataattaagactgagtggtatgtgtacatcctagataattctggaaacaaatcctcagccctatgagacatgcataagcaaattaatgctatgtcttatcccacaatgtcctaagtcagtggctctcctcatggtttggatcaggcccctcttggtgaaaaaaagttg

SEQ ID NO: 117399 - DNA, 337 bp, Homo sapiens
gagaagctgccccttctctctttctctctctctctctgtgtctcttgtacagggaagggggtttcaagttgcaactaactcattgctgataccaagcaggatgggcccaggcaggaaaaaagtacacacccttgcccagagtcacagcttctataaggggaagggggagactgggttctgtgatgaaggggtgaggcagacgtcttggtgtgagactcagtcccgtgataaaggggcgatgcacacagacgccttagtgtaaggatccaggtttctgccctcgcatcacagaaagccctccaccccacgtttgtcccttactctctggggcttagcc

SEQ ID NO: 117400 - DNA, 142 bp, Homo sapiens
ggtgttatgcctgctattgggtgcaactgaccttgtcctcctgtcccttccatcactaccaacaatcatctggacatttaagattttttagctgacaacgtcagcagctatccttttcttgttacacttttactgctgtcat

SEQ ID NO: 117401 - DNA, 536 bp, Homo sapiens
tcttgcattatttttgtctggcattaatatcagggtaattctagcttcagaaagtgaggtgagaagtattcccttctcttctatgtgttggaacagtttgttaaggattgatgttaacgctccattgaacatttggcaaaattcaccagtgatactatctgggctcaggctttttttggcaggaagttttcttttttttaattgtgaattcaatgtttacttattataagtatattgagatagtctattacttcttgagtcagtttcaggcgcttgttactccctaggaatttttcaatttcacataggttatctagtttgctggcgtttaattttattttatttcttatgctccctttttctttctaaaagatccatggtaatatcctctcttcattcctacttctaataattagtgtctttcctctttttttcttggttagcccaactaaagatttgtcaattgtgttgattttttcaaagaaataacttttggttttattgatttttctctgttgtttttctcttctttaata

SEQ ID NO: 117402 - DNA, 301 bp, Homo sapiens
ctgggattgggggagtggtgagcattggaaggaggtactcagaggggagagggcttcagcctataatctgatatctaggtagacatttgccctattgtgaaataaatgaagtaaggatttctaggatcttttatatgaaataaaattaggcccagatggtttcactggtcaaattttctaaatgtttaggagagaaacaataacaatgctatacaaagttttccagatgatagaaaaaagggaacactttctattatgaggcatctaccctgaatatcaaaatctgacaaggaaaagacag

SEQ ID NO: 117403 - DNA, 449 bp, Homo sapiens
cggatgtgtatgcatgcatatgaaaaccttaagtcaatatttgatctctgtcccatcataaatccatgggagcagaaatacttcacccatgaatatttaattatttttctggaacaaaaattcctgaactatttaagcacactcacttctgcaatattttgcccattcctattgaattatattttttaaaaagaaaaaaaaaactctttatttcaaagatttcagctacaatattacattaaaaactaacctttaaaatttaccttgctataatagttttgaacgaagcggtttaatagctactgcagttgaaacctggtcatgatgtttaattgctcatttcagaaaagctctggcaggagtcagatacaaacttaaactgtgattatctgtatgattccacaaagcaagcttgtccaacctgcggcccacaggccacatgcagccca

SEQ ID NO: 117404 - DNA, 233 bp, Homo sapiens
agatgaacaggcactgacttaaagcttgtttggattttgttttgggtgaaatggactgttgggaaattaatgatggattcgtctacaagcctaggcctttggaaaagccaaaggaccacaagtttaaccttgaagaacagaccacaaacacaggttttccttttcaccttttttttttttttttttttttgagacagagtctcgctctgtcacccaggctggagtgcagtggc

SEQ ID NO: 117405 - DNA, 746 bp, Homo sapiens
ctccatccaggaatctcatcacgatgctattgtgataacatgctgcccctcccacacctactgtccatcagaattcagtcctcttttctctaaacgaaggctttctgcacaaaaggtaaaagaaatccaactgtttggcccatttaaaatcaagtcactgaagtttctctgagctcaatcacactcttcatctctgaggttcatctctgttcttaccacatgataacgtgaaaaaatagtttcttaaagagctggccccatcatctccagaaatgatgttagggaaggtccgtggaaggcacaggcctgcagtactgaaggcagaggcataactgccaaccacaagtcactgattacaatccaagagcaccattttcttccttttatggggcatacgactcttccaaacattgtcctgcagatacttaagaaaacaaaacaaagccccaaacaaaaacccgagctccttactccacaagcgttgtgacctcccggctcagggcagcagccagtcgttcttggctgtgggagagaacctgggagggcggcgaagagcagccagacattttttcagcttgcgtcttcaggggacagaaacaaggcattctttccttctgcaaatccaggctagcagctcaggaaaacaatcactccttttcccagctgcagagatggctggattgccttggctgccttgcacgtttctcccctaatcttccagataaaccatccctggggtcccaggt

SEQ ID NO: 117406 - DNA, 243 bp, Homo sapiens
gtgaggtacatggacttgctgacgtctgcgcccacatcgttgctgaccttgcagaggtagtagccactgtcttcctccacgacatgcttgatcagcaacgacccattgctgagaacttggattcggccatttagggcaaagcagtcatcctcaattgttctgctgagggttaccctgtacctaccatcgtgtggaaattctctaaaggtgctggggttccccagttccagccaattgccctaa

SEQ ID NO: 117407 - DNA, 404 bp, Homo sapiens
gaaggtatattatacttatatttatcacttacttcatctttatcactctttgtagtaggtatcgcttattctttttacagaaagaggaactgcaacccagagaagtgaatatatgtttaatgagctaacacagaagaagaaaccagggctggagaaccccctgtattgtgaggggtcatttggaatcaccttacctggcttaaactagcaaacgagaaggaaggaaatatattgactaatataatagacaagtctggagttaagactgcaatcaggctgcaccgttgattcaggggctcagttaaagccttcaggatgctgtttcccccccgttcatctctattgtatgcttcctcattttcaggcttcttgtggtagcaggatgcatcccagcaagttcagac

SEQ ID NO: 117408 - DNA, 246 bp, Homo sapiens
ggaggatatggagagaaatcacaggccggaggacacggagagtaatcacaggctggaggatatggagagtaatcacaggctggaggatatggagagtaatcacaggccggaggatatggagagaaatcacaggccggaggacatggagagaaatcacaggccggaggatatggagggtaatcacaggctggaggatatggagagaaatcacaggccggaggacacggagagtaatcacaggctgga

SEQ ID NO: 117409 - DNA, 283 bp, Homo sapiens
ttttttatggttgaagagtctgagaattagaattgattaatttgctccaggtcacatagataataacaaatagggttgaattttgacccatgtctgttgggttgcaaaatgtgtcttttctcccatattgttctgtttcctagttgcttctcagtatttattagcacagtattcaatttgtttcattcatctttagatcctccatgttacaaacagtatatttagctgctgattgaatgaatgaaatacaaatacaaagtccactattttcgccaatgctgtg

SEQ ID NO: 117410 - DNA, 548 bp, Homo sapiens
actttaggttaacagttggttaaagagggaacaaaaggtacggatgtggagccacatacagaggaatcatttgaagaaactggacggtgagaggaaaaaggaagactttcatattaatttattcaacagtatttattgagcactggacactaggactgtggtaataaacacgagggccacaatccctatcctcgtggtggttttattttagcagcaataaattcagaaagaaacaaggccaagaactaagactaggtggagtagaatctgaaatgcatccctaacctagtgaagtcctaaaagataagccaagcctcccaaaaaaaaaaagtcacttggtgtcagatatcattaattttagtaatcaatgtatctcatgtttttatattgcatttttagtttcagaatgtgtatttttagagcatatggattatcattccaaagtgactgttttcttagacaattaaaaactttacactctttttgtaagctccatagtacctggcacaatgagacgaacatagtagggtccccttaattgttggttg

SEQ ID NO: 117411 - DNA, 680 bp, Homo sapiens
catcatttggggttttcccaatgtttctctattggaaataactctgtaatgaacatctttgtgccaaaagattgtctacatgttggattatttttgtaggatagattcccaaaactagattaactgcattcccaaaagtagataccaaggacattaatttcctaaggtaaaaattgcttttctaagtgttgacaaaatgtatattctcagaagcacacttaccagtggtgaatatcagaattaatagcaaagcaaataaatacttttttatggtaaaattgatagataactctatatcttgctctcttaatttacttcttatgattaccaggaaggataaagatgatatttaattaagtgtgctatagtttatatattatttgtttttgctctttgccaatttatgtattgggaccttggcgtgatgcctctcaattttatgaggttgtgaaaggaaaataaaaactcaggaccttgattcactataccaaaaggaaaaaataagctgaaaactgagtagtgcaagaagctgcctttccttctgttcctaagcagacagctacagataaaaagttaaattatctccacaggtggctactctatgttcaccttatcttatgtaaaatcctgatttaccgagcctgagatgaatacataattgactatttccctacctgccc

SEQ ID NO: 117412 - DNA, 639 bp, Homo sapiens
aatgcatgtatgcatgtatatgtttatgtgcatatatatatgaatgaacgcttgtatataaaagctttatttttattatgtatagattttatttgtcctctataaatcagtgctttccaaccttgatgcacataaatatttgtacagcacactgtgatatataagagagattgcttgtggctgaagggcaatagccaggaagcttttgccatcccaagcattgctgagctgcctgaagggctgaggtgatgagtatcttaagcacatatatatcttatttgaggcccacaggttagaaagctccaatgttgagagagttgtgaactccttgagtaggtagatcctcagagcacttagtatggtattctctgtatagttatttttgacagaccatatttgacatatactataaaacttttttaaatgaatttctttcaaaaggtaagaactattagtcttctcaaagacataattagtaaacatctaaaagttattatgcttagtatttcctttctatggtttttaaatcattacgatatgtctttgttattagaaatgccactgtgtaatgagtgttacatataataagtaggtatgggtacaaatgaatttggtgtcttagaaggaagccatctggta

SEQ ID NO: 117413 - DNA, 169 bp, Homo sapiens
ctggctcctgcatctagtcagtgatcaagccccatccacgtgctctctctcctcactacacagcccacttgtaggtttctccgtaagccctcttcttcccacactctgtctcctacctgctccccctcccgctgctcctgcctccacactccatgcaaaccacactgga

SEQ ID NO: 117414 - DNA, 290 bp, Homo sapiens
gaagtgacacacagtgctttagacacggattcctgcatccaacctttgatatcctggatacttttctggggatacagcgcaagaatcagtatttagaatgttttaatttgtgtgtcggcaggtatgtgggtgaacgggtaatatgtatataaggtacagaagtcagaaggtcccagtgggattatatactcatacctttttttcatatctttctaaggataggccttttttaaattatacaatttttggtcaggcatgatggctcatgcttgtaatcccagcacttttgg

SEQ ID NO: 117415 - DNA, 214 bp, Homo sapiens
tcttttgagattttgatgaaaatatttaagtgtttgctaagctctctaagtaaaattccaaattctgtctcctttgaggcggacagaaactgaagtctctgctcatctttttcaagttttcagttattgcttttcactagcccctttggaggtccctcttgcattagcggtttaagagtcaactaaatatttcagaggagttcacatgcagact

SEQ ID NO: 117416 - DNA, 205 bp, Homo sapiens
aaagaggtggtgagaagtgcgtggcgcagcgtgtgggatgaatgtgcaccgtaagaggtccagtcccactgcggtgccctagcaaagtgggacgcttcgggaaaataaggcaggaagaggagttgaggtcacatggtgaatatccttggataccatgttgagataaagatattttagaagatgtcccacattctggaactgattc

SEQ ID NO: 117417 - DNA, 368 bp, Homo sapiens
agtggaagacatgaacagaatttgttccagttgctggcaattgagttctatactatctgtggtttcagtactatctgtgaattccatcatattcattgtgggtcttagaacatgtaccctgaagataagggggaactactgtatctagaatattgtcagtcccaataaggattaattgctgtcttttttagtgtggaaaaaatctgacataatcaatatgctaccaaatgactggttttctcaagggatgcccttggatcagggtctcagtctttgctgttaaccaactggacattcagcagccacagtagataaaccttggtgaaggggaacccattttttatagcttctatctgccaccatggctg

SEQ ID NO: 117418 - DNA, 322 bp, Homo sapiens
cgtttagaggtaccagctgtggggtttgcttcttgcctttcttcagaatcacaagctaatcattagctttcctgctccttgcactttccagaactctggccagaagaggcaggcaggggtgtttactctacacgctccggagacccttttgcttccctgttagaagcttctggtgtctagcagatgcagatctcagtggagcaccagaggctgcatatgctcactgagccagtagtgggtcaaaacccttatgctgtttgtggaactccatgcatcagtttgccaaggctgccataacaaggttccacagactgaatagctt

SEQ ID NO: 117419 - DNA, 612 bp, Homo sapiens
ctctgtcacataggctggagtgcagtggcgtgatctcggctcactgcatgctccctctcccgggttccagcgattctcctgcctcagcctccctagtagctgggactgcaggcgcccgccatcacgcctggctaattttttgtatttttagtagagacggggtttcaccatgttagccaggatggtcttgatctcctgacctcgtgatccgcccgtcttggcctcccaaagtgctgggattacaggcatgagccaccgcgcccggttggctcaggttctttccaccctttgtcgaatgtgactgagccaggctctgcggcactgaccttggtcctgggatggcttccaagtctttgaccttaagagttcacaatgcagagaggggagataggcttgtaaacagatcactgattaataggacagtagtggggcatcacgcacgtagaaaccacgtgctggggagagaacacatcatcctttcagaggagtcttgcctgtaccgaatagattaaaaatgggcccgtccaaccccacagttgtcccacggtgcaaacaacttcagtctacattctctacagaaataagataaagggtctcaggcagcagcacact

SEQ ID NO: 117420 - DNA, 314 bp, Homo sapiens
gatggtggttactaacaacacagtccacggcagtcacaatggtgtaataactgccaccctgcccgggcctgaggtgatgaggccccaagtgcttatgtgcaggatctcatttcaccctaaccctgcgagctggggattatccccacattacagatgcagacactgagattggttcagcaggccgggcgtcttgctcgtggtcatgcagtagaccagaggcaggaccacagtcacatcaggccggactcagtccagcatcctactgtatgtaatgaagaaaaaaagttggcttgaggcctggcttggccaacaca

SEQ ID NO: 117421 - DNA, 256 bp, Homo sapiens
aacagtggtgcccctggtgactgtgtgaggaggagccccagaaaagccagagatggccaagcaaagccatgaaaagcccccaggctaaataagtaactgtggacacaaatcttaggcacccacaggtacatctgtccttatgtgatgagagctaccaggtttccttaaattccataatcatctagcagtccccctcccccaactcaccagaaacagcattgttccccaaactgaaaggttttctattagaacacaa

SEQ ID NO: 117422 - DNA, 748 bp, Homo sapiens
cagctgcttgtactgaccggggattaagggccaaactagacaatggatgtcagagatcctgtgtggacacgtgaccgggaaagctataagcccccctctcctccaccacacacactgccacagcaacacataaatcctcctaaacttagatctgatggggaactaagctaaatgagaatcttaaaaaaattgttgtattacagaagaatgaacaagtacaattccttgcacacctgaccttgtgctatgcaagtctttcagcttcttgttaatgcattctatttaacaagtttgttttggacaatattatttctgtttaatctaactcccttgctagcaaggaagcttaaaggtctgtgaaatcaaaatatttaatactgcatttctcgctcccaaaatgatttcaatgtgaacgacgagagacagagagagagagagagggagaggggctgtgcttagctgatgactaagggcttcctaagggacaattttattcagccctagcatcttattagcagcagagaataattaagaagggagaggtttgagggaatagagaagagggctagtagccttgtaatcagacatcccaaagtcaattcttaattttacttgaaaaattataaatttccatttagaagatgcacattttaaaattaggaagtctatacttttgtttcagttatcttctacttcttaaagccacgaatagactgccagtccttgttactttaagttcaagtaccaa

SEQ ID NO: 117423 - DNA, 790 bp, Homo sapiens
ataaaatgttgagtacaaatgcctttgaactcagaaactggagaatttgtaatattttacttttgtctgattgtgaaacacatgcctgttcattggagaaaagttgtaaaacactaaagtaccaagtaaaaaatactaattatatcattcagatataccattaacatttagtatatttgttgtcattaaaaattctataaacattttttttaaatctacataatgctttgccattcctaagagattaacccgtataataattttcccctttttctagtgagggtttatttttgacattaaaaatactttttttttttttttttgagacagagtctcgctctgccacccagcctggagtgcagtggcataatctcagcttactgcagcctccacctcccaggttcaagcgattctcctgcctcagcctcccaaatagctgggactactggtgcacaccactactcccggctaatttttgtatttttggtagagacagggtttcaccatgttggccaagctggtctcgaacttctggcctaaagtgatccacccacctcagcctcccaaagtgctgggattacaggtgtcagccaccacacccggcctaaaaatactgttctgatgaccatccttgtgccaaaattggtgtctccatttttgtctatgtcattaggagagattcctagaagcaaaatactggtcaaagggttatggacaatttaacactcctctggaaataaaggacatccatataatgtggcaaataatttataaagcatttcaccaggga

SEQ ID NO: 117424 - DNA, 321 bp, Homo sapiens
catggcttggaatgtcaccttttacctccagtaaataaagccaacatcaacactcttccgtgtcttttattttgtatgcactcaatattcttcacatgacaatctggactcttaaagggaaattacagtagtgatctatgtcttggcaaagagaattgtctttataatatatagttacagtgtatccatcaatttcttttgtttcttagactgttcacattggattgagtaaatctaaaatggaattaaaagagacatgattaatagtggactacaaagaaataatgatatcataatactctcttaaaatgacctgacgtg

SEQ ID NO: 117425 - DNA, 280 bp, Homo sapiens
  misc_feature (212)..(212): n is a, c, g, or t
  misc_feature (225)..(225): n is a, c, g, or t
  misc_feature (242)..(242): n is a, c, g, or t
catggcttggaatgtcaccttttacctccagtaaataaagccaacatcaacactcttccgtgtcttttattttgtatgcactcaatattcttcacatgacaatctggactcttaaagggaaattacagtagtgatctatgtcttggcaaagagaattgtctttataatatatagttacagtgtatccatcaatttcttttgtttctcccccntaggcacattggnatgtatactaatagggnccctgtggtgggcccaacgcataccttttttaccctaa

SEQ ID NO: 117426 - DNA, 358 bp, Homo sapiens
gcgctttggtgctgccaaacattttccgttacttcacagaaccttgatgtcacctataaaaaccgttttacaaatgaggaaggctcaaaggtcaggagcttactgatggtcaaacaactatcaggaagccctacaatgagggaccctggagttctgagcagctgatctaacccacattcctcacacagtgccacaaaaggaggctaggtggccctaggacagaaagaaataagtaatgtggacaagtagaagtggccaggcacggtggctcatgcatgtaatcccagcactttgggaggccaaggcgggcggatcacctgacgtcaaaagttcgagaccagcctggccaacatggcga

SEQ ID NO: 117427 - DNA, 683 bp, Homo sapiens
ccaatctttctttttttacgtttactaactttatttttgtttcggcaaagcatacagaataataactgatgtttaaaatcatggaaaaaggtacccccagtctccctcatgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgcgcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctcccgtcaagagccctactaggatggg

SEQ ID NO: 117428 - DNA, 662 bp, Homo sapiens
tctactaacttataaccgcagcaccaaagcatacagaataataactgatgtttaaaatcatggaaaaaggtacccccagtctccctcatgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgcgcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctcccgtcaagagccctactaggatggg

SEQ ID NO: 117429 - DNA, 321 bp, Homo sapiens
tgcctcggcctcccaagtagctgggactacaggtgcccgccaccatgcccggctaatttttttgtatttttagtagagacagggtttcaccatgttagccatgatggtctcgatctcctaacctcatgatctgtccgcctcagcctccccgaagtgttgggattacaggcgtgaaccaccgtgacccacctactttaagtagcttttgtgtaaagtaacccaagaactaccaccaatagttaaatagaagccatatcttctagttttttttcctcttctttgctattatgattttcttgaattttgctgattgtttccttc

SEQ ID NO: 117430 - DNA, 605 bp, Homo sapiens
gggggaagagtagcaagagagctttttacaaaaggttacttactataggtaaaagaagaatgtgtttaaaaatttatcttagggctgggtacggtggcttactcctgtaatcccagcactttgggaggctgaggcgggtggatcacctgaggtcaggagtttgagaccagcctggccaatgtggtaaaaccccgtctctactaaaaaatataggaaaattagcctggcatggtggcacgcacctgtaatcccagctgcttgagaagctgaggcaggggaattgcttgaacccgggaggcagaggttgcactgagcagacatcgcgtcattgcacagcagctgggcaacaagtgcgacactccatctcaaaaaaaaattattttaatgagtaggacattggcatgtcagtagaatgtcttaaaattgcttatcgaaagcaattttatagtaataaaattaaatgcatgggttctcagaaagaactttacttgtggtgaatttaaatttttaaactatgcatgtgtagctttccatgtagagaataaaaatattggtaacagcatttcaaaactttattttaaactttagatattcattaactaatg

SEQ ID NO: 117431 - DNA, 246 bp, Homo sapiens
aaagtgctgggattacaggcgtgagcccccgcgccgggtcagcccagagggtcttgagaggaagacgggaaagaagagaaacatctgtttggagaggacaaaaagagggtgttaaaaagaggaggaagtgtgggggaaggcgacgtgaactctaccccttcccttccccctcacctgcctccctcccgcccagagccaggcctggcttagactccagaggggtcgctgacaaactccaaattggca

SEQ ID NO: 117432 - DNA, 445 bp, Homo sapiens
agccctgggcgttgggggcgttggccaagacgggcgagtgggcttctcgggttctactctgtgaaggccaaggcaagggcgtcgtcgcgcgctgcctggcggagcccagccccttccccacactgtcgctgacacgcccgcctgtcaaaggctccgaggcccagatgagcagggcgattttaaatgtcagatcctgccggccatccgcgaccgtcacctgtgcgtcttcagctcctcaggctcctccgcttgtctcagttacaactgggagcccgggtgggcagatgattgcaagagaattctttggagtgagaagattttgctgtgagaaaggagaagattaatcaggaaagtctgtctgaagaaggaagtttcccaaggaaacttctaactcaagggcataggagagccgaagcagtgtgcctcaccttcaactgtgtatctc

SEQ ID NO: 117433 - DNA, 116 bp, Homo sapiens
agtaggcatctcacttaaaaaatcaaaaatctgcagtaagaatgtgccatacagtaaagtcataaagagtcatagctgagccaacacaaccctggaaggccaccccagcttccaag

SEQ ID NO: 117434 - DNA, 343 bp, Homo sapiens
gttgtaggactgtggtcactgttcctgctggcgtcagtcagccaggggctgctctcagctcatcgaggccccctcccactgggcagcttgctttctcaaagccagcaaggacactgacttctagaccctcttttaaagggcttgcctgattagggcaggcccataggataatctgtcttttgagcaaggcagtcaactgacgaaggattttaattatttttttaatactttttgccatgtaatacagcctaattacagtggtgtcatccattatgtccatggtcccacgcactcagtgggagaggggtatgcagggcaggtacactagtggtgggagtcttgg

SEQ ID NO: 117435 - DNA, 428 bp, Homo sapiens
cccacatgtggccacaggaggaactcggctgagggctgagaagaccagataatgacacagagggctcacttcaggaaacccagagagctgcagcggctcctccagggccattccacgcattcattttctaacaagtcataagtcaaagagtgacatcaggagcggacagcctggtgtccaggcatgagccatggcaacagattctgatttcccagaacggctttggtctttacctggtgttggatatggtagtgttagctggagtgggaggagattcacattgtatatttgtttagtgactccaaagattttaaattatattgtgttttttattattttattccatttttttagagacagaggtctcactctatctcccaggctggagtgcaatgatatgatcataggtcagtgtagcctcaaactcc

SEQ ID NO: 117436 - DNA, 174 bp, Homo sapiens
tctgagactgagaaagaggagatagaaccagctcaaaatttgaggaagcagccagacagggtggcttatgcctgtaatcccagtactttgggagcggaagcaggaggatcacttgagcccaggacttcaagaccagtctgggcaacaaagtgagaccccatctctacagaaaaa

SEQ ID NO: 117437 - DNA, 398 bp, Homo sapiens
gaaaacatcatgccacgactcgatacattgctgtgagaatcgaatgaaatattagttttgaaaacacctggtgtggaccgggtgcagtggctcacagctctaatcccaagcactctgggaggccaaggcaggtggattgcttgagctcaggagatggagatcagcctgggcaacaacagcctgggtgaaactctgtctctacaaaaaattagctgggtgtggcggtgtgtgcctgtagtcccagcgactcagtaggctgaggtgggaggatggcttgggtccaggagaccaaggctgcagtgaaccttgatcacaccactgcacttcagcctgggtgagagaaagaccatgtctcaaaaaagaagaaaaaaaaaagaaaacacctggtgttaacaaaa

SEQ ID NO: 117438 - DNA, 188 bp, Homo sapiens
ccgcccctggcctctgccagtcttcccttgtgcacaatgatactatctttgtggatatggctcttgccacatccttcctgcttaaaaaccttcaacagttctcttctgcctgctagatgtaagatgcccgcctacgtaggacacgaacagccctctctattctcctgtaagctctcagcatgtggttt

SEQ ID NO: 117439 - DNA, 556 bp, Homo sapiens
gcatacctgtccagtaaatccctcagctgggaaacaggtcaagcaatccaataatgggggtaaaactaatcaataccaccctccaggcactcactacgcatggcactctaagtacttgggttggaaaaagacacaatgcccagcagaagaaagggatgctagaaacaaagatctgggggcaggggtgaccatgggcctctagaaaaggagaggactttggctgctgctgaaggatgtacactagcaatgcgaaggataacttgaggaaagtaatctggggacttgtgtactcagtggagcaaaggtgggctgatgggcaagatactacgtttgtaacagctttactaatgacagtgttaagaataaattggaagggagtgctgctagaagtaaaactaccagatttagttctctgaatcaaggtgatgggggtctgaattctaatgcagttagaaatgtacaaaatattatcgagacctcatataactcggtgattgactgcattgggctgtggcctaggagagaatgaggaagtatgaaagtttactgcaaagtg

SEQ ID NO: 117440 - DNA, 730 bp, Homo sapiens
atatctgctccagttaggacagatttctttcctgtccatgatgggagtaatccattgcaatcatcttgccaccaggtggatggtcccccccagggaatggtgcccataaggagctcagcattgttctctgtgtttgacaggttaatcattcaacagtaacagtatcaggccagcttggtaagaggaagcccatgcatagcctccatccttaccaccatggctgttttatgcataagtccgttaagcaaaccctgggtgactaaagaaagatgctgtctaacatacataggtcatgccattttgtccacctgattattgaaagactgttttcatcatgtcctttgataaactctcacatggggcacaaatatcctcttactctgtacctatcccaagaggtccatccacctaccttttccccagacctccttatcaccagtcttgctattttgttctttccaagtccctgatcatccagctaaaccattagcaactgctcatgaatcaatgtagtgctaaccatcccctggaccaaagtatacaactaaatttaccacttgaagtcatgtccactgtccttcaccattaccttttattggggctgtgaagctgccaccttacacttctagttggtgccaacatttattcacaacaacttgtaaaccaagcccaagttttttctccttggtcagctgctcttaaggaatccccagtgaggccttagatgtgg

SEQ ID NO: 117441 - DNA, 318 bp, Homo sapiens
gaaaggaggacctagggaaaagttgaggacaatggctgcagagacagcctaggagccacctggagatggacgagtgaaagcaggaagggctcagagaatggaaacagggaggtcagaggactcatcgcaccaagtgaccaagggagagttgggagggatgggggccatggtcagagtgaaaccttagaaatactgactcccggctgggcgtggtggctcacgcctgtaatccctgcactttgggaggccaaggcgggtggatcacgaagtcaggagatcgagaccaccctggctaacatggtgaaaccccatctctac

SEQ ID NO: 117442 - DNA, 362 bp, Homo sapiens
aactccccatcacaaggtgatattctacactgatttaggtgattatccatttaatgcccatctatcccactattctatgagctctgggtttgacttgttttcctcactttcaattcccagggctgaagcatattttctggaataaaggactgaacaaaagatctcgaccacagagacttgacctggcttccactcttggaggcagtggtctttccatcacaaatgcatgctattttttttgagatggagtctcgctctgtcacccaggctggagcgcagtagcatgatctcggctcactgcaacctccgcctctcgggttcaggcgattctcatgcctttcagccacctgagctaggatcac

SEQ ID NO: 117443 - DNA, 299 bp, Homo sapiens
tatgagttaactttacctgctaagagagagtttggtcaagggatctgaagagtggtgagggtttgtggtacttgaccaaggatgagtaaaagaattgatgagtactttaagatcctgataatggattttataaacttttaatacccagttcttccgcattttcttcatctgattttccctatacaaacaagtggaataaaattgtgatactgatttaagatgggaggtttgcaggaactgtgaggttgaagggtaaagggaggatgggaactgagagtgctagtgagaagacaatgaaa

SEQ ID NO: 117444 - DNA, 375 bp, Homo sapiens
ataggcatgaagccttcgtctcacagctgcatgcgtagtcactgttgaagcaaatgcctacctaatttgacactcttggtgtgtttaaaaaatttttttgagtttgcaaataagcatattaagtctactgatggagccttcgggcagtgaacagttatttgaggaccctgatcctggaggcaaatcccaagatgcagaggccagaaagcagacagaatcagaacaaaaattgtctaaaatgacccacaatgctttggagaacattaacgtgattggccaaggcttgaagcatctcttccagcaccagcgcaggaggtcatcagtgtctccacatgatgtgcagcaaattcaggcagatccagaacctgaaatgga

SEQ ID NO: 117445 - DNA, 668 bp, Homo sapiens
attgtgaaaaatatggtaaaatatggaagcatcaatattgtttcattttatgtatatataatgaatatatatatatacatatatataaagtatttgaaaagtaggaaaattagaactttcatcgttcagaaattcttggcagtaacagcaaaattaaagcacacccacatacatctgtgggttgaatagtggcctccaaaagatgccttcaaatcctaatccccacatgtaaatgtgattttatttagaagtaggattgttgcagatgtaaaaagttacggatctcagtatgagatcatcctagatttagcgaaatctctaaatctggtgatgagtgtccctataggggaaaagtagtcagagagagataccgggagtaagtcatgtaaagacagaggagcgccaagaattgctggagccattagaagctggagagaggcatgggtatattttcccttagagtcttcaggataaacccaccatggttttgaacttctgctctcagaccagcgagagaataaatttctgtgatttcaagccaccaagtttatggtaatttatttggcagctctagaaaactaatgcacacaccttcagtctctgccttatattcaagccttgatgtataatcagtagttttgatttttttcctttgtttgatggaatat

SEQ ID NO: 117446 - DNA, 174 bp, Homo sapiens
ctcaagagcaagtcacctgggggggccaaactgtgtcctgcctgctgctgtgcattcagctgctctggagaggcctgcgctgctgagaccatgttgggaagtcagtctaattgtgccatttgctactataaagcttacttggggctgggcatggtggctcacgcctattatccc

SEQ ID NO: 117447 - DNA, 485 bp, Homo sapiens
gcttctgactccctccataatcccccaaattttaatttctaccatatttgattctataaaattttctgatgaattcattgaaagagccaatatttggggcctacaaagaatccagcatagtatgttttcaactaaccatactctggaagacaatgataaatttgaagctgtccacagaaaaacagtgatcataaaaataacttcagtaaatggaaaattttttcactataaattcattataaggggactaaataaaatattgtatatatgctaaattgaatatcatgtagccattcaaaggattgggctggatttatgtattgatgaggctaggtcttaagtatgttattatgtgtgaaagctaggtacataacaatgtatacagtatggtattttggggggtaaaaacaaggaattaaaaagaattctataaattgtcactctatatttgaagtttttactacatacaagtattatcattttcc

SEQ ID NO: 117448 - DNA, 435 bp, Homo sapiens
ggatggcactgggctatgggggaccagagatgaaacccacaggaaccccaaactcttgcagtgaagggaatatgcctactgcacagaacatggaggtttctatcatgttcaagagaaaatatttagccgaaagtactcttatacctggacccttgagaatttaagcctctgaatcacacaagagcttcagggtcacccaaacaaccaaaatgacccaaagatcagaaaaacaaccgaacaaatgagacgaatgtgttaaaaagcccaggagagagtgattagggagaaaatgggatgccagcatttaaatggtagggcaacaaactcccagctgagggtgatgtttccagagaagcggggaaggaaaagtaaattatcagggacagatggcaaacaatatcaggtggcataagcatccccagaagaaagtgttag

SEQ ID NO: 117449 - DNA, 253 bp, Homo sapiens
aatattcaagaccagcctgggcaacacagtgagaactcatgagaacaaaaagaaaggaagaaagaaaagacgagaaaagaaaaaagaaaggaacatgatggtatgaatccctgctcttggtgctgcagagaaccaccctagggcttcccctttgacacacagatctcaactctcaaaaaactcaagctctggtgactttggatttggccttctagccacggatgaggctgcacatccaccgccatcatttgca

SEQ ID NO: 117450 - DNA, 163 bp, Homo sapiens
caaatgggttccttgctcgaaaaatctgtaataggttctgtacttaatatttcattgtaggtttaagtcaactttaaagtacttacgtgttctgagttgtatgttatatatgcaacatactgttatatattgataatcaccaataaatacattattttaaaag

SEQ ID NO: 117451 - DNA, 624 bp, Homo sapiens
aaaaggccactcacggtaaaaacttctagagcaaaagaccaagactacaaaagctctgagccacgtgagaataaagaagaatgcaagtacagcacggggagaatgaagcagttgcagaggaaactggaaaaaaaaagggtcggggagatggagaagaaatgaagaaaaaaacgtgtttccgtatgacccggctgcttatattttctgggctcaatattctcttcaagaaccaggggatgccagagaagagtttataagtggacaatgggatcagatttgattttaaagaaatcaccagactgaaaagctgtttcagtacacatgtcaaaaatgaaagggcaagattgtcttcccctgctaaacccatggggctacagaaaaagcaggctgtgaggaacctgttctaccattagctgaaagggtgtgtggcacatgagaaacacttgctgcatgccaaactgactgctctggtcccagcaacgctctctggagtgtccctgaccatgcctcagctaaaagtctcagtcaagtaaactctcctaaaattttagcatatcattttgcaaaaactaaataaacttcatgttgtctttctgcaaagttgctaatcccagatataaagga

SEQ ID NO: 117452 - DNA, 344 bp, Homo sapiens
agatattggtacttctgcttctatccttcacataccttaatgctttatctatctcacacactctctctcaacttctattgctttattccttcctgccagtttctaagacagtttatcaatttgatctttcatctcactaatttgttctccaactatatccatcctaaaatttattccatccattctttttatatcaatgtatattttatacctaatatttacatttttttctaatttcttatctttgtcatatattacaaatatgttcctttatcttcttaaatacattcagaaatcatttgttgtatttttaatgttgttgttttaatagctatttctttctc

SEQ ID NO: 117453 - DNA, 398 bp, Homo sapiens
gagagttaactgggtttaaaagtataatctgttcaacagggtggagtcttagtccacagaaaagtaaattatataaactcaattccttcatctttaagttgggtataacaccaactactcgacacctcatagcattaatatgaggacacaacgacgtaataaagacattagtgttactgaagattggcagccaatgctgatgtagtagtatataccatctgatggtcaagagagcaccataggctacaaaagtgtatgtattaagtaagcagagtctatacccttcaagatttttattttgggtatttttcatggaacgttttaaaaatatgatttatttaaacatactgtggtcttccctgtgtcctgaaacaaaacatgttaacaaatatttatcc

SEQ ID NO: 117454 - DNA, 514 bp, Homo sapiens
ggtggggcagcgagggtcctgctcggtttctgacctttaggctctgaagcacaacatctgcatcctgaagagaagttttgttggtggcagggcgcttggggcactcagagccccagtacatactcagcagtgatcacaacaactgctcttgatatgatgctgggcccacaagctcccccaaacccttggaaaaatccggtgggcgcagtccaaatctaggaagtgcaacccacccaaccacgggggcgacggcttctgcagggggaggaatggttttgactcggactcaggtcgccctcactggttctccttgtgccaggctcagcagacagtgacaaacatgtgccatggcctctctctgtaccaggaacacctttctcattatgccctgcccggtatcagagaaggactggaggccccatgtcaggcattgggacagggagtgcacggccaaaggtcagtgcctagactttgccctgtgtgcatgggcttggagaattttgcctctgaccac

SEQ ID NO: 117455 - DNA, 904 bp, Homo sapiens
tgaaaggtgactggcaccagcagtttggatcgcctcctgtggcgggaggcccttgtagaggatacctttggagaacagctcacaccccagagggaagtggcttggacaaagggggctgctcagcagacttcgatctcctctgggggatgtggataccgctcaggcccgcacccctccattggtcctggagactgatatgggaggcggtatgtgccttggctccggagggcacctggagcacccctcacctggagaaccctcatccagagcactcctttcctggagcacccctcacctgaagcaccctcagttggagcatcctctcacctagagaaccctcacctggagcaccctgttacccggggcaccctcacctggaaaaccctcatctggagcaccttctcacctggagaaccctcacctggagcaccctgttacctggagcaccctgttacccggagcaccctcatctggagcaccccctcacctggagcacccctcacctggagcacccctcacctggagagcccctctcctgcagaacccctaccaggagcatacttcaccgggaccaccccttgccttgatgcctcagcactgaggagtctcccatctaggtggctgggagggcactctggagccatggggatgaggaccagaggctgctggtacatcttgccctgagactttggaggactgcaaggggacccacattcacttcagctctgcacctgtggtgatatccccacactggagagcaaagtgattgctccgggggccagatggccacgccaccatccccccacacactgcccctgccccctgcctggagcacagcccgagagcacccaggatcatccatgtgaagcagcaggctgtgggtatgtttggccgtcccgacccc

SEQ ID NO: 117456 - DNA, 196 bp, Homo sapiens
tacattgtagggttttggttgtggttttaccctaatactatgaatataggactcaataattctttgttgtggggggctgccctgttcaatgtcctgtagaatgtttagctgtatctatagcctctacccactagatgctagttttaccttcacctaccccattcatgacaaccaaaaatgtctctaggcattgaca

SEQ ID NO: 117457 - DNA, 633 bp, Homo sapiens
tctcggggtggcagaggtgggagaaaatctgcatataatcggacacgtgcagttcaaacctgtgttgttcaaggttcaatggcaattagtttttattagaaaaaatatatcaatgtggagaagcccttgaaggaatttaagcacagaggtgattgataggtgtaaccgccgggtccagacaggccagaacttgaactcaagttgtgctggtcaagggaggtaaaagaatcaaaccttgatgaccagaagacactggagtaaaaggcaagagtgaaaaaaaccttgatttgttacacggtgaaaagcagcagaagaaaaatggcacccgaatcatcgatgtcactaccgttggttggtcaggtaggccatgagaaccaaccagagatcaaacagagcaaaatcgaatatgcgataatttgttcatttccattccaccattcgccctcagtgtttatcccatggtaattaaaaccaactgtagctattgaacaatggaatttgctggtcaagctcttcagagcccaatgtcatcagccttggggtggcccctgcaagtccttgctgtgtccattctgttctcactgaatgcagaaggtgcagcccagctcagggatgagttacagctggcctcaa

SEQ ID NO: 117458 - DNA, 910 bp, Homo sapiens
ctgatcctcagttttctgtcaaagaacttctgctcatatccaattcctataaagtgggagtactctaacctgatattaccaacattaggttagattttatcctaatgttaggtattagaatatatcctaacattactagttcttcactcttactaaagtgcatgttagatttcttcaatgatttttttaaattggcatggttgatacaaagcatccttctatccaaatactgtgctcagtcgcctaagtgatagtttagaaccatactatctctctgtggaaagaatgctggggctcctggctacacactttgagtagaagggaaaatacccctcttgtatttatgatgttttttctttctacttgattaagaagaaagtacaaaaaggtgcttattgaagcattgtcaatttgggaacaagattctcaggaatgaaatatttgtgactgttctcagcatgaaaggtagagagaagattacttgatcattatgtgcttatttgaaagtcactttcctcccatgcctcaacatctcactttttagaatgcacactgaatgcctggaatctctttgttttagaaaagacaaagttgcattgttaaaaaaataatatttctggggaaaaggctcagtgctcaacggttactctataaagagatttaaaaagaaagtcaagggaagataaggaaggtagcatggctaacaacctcgtgggttctactagcattatttcatgcaaaatgtcattaacctttatataggagagaataagtctgggaatcaactggcatctaaactccatttcttgttttgtcactgcttccctggttgactatggaaaatacatttggtcttttgataccttggtttcaacaactataacatgacttaagaacttttatgcatgga

SEQ ID NO: 117459 - DNA, 535 bp, Homo sapiens
aaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatattgaaaactggcacaagacagggatgcattgttaaaaaaataatatttctggggaaaaggctcagtgctcaacggttactctataaagagatttaaaaagaaagtcaagggaagataaggaaggtagcatggctaacaacctcgtgggttctactagcattatttcatgcaaaatgtcattaacctttatataggagagaataagtctgggaatcaactggcatctaaactccatttcttgttttgtcactgcttccctggttgactatggaaaatacatttggtcttttgataccttggtttcaacaactataacatgacttaagaacttttatgcatgga

SEQ ID NO: 117460 - DNA, 744 bp, Homo sapiens
accagttcttgccggtgcccttcgggttggggttttgccctgtagatcctcttcagtgacagctgcagattgtgaacccctccaggcctggaaccaaatctccgattcagtgttgagaacctggactcgggagtcagcccctgggatctagtgctgcctctgacagttacttgctgagcaactttgggcaggctcctcatctgtaaaactgggttcattactaggttcttgcgattattaaatgacgtggggaatacgcaaagtatttatgtgaccccgcgtgtggcccatattaagcactcagtaaatgttattttcattctttattcttgtatgccccagttgttagtgaatggcagaagtttgttgtaagtagataaatgaaggttgagatatttagttcagttgagttttattgcctattgagtcagggcattatattctgccttaaataggaggtttaaagaaggtgtgattatctaccacaagtcacctgggatgccttctggcacccaaatgagtagttttcattaataattgtgctgtataacaaaagctaccaggtattgagtgattttcctgagcccagcaatatgctgattgtttacttgctttcctttgaggaagatatcgatctcattaaatagatgaattcagagctaaagttcagagagggcaagttacaagcctgaattctgaggtctaggaattgatgacgctgtaattcagggaccaaacatataa

SEQ ID NO: 117461 - DNA, 517 bp, Homo sapiens
gtttaagttaggaaattagttgccatgttggttcagttgtgtatcaccaccaaagaagtgagttgctaaattaaatataaataaatacttagccatagaactagaggaaaagattaaacaatgtattgttggatcaagaaatcatgtttcaaaatttaaatcaatgacttttatagttcaagtgtctgtgaagtctaaaataaaaatacagacattaattgcactaccttattggtagaagaaatagcaagtaccttaaaaagtgcatgtcatattggaatcaaatctcttgaaggctaggctagtggtaaaagaaatagtaggtaccttagaaactacatgtcatatttgaatcaaatctcttgaaggctaggcaattcatcttgactatatttttgtcaccaaagagcttaatattgaaccatcaaaatatattcactttaccatctgggacattttaatcaaacctctcatctgttcaatcacatctttcacttcagaaagaactttcacttct

SEQ ID NO: 117462 - DNA, 362 bp, Homo sapiens
ttttaggtcttggtcttcagccctcttatcctgatttattctctcattggggtctcactgtctctagtattttagctaccacttgataaggatgacttccaaatttatattcccattcccaatatttattccaagactcagttttgcatttctgactgctaatcatctatatatcagtgtcccagtggcctcttaattgagcattatcaaaatcctgtggtatttatatggtcccagttatccatccctgaagtctgtcaattttgatttctctaaattccttgccatgacatcctatatatgatcacatctctatacggcttagcattgtattccgatgcccagatgtcaaacttgaagct

SEQ ID NO: 117463 - DNA, 371 bp, Homo sapiens
tgtggggtccaggaagacgaagaggttcggggggctgagaacgaggaggccgggagggatcacgtgaggaggcctggagggcccaggaggaaggagccaagaaggcccaggagggcccaggaggaggaggctgggatggcccaggaggaggcgacagctcccagctccgacagctcccagctccgcattaggccgcagcagcccaggggcattctcttctcagccatcttcacacccacttgctgttgtcttctctgctatagtgtcttttgcaatttaagatgccttttcaatggtgaataattagcacctccttacaaggcagaagttccatgacttaatgaggaggaaggaggtcagaggccactccc

SEQ ID NO: 117464 - DNA, 335 bp, Homo sapiens
gcaaatgctataaatcaggtctttctcctgcaccccctcttcagagagcaggttgttaaatatttaccagcacatctctggctctgtgcccaaagattgcttaaaaaactgaatgaatctgtgatttagaaacctatctctggcagagggtgaacaaaaaaccggagtctaggggagggaaggaggcttaagatagaagtggtaggaggctcctgcagtgacctaaacaggaactggcaaagcttgaaccaggaatgtgaaacgtctaaagttaatgtttgtttaaattatagtcattcctttctcagcgaactgtttctacacatgaaagcacc

SEQ ID NO: 117465 - DNA, 318 bp, Homo sapiens
  misc_feature (126)..(126): n is a, c, g, or t
ccaccgcacccggctacggggtttcaccgtgttagccaggatggtctcaatctactgaccttgtgatccgcccgcctcggcctcccaaagtgctgggattacaggcgtgagccactgcgcccgccncggccaacttattcaaagtcttaatctgtccatgtgaatcgaggttaaagcagtagcaacaacaacaaaatgctatcattagtaaatgttttgtttattacttagtgttaacagagctctcagagtgtgctcttaggaagacacgcacctcttaaggtaggtgtgtcttgcttagtgaggttgaacaaatca

SEQ ID NO: 117466 - DNA, 427 bp, Homo sapiens
tcctgcctcagccacctgagtcacagggattacaggcatgagccaccatgcctggttcacctgcaagtgtgtttatgttcaatttgatgccacctacaggcaccaacttcctacctgctgctccatgcagtgggctgaacctccaactcagaatgtagccaagaacttgcagctatcactctttggaagagtgctacccaaagaagggctggcttccagtttgtcagccagcagaagaacttgtgcaaggagaatggaaatgagctggtgttttagctctgatttttatctagaagccaccaggctgtccagtggctcacctacctctgtagctcctgctttacttttctggtaggtcttaggagctgggtggcagagtggttcaatggatggagtgtgagctttggactcatcgcatctgggttca

SEQ ID NO: 117467 - DNA, 516 bp, Homo sapiens
agtatgacaaaatcaaaaggtctgttggtcctgagcttgcagcttagctatatggtggatggtccaagcccttcctctgtgatgcttactatgcatgaactacactggccggccataggtccttgagggacaatgagattttaaacattatccctagccttaaaaggcttacaatctagtctcatgacaagagcctatgctactctgaagaagttttaaataacatatatgaagcatgaggggaatggtaaattgtcaaaactgctatactctgacaaggatcaggagcagtaaataatttaactgaggcttgaacaaagactgagccttgggcgtgtggtttgtagaaagaaagatatcccacatgttcttgtttttactatgaaactgtggttaccattcttaggtgtggtttaaatgataccatgggaatgaattccacattgtgtattaattagtaactgattttaattcaacacatttatgagttaaggagtagatattacatctacatgg

SEQ ID NO: 117468 - DNA, 268 bp, Homo sapiens
gacatagtgtctgtcagtctccaccagctctctcgttctccagaacagaaaagacagaaatgtccaccttccccgtttcctctatctggtgaaacctctttaccctacccggcaccttttttattcctacagcttagcttcccagaccacatgaggcaatgggttaaaaaaatcgctgtgtgtcctagaaatatcaagttcttgagcatctgcttttgggagctggtggggccttctctgacccagccccctcactgctaaaggcctt

SEQ ID NO: 117469 - DNA, 427 bp, Homo sapiens
tgtgggtagcaacaaccatgagacattccatatgagtggtggcctactaaggaataagaactcccctctcactcatccataaccaggaggcacaactcctcagggtcaacagtgatgaaacagtgaagcaggcttctgacaccacctggcagtaatgagatggtggccctctgacttctgccagagcagtgtcagaaaaagccaactaaaatagaactatgaatcagatccagagtcttacaaattagtaccccaaatgtctaggtttcagtaggaagctgctcatcattccaacaaccaggaagacaacagactgaatgaaaaatgtaatcacagacactaatcctcataagatagatatgttagaactatatgacaaagatttttttttttaagatggagtctgctttgtgctacctagagtgca

SEQ ID NO: 117470 - DNA, 622 bp, Homo sapiens
actagtccacggtggtccaggtattagttatcttatgccaaagcttaatgccttaaagctacagacattgtagctacagacatttactattgtacagtacctgtgagtcaggactctgggtgcagcttagctgagtcctctggctcaggatcttccatgaggctgaaatgaaagtgttgttgagggttgcggactcatctgaaggctcaacagaggaaatgctttcaccgtcactcatgagatcattagcaggattcagttagctccttgtggtttgttggccagagacctctcttacctccttgccacataggcttctccgtagggtagctcatagtgagctagtttactttgaataggacaagcaagagagagtgagcaagatagaagctggagttttttgtaacttaatcttggaatggatatcttattacttttcccatattctgtttgtttgaagcgagtcactaggtccagcccacagtcaaggagagagcatgagttccaggaggcaagaatcattgagagttatcctaaaagcacctgccacaacctgtaagtcctacatgatttgacccctattaccctctaatctcagctccttctacttcccttttgccca

SEQ ID NO: 117471 - DNA, 534 bp, Homo sapiens
aacaaaaaaaaaacccctgcattggggtaaacagacattttttttcctcatgtaacagaacgtccagtctgcagtcagtccatccatccaggattagtgcagctgctcaacaatgtcattcaggacctggctcctcctattttggaagatccacagatcctggcaggctgtcagccctaaagccaatgctttttcttttaaatagtaagaatgatcaaacatgaaaacatttatatttcatttctcatagatttaccttttattacacttgttaacatagtaaagagagggaagcaacactagggctgattcaccttgtctgtatgaaacatttcttcaatttctgtctggaagttgggtgcttctacaatatccctgaactatttgaaaaatgaactaaatataggtaagaaaaaagagtctaggctgggcgcggtggctcatgcctgtaatcccagcacactgagaaatggtgtcacctttaagtctttctcctttagtgaggcatatgtgaaacactattaaaatgctgcc

SEQ ID NO: 117472 - DNA, 692 bp, Homo sapiens
tgtttcaaaaggcaattatttaaaataaaatgcagttgcaacaactgtgattcaattatgagtttctgaatgttttaatatacttaaagtaaatacagttttgtacttttttgtaaagcattgataaagtaatttcaccatttactttctcagctttcttaatgcagaatgattcccttttcataggatcatttatttagcatctgaagtcaaaattaataggcttgattgagacacttgtgcactttttagtggtaatgatcattcacaagtgccttcatatttactatgttccctaacttagttttatgtctttttcagcattcatttttctcagaaggcattattatggttagacaaacagtaatttttttaaactattcatttaatttaaaatttcaaaattattttatatacattacactacttaaaatagtcacttttccccaaattctaaactctcaggatcatagtcgttggatatttattcccctttaaagaaaaacctttagaagatctatgaatgttaacagttcggtggaattgaggttacattttacctttactgtaggaaaacaaataagaaattatgcccagatgtcagcttggttattagcacttgttcctggttaattattaaatgtttttattaataaagttgcagtctttccacattatatatttttactgta

SEQ ID NO: 117473 - DNA, 882 bp, Homo sapiens
atctggttctaacctccttctttatgtatctcttttcctcgtgggcttcccttacttacataaagggcaggcactgctacacagacaggcaggaaaatgtccacagtgtctgctggaggaggtgatccaagtatctgcatatggtagataccatgtgaacaattgagaagagaggaaacaactactgctaaagatattagaaaggcttcctggtttcctcatttgagctcagccttcaggatggcaagtgagttttgctggaggaggtcatacaagtaagcattctaggaagaacattaccagcatgcaaaaggtgcagagaagggaaaaaggaaaacgatgctcataaaatgatgatggactcacagtggatttgtttaggggagtagggagataagaacaaaaaatggcttagcaacacattgtggaaatttttgaatggtcagctgaagatactagactcttttcagaatcttttgctttttagtatagtacttggaatactttgtctccttgaattgcatgcttacctctcctgaatggcacagatggtctttttttgtgctacatcatttaacacagtgccttgcctagtgatggtcccaaaacagttgttgatttctattgaaagtgctgactaggtaataagaagtcattactacctaactatataaaagaaaccagaacctacaacagttcctattgccttttcaccatccctcctttctctacttttcaggcttaaattttatgattcacgtgtataatcactcacttaacacacaccctcaactctctggtcctcactcacctggctaaaccccaaccctggtttaatgcaactctaacctgctgattaacatttcattgcttacatgagag

SEQ ID NO: 117474 - DNA, 380 bp, Homo sapiens
accccatcactacaaaaaatacaaaaattagccaggtgtggtggcatgcacctgtagtcccaactactcaggaggatcacttgagtccaggaggtggaggctgcagtgagccataatcctgccattgcactccatcttgcaggacagtgagacctggtttccacaaaatcattcctagagtttgcttaaaaaaaaaaaaaaaagaaaaaaaaaataaacagaaagaagacttagcctaaagaacatagtctccaaatacaaaggatggtagcttagaaataaaagtctttaattatttgtcatattctatacaaagtttgaagtctgcattaagttattaagagccccattcctgaggcttattattcaaaagggtggaa

SEQ ID NO: 117475 - DNA, 103 bp, Homo sapiens
gtccaaaaaaatcacgaaagcctgttttcaatttcatcattctttaattcacaaatggctcacacatgtaactccagcattctgggaggtcaagactggagga

SEQ ID NO: 117476 - DNA, 493 bp, Homo sapiens
gccatggtgatgcagcccaattgagcattggtgattggccctgaaatatctggcttgcacttcacagggagtaaagcaaactgatgtcattggttccccatttatgtgttttatttgcagctcaccagttggtgtactcactgaagaaatcattaagttttttgtacaaatgccttacctatcgctgtagcacaccaaagattactttttaaaaaaatcaaatatcattcccactttgagaattccatgttttaattgaataggaccaaaaccagttcaatgcatttttgctaaatattgtgaaaggcatttttttccttgttattatttaaccatcacttacatctacattgatctactgagtttttctttcatttaggcagtaatggataccagatgaacatcagtttgacctgttcactgctgaagggcagacgatacatttctacctagtgaccttatcttgatttttttttttagtttctcttacctt

SEQ ID NO: 117477 - DNA, 366 bp, Homo sapiens
ggcaatacattgtgaggaggtcagttctcacttcctgcttttacatttcacccctcctttgactctaagttctaacagttcaaattcagttatcgttctcaggcctatcctaaggaacataataaatacagaatatttttttcaaatctatctgcactaattgtgctgggtattatatgtcaaatgatagaccaagtaattccctactcagatataaaatttataatatgcaatttttataaaaattaataaatgttgaaatagaagggaaatgtaccatgtaattcacaaaatctgaaacctttttgaaagaggagggcattaggaaacaatcactgaagattggagggtgagagtttttttttt

SEQ ID NO: 117478 - DNA, 545 bp, Homo sapiens
cctagtaaaatcagcttgcatggtttgcacactggaaaaaggccagttcagtgccccaaaacctcttctgtagcttgctttgcacagaacctggcaagcaaggagcattatggtgtcaggagctgaccagaggactctgtgatgctggatctgggatcagcttcctcctctacgaaactcccgacccttccagttctgtaattgctctgccccaggggctcttaggaagcataattttccatgaagccttgctgcttctgggctccatttctagccagaagaccccagctgtcccacaggtaactgagaaaggccaaagagctctaagcccctttccttactttctcaccgttgttctttggacagtagtaatgttaaatataaatatattttcccctgctattgctgccagaaaatatttataatggggtcagcacagagctttctcaatgacttaattataaaatatgcttataacctgtggtgtgattacataaatgcacaaaagcaacttcagaacgtggtgctgatcataacatagaaat

SEQ ID NO: 117479 - DNA, 221 bp, Homo sapiens
aagggggatggaagagacagacagggcagagcaggtgagtcttgcaggccttgagaaagagaccagagttggtgctaaggcccatggaaggtcactgaaggctggtgatatgaaagaaaatgacatgatcctatttacatcttaagaagtctgctcttcggtgtggtaagtggatgggcaaggaggaagaaaagaaagttgtgaggccatcacagtaagaa

SEQ ID NO: 117480 - DNA, 564 bp, Homo sapiens
tataacctcatgccttgtatactaccttgtttggattgtgcctgagttaagggagtgtatttttcccccaaggctacaggcagattgatcatataaggaaggcttaatttcacatatcaaagctgttcatttaaatcgttcaattaaatatttgtgattaatacagttttcaattctaatataaagattcatattcttcaattagggcataggtaaattgctttttgtagctttctgaaatgtaattcacagattgattatattctcctcagtgaattttgatactttatgtgtacagtcagccctgcatatcatatacataacttcgtacatgggttctatatctgtggattcagccaactgtgggtagaaaatattttggggaaaaaagaatggttctgtctgtactgcatgtgtatagactttttcttatttcctaaacaatacaacaattattaatatagcatttatgttttattaggtatcataagaaattttaaaaggttgcaagaatgattttaaaatatatggacagatgtttgtaggatatatgcaaatactaca

SEQ ID NO: 117481 - DNA, 169 bp, Homo sapiens
agggtgattttcttttcaattttgcattgctggggccagatgaagaaatatgggtttagaaatggagtagcaggctgggcgcaggtggctcatgcttgtaatcccagcacattggtaggcagaggcgggccgatcacttgaggtcagcagtttgaagccagcagtttga

SEQ ID NO: 117482 - DNA, 409 bp, Homo sapiens
tcaccgagaatcttcccctgctctgggcccgtccgtggtgggccagctgctgtgctttcttctatgtaagtaaattaagatggtttaggaagaggagaactcctccttgatttttacctatccaaagatattttctcactaacatgttggcactaacagcagctcaacgccatctgaacacataacatactgaatcctaactattaaccaccttcatgctcttgagaagggggacaaggtatagtttttttttgccataggataacatttaggtgctgttttgtttggagagtggtagagaaatagaatagcctctagaacatttcagcaatctgaggaacccccatcgtgggatcttgcttataatactccactatgtaagacaaaggctggtgctggaactctgggg

SEQ ID NO: 117483 - DNA, 265 bp, Homo sapiens
cactctacttggtctacttgtatactctgtctttatattttgctggatgttggccattttaaataatgtttccacacttatacaatgtatacagaagaatttttatttccaaaaaggtatctttaaaaaatgttttctccctgtagtcccagctactcgggaggctgaggcaggaggatcgcttgaacctgggaggcagaggttgcagtgagccaagattgcaccactgcactccagcctgggtgacagagcgagactccatctc

SEQ ID NO: 117484 - DNA, 651 bp, Homo sapiens
ggaaagagtggggttctgacaatgtgctctgaccaaggcagtttagcaaatttgtactaagtggctgacctttgataagcaccactccttccccacctgacctgtgattccatttttcttttgtgcaaatagttctgaaggtttaatgtttattttttactacgatgcagtagactttcttctctcgtgtagaaactgctcgaatgactgtggatgactcctagaatataggaataacagaattggtttctcctgtactctcaacacaaaatacttctgtgaccaaatgtgtgggagtgtgtccccacacaccaagcagtcaaccagttctgcagcagctgccagctggtgtcctctaatgcagttcagttcagttcagttctgacactgtctacctggagatagcgtcagatctcacagattgagggctcagtcccacaagtctgtccccagtcttcagtgccagtcacaggctccaggtggttttacctgtgcttctgacctgctggctataaactggtttcccaatatccccttattgggttccatgaaattgttagagtggctcacagaactcaggaaacatactgaccagttcattagaaaggatgttttaaaggacacaagtgaacagccagatgaagagatacc

SEQ ID NO: 117485 - DNA, 280 bp, Homo sapiens
ttaatattttttttgtagacacgaggtcttgctgtgttggccaggctagcctcgaattcctggattgaagtgatccacccatcttggcctcccaaactgctgggattacaggtgtgagcccctgtgcccagccagaaatgcttctactttctcctgtagggtggcctgtagcaggatcatccattcacattcccaagtatcctctgttcattcacctgggcaatgagaggagcaacaattaagccagaaaagatttgctgcctccctgtcttgatcccaa

SEQ ID NO: 117486 - DNA, 385 bp, Homo sapiens
tctgaggaggaagccacgagttgggagtttcctctctattgcactgccctgtggggtgatgagagtgtctgggaagtgagtgatatgaattttcctaacagctttgatacaggtggttttgtgcttgcctaggtgcaggaaccttttaactaatttctggatttttcacaaatggaattggtccatgtatttttgttgaatcggtgtctcattgagggaaggagggtctggggcttcctattctgctgatgtcactcctccactttttaaaaattaagaatgtagtatatgttttaaggctttcagcaaagttttggtaatagtctcctgtgattatgcttgtcaacaaagagaaatattgactgagtttttaacttaatgcatg

SEQ ID NO: 117487 - DNA, 709 bp, Homo sapiens
aggtgctgactgttctaacccgcccttattacacataatattcatgactaatgcctgggtggctacttgtaaagcaggcattattcagacaaatgttgcttttacccctgtgagaagaaaagagaacacaccctgcatgggtacgtgtgtctttgtttccagaagccccttagaaagggaaggaaaaaactcacatccttgaattcaaatacctctgtttcttagtactccattttaatattgtagtgattagagtcattgaatccaggctggtacttggctctagaccctttgctttctgatgagggatatctctattctaatggtatcttgtctactataaagaagaaaacaaaacatgacttaaagaaaagaaaaggtctcctctctcagtccctttcctcttctccttttttctctagttttaagagttgagagagtgaatattcctctggttggtcagcatacctcaatttacagataaaagaatagacccttggagagtcacatgactagcttgaggccaaaggcagctggaagagtttgaggtttgatttctaatctgggacttacacaacagggcgattcctccttgactcaagaaacctgggctctgattggtaaagttgctataagaagcctgagaaccatgtaatttatctctagctgcgagatatcaatgccttatgctttgtgtttgcttccaccg

SEQ ID NO: 117488 - DNA, 840 bp, Homo sapiens
gcctcaccagagcagcatgtagcaggcccccatggaggattaacacagtggctgaacaccaagaaggaactggcacttggagtctggatatctgaaacttgatgtgttgaggcttctggtacaccatgaactgatatgaactaaaggattggattcatggaagcaagcccctggacttgggcaggagggacctgagtgtctattctacctgcagagccacttggatccccactaatgtttacacacatgaagctcatggagcaagctcagttctatcatttggcaaaaagagaaggattcaaattcataagcgagtgacatccagccctttctggaaggaataacaattttcaaggccaccaccaaagaaaaggaagatgtcataagcatcagtgttttgcttaccaaaagagggagggcacaacatgggttgacctagcatctctgcttccatataacccaacttacagaacagacttctgtgaatgtcccgaccaatagtccttcatcttctgcctcaagaaaatcttttttcttctgtcaagaaatgagaaccacatggacctcttgtagaagccaatcccgtcatcaatctcatgtggctgacgccagtaacttcaaatgcctgaacttttccatgtccatcctgtagcaaagaactgggcctgttcttctagccaggcagctgaacagctgtttctcatcccacctgtatagtgtttacatttacctctagtcttgatctgtggagtgacagtcaagctgatacctcggcctgagaaggtgaagtcatatggtagtacttcctcagaaagatctgtggcactgttaaagataatg

SEQ ID NO: 117489 - DNA, 221 bp, Homo sapiens
ctgggattataggcatgagccactgcgcctggccttaagtcagatttttaaccctttttaacaaaagagcagtattttgatgatgattatgatttttttttcttgtggccagagtggaaaaacaatcactctcctctttgatttttaatatagcattggtcatcaattagaaacctcttaagatttcctgggaaaggaatatgacactgctaagatatggg

SEQ ID NO: 117490 - DNA, 328 bp, Homo sapiens
tcacggctgtactgcattgttttttaaccaaacccgaggagtgtaaatgaaaactaaaaatgttgcccagaatctaaataacacaaggactacacattttttatgatggaatcaatatgaaaacaggcaatagcattgaaagctctgctttttaagtggctaatttaggaggaacatgcccccttgccagccccctcccctcataaacatcatattgccaccactctgctttcaaaacagaagacggaaatgaaagaatgggggagcaattatataatgaagtttaaggtcaaaaacatcactgttagaacaaacaaaagatcccaca

SEQ ID NO: 117491 - DNA, 734 bp, Homo sapiens
tatgtgtatatatactcacatgtatacatgtatatgtatatatgtatgtgtatgtatacatgtatatgtatacatacacatgtgaacatatatacacgcatacatgtatatgtgtatgtatatatacacatgtgtgtatatgtatatatacacgtgtgtgtacatgcacgtgtgtgtacgtacacgtgtgtgtacgtacacgtgtgtgtgtatatacacatgtacatatatattttggaactttgtataaataaaagcatataatacgttttctatctagactttctttggttcaacataatgtgatgagattcactcatatttcatatagttgtagattgttagattgattctttttttggacaagggagtatgatttattggtgagcatgaataaggggacattacagtgaacaccctcacgaatgtagtgctcaccacttgtccgggggccacatttgtggatgtttttgacctcacaaccatctgggatgagccacttctcagccgccatgtcttcacatttatccacattaaatttggtaaagccccactttgagatgtgggtctttgggcagccagggaccttgaacttggcgctgcatggggccttagttgcatgctccttattttgcagatttgtgtggatggacatgatgacttggccactgtgaaccctggtcacggtgccctgggggctttccaaagacaccttgcataatagctctcagaag

SEQ ID NO: 117492 - DNA, 374 bp, Homo sapiens
aagggagctaccggcattcagcagacaggagtcagagatgctgaatatcctgccatgcaaaaaacagctcgatacagtgatgagtcattctataccctgcaccatcttcacagatccctctggacattcatgtgcatgcaatacttgtttacagttacctgagtccaggattcaactccaatttatacataaacacaaagactttgtatggctctaatacacatcgaacatttcaagaataataccgtctgaattgagagatgatgttattttgcttcattcagtacttcaccaggaggaaacttcatgactttggaaaatcaacatcagcgctgctgtgatatctgtgttgccgataaatcacatccctatca

SEQ ID NO: 117493 - DNA, 557 bp, Homo sapiens
tcagcctctgagtgcaccatcagcatctgtatgggcacatcgtacccctccttgcccgcctttcctcatgccaccagctagggatgtgagctccccaaggccttggaccagctgggccttcatgggtgcatctcctgtgcctgagagtatggccaggacaaagcagacaatcaaactgaaaaatgaatgaataacaaaagaatgaacgaatagaatgaatgaaagcagaaagaatgggaagagactgaatgaaaaaaaaaatgaatgaaagaatgaagcatgaatgaaactcacaggaaggtctgaaaggccatctcttccagtgcctgccagagacaggaagcaaagtccagcatcaatgacagtggctcacatctgattctacagtggcaactacatcgctctgccagagattattctctccccgtcttccagatcacactgggcctgcagaacagcgaagagccaggagctgtggggagagttcccgaagaggagtacagaggttctgtgccctcccaaggctctcctgaaagtcacaggagcctccctggtgc

SEQ ID NO: 117494 - DNA, 485 bp, Homo sapiens
tggccctttgtctctggtgaagccttctctgactccctcaagtactgcttccaaccactacaccttgaacatatacaccctccttagacaaagcatcacactgtattatagctcctggccggtgtgcctgtcttcccattccatgcaggtacacaacctttggagatgatgttccattgactatacagtcccaggtttagaaggctcagtattcacggaaggaattaataaatgggaaaactgtttcttctaccctctagcagttactacagtgtccctctgatcaaagagacggatggacctacgcccagtctttggagctatagacagatcctttaagtagaagagaaaatgatactatccataaaaggaatttatggtatattcttttcatcaatgcagccagactgcaggtcttaaagagggtccttttacggataatatcattttctccttacatataagctcctccttatataccgtaa

SEQ ID NO: 117495 - DNA, 176 bp, Homo sapiens
gctccagggcggggttggagactcccacgtggaggaatcacgtgggtgctcctccatcttctgcccaccctaaggggcctaaaactaaccccagccacttttctactgaatagtcattggctcttaacatgaggtttgagatcaaatgacctccctccccaataaactttttagaa

SEQ ID NO: 117496 - DNA, 189 bp, Homo sapiens
atatatttttaactaaaaggtaagcttgaaagcagtgtgctaaagtcaaattatgtggtctgagccaccctctgtacaacaactttaattctactttctgtacttccactttttttctgtgtaactgtttgaaaacctcaaacacccttgttctaattctacactattcctgggaatcctttctctttg

SEQ ID NO: 117497 - DNA, 463 bp, Homo sapiens
tgaaactagagtttaaagatgagatataaaagctcgagaaataaaagaagacaacagaagtattgtaagagtgagctgatggaatcagggtacaaaataagagaaaagtaacattgcagaaacattcaaagtgcaaatatcaactatagctgggggtaatggaagcaagcttgagaaatttgagcaacccaaaatggaacaaataaaaatgaagaaagactagagagagagtgacagatagggaatacagtcaatctagtatgccaataattgatacccctgaagctgtcggagaataaatcaagcagaaagaaatgtcaatacattaaggaagagtttcccacaataaaagatttgaaggcaggtgtggtgacatgcacctgtagtcccagctatggtggaggattgcttgagcccaggagttcaatccagcttgggcattatagtgcaacctcatctctta

SEQ ID NO: 117498 - DNA, 302 bp, Homo sapiens
ctcaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccggcgggaggtcaccgtgagaccggacttgcctccgtgggcgccggaccttggcttgggcgcaggaatccgaggcagcctttctccttcgtgggcccagcggagagtccggaccgagatacatgccaggactctccggggtcctgtgagctgcc

SEQ ID NO: 117499 - DNA, 551 bp, Homo sapiens
agcctcccaagtagctgggactacagttacatgccaccacgcctggctaattttttgtatttttggtagggacagggtttcaccatgttgatcaggcttgtcttgaacacctgaccttgtgatccacccacctcagcctccaaagtgctgggattacaagtgtgagccactgcgctcagccgccctttttaatactatggttattttagttgatatcttcagattgctcttgattggagtatataaaatatgtcatagattgtgttattttaattttacttgtctatgttcttatttctttgaagttgctatttttcactatattttgctgtcacctataaattataaatattagtcttaacagaagtcagatattttctatattggatttttttttgaaaaaaaggagataggataaaatgtaaggaaatcaaatctaggaactaatttagaaaagtcagaggatttttatttagtattgagaagtataagataagttaaatgtatacaccagagaaaaaaagttcttattacaatgtaatatgtggaac

SEQ ID NO: 117500 - DNA, 405 bp, Homo sapiens
attttttgttttagtagagatgggatttcaccatgttgcccaagctggtctcaaactcctgacctcaagtgatccacccgcctcagcctcccaaagtgctgggattataggcatgagccactctgcccagctgtggttattcctaaaggccagtggtggggcaggataacaaggacagcaccagagtggggaggggtgaatgaacctacagcgtccacatcattgcttccctcacagagtatgttcagccaccagttgacagtgggcgggggctgcccagcctgtccaggagctggagcacacctgcatagctttcagatcacacagaggtgccctgctgcagacgctcaggctacatccgttctagtgggtgtgtttgaaggtagacattgggaaactggctgg

SEQ ID NO: 117501 - DNA, 774 bp, Homo sapiens
agccaggatggtctcgatctcctgacctcatgatccgcctgcctcggcctcccaaactgctgggattacaggtgtgagctactgttcctggccgtgagttcttattcttacctggattagttctcttgggaatggattagttcctgtgagagacggtttttataaaatgaagtttcccatcctgtttgatctctcctcatgcgtttgtgcttcccctttggccttctccgccatgtaatactgcagcatgaaaagccccaccagaaagtgagtagatgccacggccgtgtttcttatacctcctagattgcagaactgtgagctcaatacacctttttttttaaataaattacccagcctcagatattctgttatagtaacagtaaacaaactaagacagtctcctttatgcctataaaatgcttctctttatctctagtaatcctcattctgaattctactttgtcttattttatataaccattctgctttcttataattggggtttgaataatttccccttttcaatattttaaaaatagctgggtctttgtatttaaaatggtgtcatgtagactgcatatttgttcagtctgataatttttgtcttttatcagttttcatcatttacatttagtgtgattatcaatatgtttgggttttcatctacccattgctattttaaaaatttgtctcatgttttctttgcccttttccttttgtgacttcttttaattaattatgtttaatattttgtattatttcacatattgg

SEQ ID NO: 117502 - DNA, 103 bp, Homo sapiens
tctggtctacagtaacgggtccccaacgccgcgtcttaaccaggcccgaaccgaccaccgccaaccttccctgacacgcctttgccccacccgaccccgcccg

SEQ ID NO: 117503 - DNA, 428 bp, Homo sapiens
tagcccatagttcaagggcataaccctgtcagaagattctgagactatgacagttgcctggctcttctccctatggattcttaggtaccaagattcttgaggctcaaataaaaatcatgattcataaatataaaggcctttgattcacactgtattcttagagactcactccttgtgtatctcaggacatggtgtctccactgccaatatcctgcctgaagccaagccaaggccctcgaaactcattttatttgcttgccttttatgagaattacaggggacctggtccagataattacctaattcccactctaaaaatagctagctctggggggcagggaagaaaatattaggagaaaacacttttgtaataatctctacctcaaggaaactaggagttaatgcacacactcacagcagaggaataa

SEQ ID NO: 117504 - DNA, 468 bp, Homo sapiens
tgagaggttcctggtaggagatggatgtgtgtgtgcacatgtgtgtacatatgtgtatggggttgtgcacatatatgaatgtgtgtacgtggatatgtacatgtatttgtgtgtgcctttgtgcttatgtacacgagtgtacatagctgtgtgcatttatgtgtgcatgtgtgtatatatgtgcatctatgtatgtgtatatgcgcatgtgtgtatgtaggtgtgtacatgtgtttttgtatgattgcataaatgtacatgaatgtgtgcctctgtggggggtggtgtgtgcatgtatgtgtatgcatgcatgtgtgcatgtgggtatatgtgtgcatgcatgtgtatgcatgcatgtgtgcatgtgggtatatgtgtgcatgtgtgtgtatgtgcatgagtatctgggtgtgtgtgtatatttgtgtgtgagtgtatgcacgtgtgtgcgcatgtggatatacatat

SEQ ID NO: 117505 - DNA, 567 bp, Homo sapiens
attagtcaactaagtcaacctaaatgtgaaataaaaatgttcgttcatttactaagaaatatttattgaatgccaattacgtacaaggcactgttcgaagccctagagataagaaaaacaagatttctacacagaagatcatattttaatgggggaggggagatatatcagacaagtgaacaaacaaagataaaataattaaagattataagaaacaacagagtaatagaaacttcaaacacttttttttccaagagacaagggtcttgctgtcacctagagcaagcaatcctccttcctgtctcggcctcccaagtagccaagacacaggtgcatgctaccatttccagctaattttttaattttctagtaggaacaggggtctcactatgttgcccaggttgatcttgaacacctggcctcaggagatcctcctgcgtcctcccaaagtgctgggattacaggcatgagccaccttgcctagccaaagactatttttttttcttttctttttgagatagatccgcccacctcagcctcccaaagtgctgggattacaggcgtgag

SEQ ID NO: 117506 - DNA, 832 bp, Homo sapiens
agcgggctggctaattttaatttttttttgtagagatggggccttgctgtgttgcccaggctggtcttaagctcctggcttcaggcaatccaccagccttggcttcccagagtgctgggatttataggcatgagccaccatgcccagccaaaaaaagtatttttttaaagttagaaaacacctttaatttaaacagccttttatgattataatataaaaggccaacataaaataatgtattttactatgtaatataaaaggtataattttgcttatcgtttttctgttaagatgtaatgatactagagaaaggcaactcagctacctgggccattttcagttaagatgtaatgatactagagaaaggcaactcagctacctagggcatagtagggggtaatggtgataccactgtatgaaagtataccacttattgtctagggtaatggtgataccactgtatgaaagtataccacttattgtctaacaagacagtgatatgaataaattgtactaaatactgaaaagtgtggctagatttggtcactaaatttcggttttctagaaaaaaggggtctgagaatggtgaatttagtcacttatctaatgaccataacctagcagagaaccaagaacaaagggggaaaagtggtgcatctctgagtaaccaaaaggttactcattctcaaaaggtacatgtgctcaaaggaacgtgtataaaacctattaaccttactagtaggagaggcccttacttaggttgtatttgctcttactttagacataattctagtaattgattagctggcttacctgctcaagaagagtaaag

SEQ ID NO: 117507 - DNA, 752 bp, Homo sapiens
  misc_feature (505)..(505): n is a, c, g, or t
  misc_feature (510)..(510): n is a, c, g, or t
ggccgggcgcggtggctcacgcctgtaatcccagctctcagggaggctaagaggcgggaggatagcttgaggtcgggagttcgagaccaccgtggccgacatggcgaaaccccttctctactaaaaatacaaaaactagcctggcatggtggctcaagcctgtagtcccagctcctcgggaggctgaggcggcagaatcgcttgatccccggaggcggaggtcgcagtgagccgagctcatgccactgcactccagcctgggtgacacggcaagaatccatctaaaacaataaaaaaaaaattaaaataagtaattgcccttaaattgggaaatgctcaacaacccacgtgattctgaatctgaaaaggccagatcagggagatacagagaagaataaataaaacacaaggcaagagaagatttatctctggagcatccttgttgcagctgttggataatggcctccagctgcatctgtgtagctgctaaaaacatgatttcatnctttncaatggctctatactattctacggtatatatgcagcaactacatttcttcatccaacacataattgatggacacctgggctgattccctcaatgcctcccaagattgaatcaggaacgaaatcagatccagaaacagaactcatttccatgaccaggtactgacattgactccgtaatgttccaaaaagcttatcaagtcagaacaacaaaaatatggcccaagacacccccaccaattgca

SEQ ID NO: 117508 - DNA, 480 bp, Homo sapiens
aaaataatgattgtaaggaagtagggcttaccccaggatgagagtgattcattactagaaatagattatttaaagaccaggatttactaggttaacagaataaatgagaaaaactacacaacgtatatgtgtttttaaaaaaggcattttataaagttcagtccgctttctgttttctgaatttggggggattacattgtgattgcatgtatgacaacggtacagttgagtaatgatggaagaatgacgtacctgtgtggccaccacccagatcaaagccttgaattctggtggcactgcagaagcccactgacctcccatccccaaaagtaacccctctcctgagtgctaaccgtgtaggatggtcgtgtttgaagtgctaactctgtaggatggtcgtgtttgaagtgctaaccctgtaggatggtcatgtttgatttcgttctttctataaatggaattacacagaatgcattcttt

SEQ ID NO: 117509 - DNA, 437 bp, Homo sapiens
gagatgactacttccatccacccacagggaatgtagatctgggaggcttcctggaagagcggatttgggaaagtgcagtgtaggcagaggaaacagcttgaggaaaaaacccggaggcaggggattaaagtaggggttcaagaatggggttgaggccaggtgcagtggctcatgcctataaatcccagcactctgggaggctgaggcgggcagattgcttgagcccaggagttcaagaccagcctgaccaacatgatgaaatcctgactctactgaagagacaaaaattagccaggcgtagtggcacatgcctgtagttccagctacttgggaggctgaggtgagagaatcacctgagcctgggaggttgaggttgcagtgagccaagatctcattactgcactccagtctgagcaatcagagtgagatcctgtctc

SEQ ID NO: 117510 - DNA, 380 bp, Homo sapiens
tagctgggactacgggcatgcaccaccatacccggctagttttgtatttttagtagggacaggtttttgccactttgcccaggctggtcttgaactcctaacctcaagtcatccacctaccttgcccttccaaagtggtgggattacaggcgtgagccaccatgcccggccaagactacttctgatgtgaggagtgtgctggtccagacaccacactggaagaatcactgaagaaagcaattcccatttgccctgtgtgaggaaaactcaatttccccatatacgtggcacgcttctaggtgctccttggtatgattccctttgttgagccagagccctccgttagtcctgagctttaaaacaaaagtttgtctccaacc

SEQ ID NO: 117511 - DNA, 224 bp, Homo sapiens
gaaggaaaatatccttttgcatcttgaaaggcatctcacatgttaatattttgcttaactgcaggtgaggtcttcattcaacaaagtggcaaaggcccaggaaggggactgtttgggagtggtgacacactggtgtagacccttttagccaaaggggaaataggagctgtcctaagttaccactgagggttgcagggcagccccagatggggaggggccggcct

SEQ ID NO: 117512 - DNA, 160 bp, Homo sapiens
aacggaacctgaccaacctcctaggccagacacacgacctagctcccacctaccgtatccctcctccctccttcctcctcaccctatccaaccccatcccgcccctctccttccctgttccctcccctttatccttcccttcctttccctccctcccttc

SEQ ID NO: 117513 - DNA, 265 bp, Homo sapiens
tagaactacaggtgtgggccaccacgcccatctaattttttatttttagtagagtcggggtttcactatgttggccaggatggtctcatctcctgacctcgtgatccgcccaccttggcctcccaaagtgctgggatttcaggtgtgagccacagcgcccagcagagggttgactcttaatcctaatcctgacatttgtgtcagatttatggaataatgtgatttacagatcataaagagacattatgagatcatcctttttact

SEQ ID NO: 117514 - DNA, 302 bp, Homo sapiens
gggtcctgcagtaggatagggggtgaaactcagcaaaatgtcaggttatctgctgctaacataaccccatctgtaacctccaaggtccttgggcctttcaggaacatgtttttcacatttcatagaccactgtaaatctaaatagctaatacaacagctaaagatcttaaagcaatttggagacattcatatagtaaattcccttcgtctaccaaaggaaatatgagcatctctgaggcagagcagctgcttaatggttacagagcaatattacacaacagcttaatccaggaagaaaagaa

SEQ ID NO: 117515 - DNA, 577 bp, Homo sapiens
ctctcccccatacaccccccctccacacacacacaatttttgccctttgaactggaacagtgatccgttccctgtgattaaattagtgtaagtaataagatatcatagatttgattgatttccccagcaatgattattaaccagcccaattcagagccaagcaggaccattattctaaacactgttttctgagcaggcatgcagtggaaggaaattctcagctacagagatattccataaggaattatcagataggatgatatatagttaggattctcagacatggcaacgaaccccatggaatcctcaaataccatgatacacagatgttagagtccaccaggagttgaaccaatgctgtaaatacacttcactgatgttctcagggaattcttagacacaccacaaaatgtaagagctgagaactgtattatatcccaatcatcgtacttaatccaacaaatatatacttagtaacttatccgaaccacattttccagaggctcaggagacaagaagaaacatggtttttaaggagctcacagtcaacatgcgtttcttgaggaagcttgaaaat

SEQ ID NO: 117516 - DNA, 314 bp, Homo sapiens
tgtgggttcaatttgcacttaacgtgcattgtcctagttactaataatgttggctatctatatacaaaaatatgaaccttgatgcttatcctacctcatttatcaaaattaggtcaaaatggataatagtcctaaaattaagagtaaaaattttagatctagaaaaaaagtaggagaaaaggatttgatcttggcttaggaaacacttcttagaaaaccagaaagacattctataaaggacaaattaataaattggacttcatcaaaattaaaaacttttgctctttaagatatcatttagtaaataaagggca

SEQ ID NO: 117517 - DNA, 492 bp, Homo sapiens
gggctgaagtgcagtggtgcaatctcggctcactgtaacctctgcctcctgggttcaaatgattcttccacctcagcctcctgagtagctgggattacaggtgcccaccaccacacctggctaattttttgtgtgtgtttttagtagagacagggcttcaccatgttggccaggcttgtcttgaactcctggcctcaagtgatccacccgccttagcctccccaaagttctgggattacaggcgtgagccaccgcacccagccaaaaatcaataattttaaatgtttcatacttattgacattaatgaaacctcctgaaaaagcatttaatgcaactccgctgatattttaaatttacgttcctcacattacaaggtcaggtcagttcccctgggtttcacagagccgacgttatcacatagacacgactttgttcatgctgtgtatggaacaacccttcagagggttgctgagctgtccatggtgctggga

SEQ ID NO: 117518 - DNA, 416 bp, Homo sapiens
tttctctctcatttacaatcctgttgcaagtatgttatcttgaagaaatcacacatttccatatgggaacattttcctttggttgcttaataataaacatgatcattttagcttaatcctttaggctatagaattgcaaaggttgggggaactacctccttgtattctaatcaaaaatttgtacttaatgaaacagaaactttttagtgtaagtagccatgtgcttatttaattccaagatatccatgccctgtaaactttccagtgattacaattgtaaacatatacaaagccttctcagccctgagatccaagcatggagaacgtgaccgtatctgtggtttagtctgtaagagaacaacatatcccaaggctacagcatgatcagtttggaagggaccttagaggagaatacg

SEQ ID NO: 117519 - DNA, 407 bp, Homo sapiens
acatccttcctctctcacgatctcccctctctcacttgtgtctggaaaaaaaagtgataatttgaagagattgtataacttgcccaaggtcacgtttcttttgattgagggaaccaggattcagagtgatactgacccacactcttagccactctgcttaaaatgccagtgatagtaactaactggggagggggaaggaacagccctttgaagtggtgacagctgagctgagacctgatgtgtgagaatacaccaggcatcttgtgaagtgcaagcatagagtctggctggggaaaaggtttctgggtttgaggagagaagggaggtcagtgtgcctggagcagagtgagccaaggagagagaagtggggaacgagggaacagaggatgagagggaagtgcaggtat

SEQ ID NO: 117520 - DNA, 270 bp, Homo sapiens
ctgtgattgtgccactgcactccagcctgggcgacagaaaccttgtgtctggaaaaaaaagtgataatttgaagagattgtataacttgcccaaggtcacgtttcttttgattgagggaaccaggattcagagtgatctggtggggaattttaaagaatcactctggcagccttgtggaaaggtttgtagactacttaggggacttcttccagagttcattgaaagggtgctggtggcaggcccaatagtggtggccatggcagtggaga

SEQ ID NO: 117521 - DNA, 792 bp, Homo sapiens
tgatttttttacacaaaatcaaaataagcatatgaccttttaacttctctagatcaacaattctttcaagctgatagaatgcaattgaatttttcttcatattcagtgtatacactatagcatgtctttaacttgtcttttgaagggagcgttttgagaaaagtttatttccttgaaaatgcttagatgtggactctgaattcttgagttgagtcattatattatcgcagtaattcctgagtgcctgtgtgaatattatttctctcagtattatgcacaatatctcacatgtggtcctgggccctgaaaatgtaacagatacgttgggctttcccccgagtaccaatagatttgttcatggcactgatttatttattcttctcctttatgaatgttatcttccttttcccttctttagagtatagatgtctttattagcaaaataatttttcatttacacccttgaaaccctatgggaggcaaagtgttttaaagctctcttgtgatcttatcttgtcctcattatccagagaggatgcagaggcttacctattttatttggatgaagacagtttataggaagtctgatccaattcatggcttccccctttcccctgtcctttaggtttaaaccatttcaccaagagtttcttacaatgagtgagtaagaccaaataacactgtctcttggcttccttgctgataaccaggacttctcattgctgtttttcacctgccctcttctgtctatattttggcgtcaagtttgtttctctattagcaggtctggga

SEQ ID NO: 117522 - DNA, 458 bp, Homo sapiens
aacacttccgctccctccacacttcaccaccacatcatcaaaggcctatttattgcagttccttttacgcagtatatcaagtccaactttcaacagaaaacatgacaaggtatactaaaagttaagaaaaacacagtatgaacagacagagcatgtaccagatccagattcagatacagcagggatgttggaattatcaggctgggaatttaaaacaactatgtataatactctaagggctctaatggaaagagcagataacacacaagatgcggaacataagcagtgagatggatctaaggaatttaaaaaaatgctagagatcaaaaacactgcgaaataaatgaatgccttagatgggttcattagtagaccggacttagcttaagaaacaatctctgagcttgaggatatgacaataaaaatttccaaaacagaaaatcaaagaaaaaaaaaga

SEQ ID NO: 117523 - DNA, 386 bp, Homo sapiens
cagggtgactctgtctcaatttaaaaaaaagaaagaaagaaaggatatacacacaatgtaaaatcactgcaccgagtcagtataggggctgccttaaactcagggaacagccaaatctgtttatgaattaaaagaacagtcactaaggaggcaagatcaagtatcatcaaaacattaggccttgacatagaacctgaaggattcccccaagccctagggctgtatccagacagaattttcattccataactatcacaaaatgtctctttcatttccagctctgtgttagaggtcagggacataaacggctctcatctccaggccctgccatgatggacctcacagcctaatggggaaaagagacacaaaaccagacaatgacagaa

SEQ ID NO: 117524 - DNA, 576 bp, Homo sapiens
agtcctgtggattccagggctgctcaggagacgcctccatcctggcgtggatgacctcaggatcagccccgtctgccccactcagcccgcagcctggtccccgaaagcgctcagtcagaatccgagagcagtgtggcggcgcccccgtgtggccacaggactgaagacagaggaccccgctcccctttctccccagccaggacgtcccaggctctccccctgttccccgcacctggacgggactctgcacagaagagagtctcccggtctcgtgtcaggctctgagttcatccagcttcccaaaatccatgttgatatgaacgttttctcccacaactgattgactggacttttgtctcagggcagagggaggcctccagaccaaaacagcaggatcaggtctggagctgactcaaccccaaacccttgctaatgcacgacccagtcccccagcctccaggatgggaccttggcctcctgtcccctcccttgttcctgccactgctcctgcaggtggaggctgctcatcccaggaatcagtctgtgagctccaaccttggggcctcggtccaggaa

SEQ ID NO: 117525 - DNA, 440 bp, Homo sapiens
gtagtgttacacgtaaaagagcagaatgtcaaagcttgatgagacctcatcatatatagaattggggactctatgaagacgcctctcagaccaattttttcaggttgaactacacattacatgtttcactccaagcctgagtgactaaaatacaaagcagttcctaagaagcttaagacaatataaaaaggggtaactatattgattcatcttaacacaagacaatatctattttctaagatgcagaacacagagaggagacaggccaagggcacgttttcaactgtgtgaatgatgctgccccctggcccttgccctcccgccttgcctactaccctctgtaggcctcaagactcattacccttctttggcccctatgctggtcacccccaggccacagccactacattctgacagaaagaatcctgaaggcaatgggg

SEQ ID NO: 117526 - DNA, 282 bp, Homo sapiens
aacaggtgagagaagaagtttaagttctgcttacaaatgaggtgagagttcatttaatctattcaccatgaccaaagttacaaagggctctctggttattaagcattcagttattttttcttgttttcaaaaattgatttttttttcagtctaagaaagtaaataaagcttatttctttcaatctttcaaaatattacaatgagattatttgagcctctgttctggtaaaatcatcactttttcaaagatgatttcttgctgttgtctcattatttacatgg

SEQ ID NO: 117527 - DNA, 368 bp, Homo sapiens
agcactagaattgctgagcatctgggcgatagccagagcttgggtagaatgctggccgattatcgagccagaggaggaagaattcagcccaaaaattcagacccttttgctcattcaaaggatgcatcaagtacttcaagtggcaaatcaggaagcaaaaacgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggtaggattcttttccccctacactattccacataagaacagaattccagca

SEQ ID NO: 117528 - DNA, 608 bp, Homo sapiens
agcactagaattgctgagcatctgggcgatagccagagcttgggtagaatgctggccgattatcgagccagaggaggaagaattcagcccaaaaattcagacccttttgctcattcaaaggatgcatcaagtacttcaagtggcaaatcaggaagcaaaaacgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatt

SEQ ID NO: 117529 - DNA, 909 bp, Homo sapiens
agcactagaattgctgagcatctgggcgatagccagagcttgggtagaatgctggccgattatcgagccagaggaggaagaattcagcccaaaaattcagacccttttgctcattcaaaggatgcatcaagtacttcaagtggcaaatcaggaagcaaaaacgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaaatagaccctattactatattttgtttgccatttatttctttatttgtatgttttttttttttcctgaggagaaggtttcctatatggtactggattcgttatttgttatagagctctatttgtcattgttattttaccttccagtgctgtatgttcaatctagtattcgttttttgaagatcccatcttaggaatgtatcagtcattaaataaaatacaagtgccttatacagtaaagtatcttgaggttgtatcatgacatatctcaattttgtttattcattcaacaaacatttagcaccatttatgtgccagatactgtgctaggccctaggaaaaaaaaa

SEQ ID NO: 117530 - DNA, 382 bp, Homo sapiens
aaaaagtagttacataaacctgttatttcgagatatggaggtaaatatcaaaagaatcagctaaagaagttgaaagtggttgcccttggcgataagaaatatgggcagggactgttggtttttctataaagctttgtagaattatttgtctctttaacgtgcaggtacaactttaaataaatgaattttgaaaaacacagaattgggattaactgtgcacattgctgtcaattgttgtagttcaggccactggtaccacacaatttaccaattcaagtttgatatccacctggccatttttaggatgtgtggaatatttatttatagaatttagagctgaaggactttttacattttttaatttattttttcaatgggtttt

SEQ ID NO: 117531 - DNA, 728 bp, Homo sapiens
agtctcagccatggttgcataccttccaagctccaccgcctcttcttcctcgtgggcagatccctgattttgtgtaggacagcacttgaaatgtatttgtgtgctcaacattggtttcctctctggaacctgggatcacttcaggggtggacacgtggcccaaccatgactgatgagacatgcggggaaatctgcagaggcaacttctaggaaaggttgggctcttgcagccaccctgtgactatgagcattctgaccacaatgccagaagacaatacggaattactcagtacatgaagcaccaggaagatgacaacagaagagagaggacccagacattggaatcagcaggttcaaaggattctcctgcctcagcctcctgagtacctgggattacaggcatgcaccactatgcccggctaatttttgtattttttatagagttggggtttcgccatgttgaccaggctggttttgaactcctggcctcaagcaattcactggccttggcatcccaaagtactggaattacacctggctaagcctcttctatttaaaaatagaaataaaagaaaaaaaaaacagatcaaaaccaaaagttatagtgagagtggacaagccctggacaacagcaggcatgaggacttacagcccacatgctcagccaccaggtgcaatctccaacatgtgcgggctttgggaaaacacaatcgggcaagtgaagtttg

SEQ ID NO: 117532 - DNA, 636 bp, Homo sapiens
gcgagtctgcagagctcgcccggaagtagcgttgcgcgcgcagaggatgggcgctgagcagcacacagcccgcggcggggtctcaggatccgcggcgctgcccggggccgggggaaggaagccagccgaggagacgcacgtgccctgagtccgggagcggggagcctcttcatctctccatcctccctccgcgcgcgccctcagccgtcctcgtccgctcaccatgcacctcccctccaagaaagggccacatgcgtgccagggacgcgagccccggccacagggacatagcagcctagaagaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagtaaaggctgtcactctatcttgggcgaagat

SEQ ID NO: 117533 - DNA, 467 bp, Homo sapiens
agcgtctttagtttaaaatgtcaataaagatacaccaggtgtggtggctcatgcctgtaatcttagcatttggagaggctgaggcaaaagaattgcttgaggccaggagttcgggactagcctgggcaacataaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagtaaaggctgtcactctatcttgggcgaagat

SEQ ID NO: 117534 - DNA, 944 bp, Homo sapiens
tgattgcatcgctgcattccagcctgggtgacagagtgaaaccctgtctcaaaaaacaaaacaaaaatccaagtcaggcctcatgagattgagtccctatgacatttccaaggtgagggctttgctctgataatggggatccttcagagaaggctttctcccacctgtgcccgcgaggcggggggtgggggtggtctcagcagttgatcgggagcccacgggcaagcgtggcctctcatatcctctctccccactctgatgtctgccttcacagatacctgctttcccacaacagcaaggaagaaccatggcccaggggtcactgtcattcggggacgtggctgtgggcttcacccggaaagagtggcagcagctggacctggagcagaggaccctgtaccaggatgtgatgctggagaactacagccacctgctctctgtgggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccagaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagtaaaggctgtcactctatcttgggcgaagat

SEQ ID NO: 117535 - DNA, 736 bp, Homo sapiens
tgattgcatcgctgcattccagcctgggtgacagagtgaaaccctgtctcaaaaaacaaaacaaaaatccaagtcaggcctcatgagattgagtccctatgacatttccaaggtgagggctttgctctgataatggggatccttcagagaaggctttctcccacctgtgcccgcgaggcggggggtgggggtggtctcagcagttgatcgggagcccacgggcaagcgtggcctctcatatcctctctccccactctgatgtctgccttcacagatacctgctttcccacaacagcaaggaagaaccatggcccaggggtcactgtcattcggggacgtggctgtgggcttcacccggaaagagtggcagcagctggacctggagcagaggaccctgtaccaggatgtgatgctggagaactacagccacctgctctctgtgggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccagaagaagtttggcaagttgctacccagccagatagccaacagcaacacgaagaccaacatttgagccatacgtttctagacaagaaagactggaccggaaatgagcttcatgaatgtaacgaacttg

SEQ ID NO: 117536 - DNA, 228 bp, Homo sapiens
tggccttgggtttcagtggtcagagtctcgatcccacttggagtcctcgtgaagttacctgccaagcgaaacagctctctgtggctgagatgtccaccttttgttttgcaggctgaactgtctgcttgcttggaaggcccagctggctcagcacaaatcctttaaccgtttctccccaagagggtgtcaagtcagcaaaccagctgtgatctccagtttggagcaggg

SEQ ID NO: 117537 - DNA, 1040 bp, Homo sapiens
agctgcttttacgcagtgttttgaggtgcaggactgcaatgcccgcacttccggaccccagactcttcctacggcgactgacacctcagacacgcgttgtggggggcggcgctctggctccggggctgtgcccagcgcgagcgtggccggcacccacttgctgcagagccggcactgcactggggtccttgggggcggctcctccagacgtctctgcgggttgtcgggtgctgccgagttgggttgggggacgctacaggtagtgggtccggagcagcggctggcccctcatctcactgcccttcctcggaccccaccgtcctctggaagcttgtgcagggcacctgccactgtgaccacctggacgcagatacctgctttcccacaacagcaaggaagaaccatggcccaggggtcactgtcattcggggacgtggctgtgggcttcacccggaaagagtggcagcagctggacctggagcagaggaccctgtaccaggatgtgatgctggagaactacagccacctgctctctgtgggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccagaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagtaaaggctgtcactctatcttgggcgaagat

SEQ ID NO: 117538 - DNA, 737 bp, Homo sapiens
tgaaggctagacttgcgtaggagagcagacacgaggacatgagccagttctgctgagctgttactgtatacctgctttcccacaacagcaaggaagaaccatggcccaggggtcactgtcattcggggacgtggctgtgggcttcacccggaaagagtggcagcagctggacctggagcagaggaccctgtaccaggatgtgatgctggagaactacagccacctgctctctgtgggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccagaaagctgacttcatgagaccgaggatctcgttcgttgatcgatgctacatattcagcatgttagataatgaggttggtgagattgatgaaatcccgcccaccagggccgacccacaaagagccactttatgaagaacatgctcctgaactccactccacaaccagcttttgaaaagaaaaatctgaaaaaatttgacctcagttaaactggtccaaatgcctgagcataaccaaaatctttcctcattcactcttcacgtggaccgtgtttaatttggttgctggtgatcatatttgttttagtaaaggctgtcactctatcttgggcgaagat

SEQ ID NO: 117539 - DNA, 744 bp, Homo sapiens
cacaatatgtaaaaatgttcattaaaacattgtaaaatgcatctacatttgagaggaaaaagtaaaactctctattcacagataacacaaatatacagaaaatcctaaggaatccactaaaaaatcattagaagtaataaatgaactcagcaagtttacaagatacaggatccactgagattctgataaacatggaaggcaaaaacattgaaaccgtcatttataaactcacataggctccagtgattatctcttcttttctttgttaaaaaaatgcatttaaaaatcattctagaaaattgttaggcaatgttaaatttaccaataactctgactcttctttgcccctaccactttttattatctttgaaaatcaagacaatatttgcccttcttcaatcttttatcatttcttatttttctctggcttctggaaagtgagtaattacctttacgatcacttatgaaatctcttgcatggataattcatttaggcctagaaactcatttaaagcaatcgattgcttgcttaccatgctggattttagtagcctttaaatcatgtttattctaccttttttcattaaaacattagtctctttgggagaggagacaaataaattaaaacttgagttttaccttttctttgtcatctgatagcattatgtcatcagcacgaagcagtagcttccatcctttcttgttcaccctcttgtggcaagtattacttgaaaaacaaaaaaa

SEQ ID NO: 117540 - DNA, 311 bp, Homo sapiens
acatcaacacaaccaccatcagcacgcacatgggggcccgtggacaactcctggctgcaggtgcagagcgtccttgccagacgcaggtaccagggctggcccctatggccccaagtctccccagcccccatggctgagcctgggggctcttggaacaggctccgtgcccaagctggcagatgtgggtggtctctggagccatcagggagctcgtggtttatggtgtaagggctgagagcttggagggggttgtgtgtggggctgtactctgaggtggccagaggcccaggaatgtcatcctgggcacgcca

SEQ ID NO: 117541 - DNA, 717 bp, Homo sapiens
catggctgggttagctcaggtttgtatatttgttttttcaaagaggcagacttttcctaagattagaatccacagtaatgatggaagcaggaaacttaggggcaggccataggtgtaaaatcaaagttgagctgcttctgtgttacagctgtaagcacaggaagttgcccatttttttcaagcactatttctgcatagtcatatatcagctagtgttgtcaacatagacacaagagacaataggaatacgtacatgcaattccaccatcagctaaaaaacccacataagtctttgaagctctcaaataacacgcatgacactgaatggtacattttgatgcactttgaaactcttatctctttagttggtaagtacatttgaacacttaatatgtgctcagcagaagagaaggagaacaagggaagtctaatataaaatcaggattttttcttttctctttgaagccaattagaatgtgtgtatgtgtgtgtgtgtgtgtgtgtgtgtgtgcgtgtgtgtgtgtgtgtgtgtgtattatttagtgtagtaatccttgggttttttttaaaaaaacgtgttttactatgaagtgtaacatacaagaaagtgataacatatgacatatacagcttacaaatggttgtaagaattaatacactttgtaagtgccacccatggtaaaaataagtaggtggagaaggaggagaagaaaagaa

SEQ ID NO: 117542 - DNA, 717 bp, Homo sapiens
gtatacaatacagtgcactactaaggatgtgtctttaaaggcatttacagcacacagttttttttttccttataattttgctgctctttatttgtagtagtagataaggaattaagaaagcaaaaatgagtgctttgactaggtcttttgcctttgaaagtagcattagtaaaatcccctcttcttttttattcttataaaatttacccaattcactctgtcccccagcccatctgtgttcacttgctgttcttgctgctctcagtttttaaaagcttattctaaaattacatcaaagcaaccccattttgacaaaattagaattctggtaggaaacgcttgccatgaggctgtggagagaggcccagcaagacttttgtattttatttcaacctctgtcggttaaacctacaattcggcagatgatataattacctccctggggcaggtctctatctctgccttggagaaatagcaaagtccaaagtagtctcctcattcaaagatgttgcaaacgaaggctgttttgatctttatgtattagcatttgggtgttaatctttctggagctcctgacagaaaattcctttaaatttattatataattctaaaatattggacatatttgtttcaagcatctgtcagtatccttactctttccatttcactccccactgccttaattagtcatcaggtcctactgatttttaactccta

SEQ ID NO: 117543 - DNA, 483 bp, Homo sapiens
aagagctgttaccctgcatttctctgaccctgaattcatgtcttacacagatgcatctgatcaataaagcctaggtcatatgcttgtgccctagctgcaaggaatactaggaaattgagttctgactctataaaacatgaacatgcaaatttatccaacattgagaggctatttgaaatgagaaaccacaaatacagatcaagtctatgcttccaatcaagatcctcaaacctgacagattataactaagccttgtacaaacaagactctctctgttcctcatatggaggtaagaaccagagacttatcagttattgcacacagctccaatatcagaatctctcggtgatatccccctccttcctgttttctcatataacccatgaagtaaactgcaaaaagggggcagcctcctgagcagccaggaccacaggctcacgcagccatgcccaaaacacaaaagttaacttttgtgttttttgt

SEQ ID NO: 117544 - DNA, 321 bp, Homo sapiens
gaagatttcactgaggatgggccaccctagtggagaactgcgagcaaatctgtggactcatccatttattattttcatgggtcttttgaaatcttctctgtagtcttattcttattctgtagaagagtagttttctaacaactactaggtcatgtaattagttttatgggttggatctgcatttgtttaagtgatatcagagaataatgatattaaagagcatcataggtaataaaagaaagttttatttaagtgcctttctgtttcgtgtgtgtgtgtgtgtgtgtgtgtgtgtgtgtgtgtgtgtgtttgtcattatgg

SEQ ID NO: 117545 - DNA, 349 bp, Homo sapiens
aaaacatgtcatggacttcactggaagttgagcctggaactcattcagataatgccttctttatcccacgatcatatagattaagttagaggctctaagaaatttgggattgtgtgtccagagatatataatgtgcagttaaaatgctccacccttgctgggagattggtactggagagaaatgatggttaagcctgaagcttcaaggtcccaggctaaaaagagacaagatcttttattccttgagtgaaagtagtaacaacaaactaggggcaatgaaaaggagttctcaaatttgctagagaaccgtgctggcatcttaaaacttctagaagctttggaactcgat

SEQ ID NO: 117546 - DNA, 304 bp, Homo sapiens
ctggatgcaaacatccaggtgataaaaggggagcaacacaggtgagggctgggggaagtggatgcagtgaggctctgcaagatgtgtgagctgtacggtgcacagtgcctggtgatggagtggcggctgggtgggaacagggagacgatcagggaactccagggaccagccagtaggctgaagcaggggctgctcttggagaggggacatattaggagaaagtggcaggtactgggaaagggggactgtcagctgtccctgtggtacaggaccctgctgtgcttatggccagggctcagtacag

SEQ ID NO: 117547 - DNA, 818 bp, Homo sapiens
ggctgaggtgggcagatcatttgagcccaggagtttgagaccagcctgggcaacatggtgaaaccctgtctctacccaaaatacaaaaattagccgggtatggtgctgcgtgcctgtagtcccagctacttaggaggctgaagtgggagaatcgcttgagcctgggaggttgaggatgcagtgagctgtgattgtgccactgtactttatcctgagggagaccctgtctcaaaaacaaaaaacaaaaaccaacaaacaaaaagctgctatgaacatgcttatacaagttgttattatttttttgaagagatatgtcttcatgtctcttggataaaaactacaagaggaattctgggttaaagggcaggtttaactttctagaaaactgccaaacctctttccagtgtggtcatatcattcatatctacacatgggggtgtgtgagagttttagttgctccatgtacttacaacattggatgttgtcagacttgtcaggtttagccattctagtgagtatttagtgatatcttgatatagtttgaatttgcatttccctagtgactaatgaggctgaccactattcatgtacttttgggcatctgtatatcttgctttgtgaagtaccatttttttaagttatttgtcatcttatattgaattgtaggagtttatatatatagatatagatgtagatatattaggatcaaagccctttatgagatacatgttttgcaaatatttctcccaggctgtggcttacctattcatattcttagcaaaatcttttaatgagcagaggttttaaattttggtgaa

SEQ ID NO: 117548 - DNA, 471 bp, Homo sapiens
tgagttgtgaaggtgtctagagaaagggaattgcaggcagatggaacagcaagtgagaatactgagaggtagaatagaaaatactgataggtgatttcaaatttaggttgggtcagagaagctctgtctgagaaattgactttttagttaagattgaggaactagcacttcaagcagcaggaatagcaaattttcatcaatcatactaaaggacagactgacgtacattccttttgtctctgtagaaacttatataacaaaatggttgttaaacagacaatcaaagatgtagtcaaaaaatgcactaaataaggtatgttaggcactgaattaatgcctaacagcaatgcttcttttgattttgtgatgtttgtgattttgccaactttttaaaatttataatttttgagatgtcttttgtcattctaaataaatactcattacacatttttcagcctagttttaaaaaca

SEQ ID NO: 117549 - DNA, 920 bp, Homo sapiens
ggcttcccaaagtgctgagattacagacgtgagccactgcgcacagctgaatgaattcttttaactggatcctctgtaaaaaacacattacgcttatttgtgaagaacaaaggattgttttctcttcttctctcgttggggtgcccggttttttgtttctcttctacgatggctgtattcacttacttggtctgcccagtgctgcgacgtgcacgtgggcaacgattctttgcgcctcacttgccaaccctcttaccttccctgggggttcaaagcaacttcttatctgtttcttccagtcgctttccctttggaagctcagccctgcggcaaactatacaaagggtcagactctcgaccaaactcaacgagccacccgtgggcctataaagttctatcatggggtcattctctttctaacggttacgcaggcaattggggccgttcttttctgggcccccattggttttgggaggtcccaaatgcggctctttgggacacgttccacggaaaacctttccccttttgagaccacctctccaagcggttcggcattccccaattcctttggcccccttatataggggcccttttcccccataaaagaaggtgtggccattgggggcgaaactttataaccaaggcggccctgttttgcaatggccccctaaatcccggtggaaacccccgtgtgggagtccccccccccaaaacaagggggcaatttgggggttctattcttcccaacggtttgggggccacaagcgcacacccttcttgggtcttcaaacacggggcaactataaagtagcggggggggcgcggattttttaaaacccctttgtttcgtggctcaacaacatacctctttataaaacacgctcttctgatgggcggccccccaacgtcgtgtcgctaac

SEQ ID NO: 117550 - DNA, 294 bp, Homo sapiens
gttaagtacaatgcagagaactgcaacaggatgacccaggagtgattaggtggttaggtgagattgggtaataaatgaaggagtcaccacggaatctgaatagcattaagaagccaatgcaggtgagacagttgctcattctgaagcagggaacagcagaatcaacgaccctaaggaaaaaggaggctgacatgtttacagaaacagaagaaaggccaataggactgaagcttagtgggccaggaggataatgataataagatgaatttggaaaggcaagcagggaccagctca

SEQ ID NO: 117551 - DNA, 234 bp, Homo sapiens
cagagtctcactgtgttgcccaggctgtcttgactcctggcctcgagtgactcacctgactcagcctcccaaaatgctgggattccaggcgagagccactgcacacagccatgtgtttgtcttaatggccttgtatcggaactcttggtgacagaggctaatgagcagccactggtgggagagtaggggcggcgctcaccctgccccctgacccaggggtgggctcaccctaca

SEQ ID NO: 117552 - DNA, 398 bp, Homo sapiens
gttcatcttctctctctttgggcttgcagtggatctgccatgatccctttgattttcctaaatgttacccacatcttgtaatacccatatctttccttatccaaatttgccctattacatagttaggggaactatctgagacagataaactctgataaagagtgtggaatttcaaatctagaaattcatactctctaaactattaatagagtaagaaatagagatacatgtatattacctatggtcatgaaaataactaaaacgataactaaatataaaattataatgtcaagaaaatgtataaggaagacatgagagggaactagagtagtgtaaagagataagttatttgtctcccaaattcaagtgaggaaagaaaagaagttttataggaggaa

SEQ ID NO: 117553 - DNA, 712 bp, Homo sapiens
agcagagatgacagagataaatgagagagcctgaggaattcatgctgctggcattggttcatccctgcccgatgcgcaccactcagagacctcaggtcaatgagccttgcttacttctcctctaatttgagttcaattgtcatttataagaaagtcccgcatacgccaggatggtggctctcacctgtaatcccagtactttgagaggccaggcaggagcatcacttgagcctgggagttcgagactagcctgggcaacatagggagagcctgtctctactaaaaataaaaaaaattagccaggtgtggtggcgcgcacatgtggttccagctactcaggaggctgaggtgggagaatcacttgggcctgggaggtcaaggctgcagtggcgccatgatggcctgggcaacagagtgagaggctgtctcaaaaaaaaaaaaaaatttactgggtgcagtggctcacccttgttaatcccagcactttgtgaggctgaggggggccaatcacctgaggtcaggactttgagaccagcctggtcaacatggcaaaaccccatctctactaaaaatacaaaaattagctgggtgtggtggcgggtgcctgtaattccagctacttgggaggctgaggcaggagaatcacttgaacccgggaggtggaggttacagtgagccgatactgcaccactgcactcaagcctgggcgaca

SEQ ID NO: 117554 - DNA, 392 bp, Homo sapiens
gcacgaggatgattttggttagatgaaatttcaaagtggaccatagaatatataatgagactaaaccatgaataatgtattaacttatttaaaaatgcatatcaagtttggccgggcgcagtggctcatgcctgtaatcccagcactttgggaggccgaggtgggtggatcagctaaggtcaggagttggagactagcctggccaacatggtgaaaccctgtctctactaaaaatacaaaaattagttgggcatggtggcatgctcctgtaatcctagctactcaggaggtggaggcatgagaatcacttgaacctgggaggcggaggttgctgatagctgagatcggaccactgctctccagcctgggcaacagagtgacattcagtgtca

SEQ ID NO: 117555 - DNA, 287 bp, Homo sapiens
acacacacacacacacggagagagagattgattaaggaatgtgaaatatttgctttagacttaaatgggttccagcaatacctggatccacattgatttcagatcagacatttaatgtatgcaagtcctgttcaaacagaaaccagagagcgtgcttcgggagagcctagttctaatccagggagccaggcttatgtgtgtgaaagaaccagacagacttgaatgttgaattctgctttcaccaatcataaagtgtgcaaccttgggaaaccattttattttacgcg

SEQ ID NO: 117556 - DNA, 587 bp, Homo sapiens
actgacttagcagggttcttcctgaaagcagattttacaaggaagggcacaactgagcctagaagaaggttccggagcctgactgtagttcggtcaagcagagactctttgtccatcttcacaatacatgatctaagaggtagttagcattatcccccccattcacagatgagaaaagaggctaaagagggttaaggaatttgtccaaaagtgcatacctggtcagtggcagagccaaaattctaataaaacagtcagtctgaccccaaaattgaaactcttcacaaaaacctccagacttggctgggtgtgatggttcatgcctataatcccaacactttgggaggctgaggtaggtggatggcctgagttcaggagttaagagaccagctgggccaacatggtgaaaccctgtctctaccaaaaatacaaaaaaattaaccaggcatagtggcccatgcctgtggtcccaactactcaggaggctgaggtgggaggatcgcttgaacctgggagtggggaggttgcagtgagccaagatcgtgccactgcactccagcctggatgacagactgagaccccgtctc

SEQ ID NO: 117557 - DNA, 292 bp, Homo sapiens
tcatctctcagtggccataacacaagctaagtcctttaggacccttggccctgataccctgaacatgccctgttcctactctctcactccagttaccacaatttctctccagcaactggaagaatcacccctattaaaaagaggtagctcaaaagtaggaaaaagttcttgttggtctgcccttacagtgaacacacataactctgtatcgcccaccaagattacagacctttaacaggccaaaggtccctgggcttagccaaaccaactgaatcacaacagccttgatatc

SEQ ID NO: 117558 - DNA, 540 bp, Homo sapiens
ttgcattttactagaagtttgtagcggtggttttctagaaagtaacagcctgaagacatgactaggaagctgaaaatttcttttgccccttctaagatagttacaaaatgatgccatcaaattatactcttttttcttaagagcaaagctgtgtaaaatagtattcagtaatcatctttaagatattgtcaacattactaagtacaagtatatatatatatatttagtgaaaaatgctgtaatgtgcctcatgaattggtattttaatacagtaatatgctatggtagcatggagtattctaagatattctgattatctcatttagagaaaggtattttagaacttgtaccaatttataatataccaccagaaggggaatgttcatgtttaatagttaacttaaaaccatagatatttttggtacattgatacatttcccgtgaaattttcttaatgacaatggatttaataataaaagaaggtactttgtgaataataaagcttgcactattctagaaagttattctagaaagtgatac

SEQ ID NO: 117559 - DNA, 215 bp, Homo sapiens
aatttatttaatgtttcttgaatataacgtggctatgtatatcaagagccctaaaaatatgcataccctttgactcagtaattccacttgtggaaaatagtctgaaatctggcaaggttttctactcaaaatgtttggcacagcatggtttataataaggaatattgaaaacaaccaaaagttgcaaaaacattccactggtagaatattattca

SEQ ID NO: 117560 - DNA, 391 bp, Homo sapiens
gtttatgggtcagcatatactggttgatggcactcagctttgtaaactacttcctacgatgcaaggtgcaaaccgtcttcctctttgataattgtactctcctactggcaaagctgggaaagagggataggaaaccattaacaactgtgatgtgatgccgaacgggttctgccaaaggtcatggtgtcacttatttactagattctccaatttcaaacaggaagagcagaaactaagcagctaaactgtgatcaaggtactacttttgctaatggagacccaactaataaagtacagtgctgacttacatggactggtgtcagaggctatagcaggtgttttctgccgcctctccgactaaattaatgttatctaaatcccaggggaaaag

SEQ ID NO: 117561 - DNA, 536 bp, Homo sapiens
acacacctccttttatcttcaaagccgttttcaaaaactgaattcagaaacagcctagcctcctgggaggcactccatgggagggcttctgcaggccagttttaaagagaggagtgaggttcagacacctgcgggggtcagaaccagaaggaaaaaatgtctcctctgaagcaggtgctctgttctgactacccgccactcttccagagagttctacaactttgcaagcccacccttcaaagggagcagatcaacaatgattcctttgagacacagccttgaaaatgggatgtatacaatactaccgttctcatctgacttcttgttcctacagattaagtggcatggggcaggggtggaatttctatgaattgctcaataacaagccctgcctctagggtgcaggtcatcactacctagtgactctcatatccatagcattataaatcggtcaaatgataagcctgcaccctatgcctcttacttgaacatcaaacaggattcaccaggaggtctcttccactctaccttggttt

SEQ ID NO: 117562 - DNA, 728 bp, Homo sapiens
caagtgaaaacactgggtccgagttctccctggggcttatggcagaggaagccaaaatagctcgcctttatcagggctaaatcgtggaactaaatcagggttctgctagcggtggtggctaagggaaaccgctggtgataaaagcaaagaaatgggggagaagccgtgggggagggagccacagtcacactccttacagaataaactatctcgcctaggggcagtttcagcagaaggcttcagagacccccggaagcagacagaaagaagtccacatgccttgctggctgaggagcaaatcgggtcatgaatttcatctcagcaatagccaataaacacagcagctgctatacccagccctgagacatctagcacaggagactttataaagaacaagccgatctcctctggcaagcaagccacaaatggagaaggtcttggcaggatttttgtgtcctttattcatatggtatcagcacctaaaacagtgcctggcattaaagcactaggtaaatatgagtgactgaagaaatacatgcgtggggagagaatataaaccagcagcaccagttagtaactatacaaaggtaagcaagccattcagtctctaggagcctctatttcttcatcaggaaaatagggtaatgacacctactttggaagggcttataagaattaaggccgggcacagtggctcatgcctgtaatctcagcactttgggaagcca

SEQ ID NO: 117563 - DNA, 618 bp, Homo sapiens
ggtgcggctactttagccctgagcgtgctctgcggctgcctgcgggtctcagctagtgtccgacccctctcttcgcggactccacgccgagcagccaccctgagccaagagccggaagtcccggcattggcggcctggacagcctcgcaccggccaatcaaggagaacctcaagaacaacttcctctatgacttcctctacggcggtgtcggcctaacagctccacgggagtgtggacgaggagctgagcaaaaaaattccagaagtgagatgaaatgaacatcctggcgacatatcatccagcagacaaagactatggtttatgaaaatagatgaaccaagcacttcttcccatcgtattataggtgatgatgaagatgtatgtagtgatacagagaccactgaaaccatggaacgagatatcttagctaagaaattcgctgctgctgaaggctcggagccaaagtatagggttcaggaataagatagcagcagagaggaggatagtgacctctcacctgaagaacaagaaaaaaagcgacaatttgaaatgaaaaggaagtttcactacaatgaaggactcaatatcatcaaactagctagacaatttcaaaagac

SEQ ID NO: 117564 - DNA, 422 bp, Homo sapiens
gcagtgggattcttgaagccaggagtttgagaccagcctgggcaacatagcaagatcccatctgttaaaaaaaaaaattagctgggtgtggtgatgtgtgcctatagtcccagctactcaagaggttgaggtgggaggatcgcatgagcccaggaggccacagtgagccatgttcgtgccactgcactccagcctgggcaacagagcaagacagcatctctttttttgttgtaagacaaacaatcccatagcatttattgccatcttgtaataacataagggtaatcaaaacaatatgaataaatgttcatattggacaaaggacagctaaaaacaaactgtatccttctcaacaatttctcacttcattgatcatttctagctggagacactttgtagcagaggaatacctccttttagca

SEQ ID NO: 117565 - DNA, 306 bp, Homo sapiens
ctgcggtgaacatgtgtgtgcatctatctttataagagaatgatttctattcctttgagtacatacccaggaaggggactgctgggtcaaatggtattttgggttctaggtctttgaggaatcaccacactgtcttccacaatggttgaactaattaacacttccagcaacagtgtaaaagcgttcctatttctccacagccttgccatcatctgttgtttcttgattttttaataattacagaatggcatttttctagctgaaagaaacacctattcaggtaaaaacacatggaaagacccagag

SEQ ID NO: 117566 - DNA, 766 bp, Homo sapiens
agacccattcctataagaaatatgactgaagagcccagctgtctcactttgataaccaattcttccatttgcatttccattgatgtgtattgggccaagagcagagctttttcttgtggttaatatctgtttaatccagaagaagaccctaaggaaagagcttgaggaagagatgactgaagccattacagaagcagcagtagcctcaagtgaggaggtgtcagaggaaagagacgacctggggcctcttgaattacatgacagtggtacctttcaacaagtcgtgaaccttctggacatcattgacagcgagtcagcaaagacggacacaacaggggcaggccttgacatgcggaagaccctggcctcggtgataatcatggagaaggccaccactgagccttctgtagtgataaacactctcatccgctgcctgcaggtgccagagatttccacccagcgcaaggtcaacatttacaacatcctccaggacatcatccagcaggagggggagctggaggagcagtgcgtgcagaggctggtggccattgcctccaaggagatgagggagatcccagagatggagggctatatgaaggcagaggtggccagcgacacactggtggctctgtcccgaaaccacttcagcttggtcatgtacgagctgcagcaccacctcaagcccctcaacctcactgatgaatttgtcatcatcacactggccaagctggccaacggcaatggtaggggcttgagggccctcagc

SEQ ID NO: 117567 - DNA, 399 bp, Homo sapiens
acaggcacccaccaccacacctggctgatttttgtatttttagtagagatggtgtttcaccatgttggatgggctggtctcaaactgctgacctcaagtgatctgcctgcttcagccttccaaagtgctgggattacaggtgtgaaccaccacacccagcttcactgagctttttaaatgtcattactttgaattctatttctggaatttaataaatttctttgtcattggaatctgttgctggtgaattgttttgcttcttccaagtttttgaatttgcttttatagacagtgactttttctcaaagatgtacctatgatattggttgggttggcatgttggcattgattcttggcacttgtagtattgtagtctctgtataattcctttggctataa

SEQ ID NO: 117568 - DNA, 344 bp, Homo sapiens
ttgatttcagaaggcaacaaaatgaataaaatatgctgtctctcttgagacacttacagataggagtggaggaaaagaaaagggaaatcaagcataccgttaagaaaggtaataataataattgaatgcctgctgtatcctactaactgtgctgggtcatagattttttttaaatgcattttgttatgtagatttgaggttgagtcatagattttcttgtttaattttcacagcaatccttaaagattgctattattaaacctattttagagttttggaaacaatttcagagtagcatgttctagttcataccacaagtgaataacaaagttctgtccctctga

SEQ ID NO: 117569 - DNA, 297 bp, Homo sapiens
actgggttgtcagtcatggtgacccttgcaggccatggagacctgcacttccccagatgacatgaaaatttggggagagggggccgggtgcggtggctcatgtctgtaatcccagcactttgggaggccaagacgggtggatcacgaggtcaggagattgagactattctggctaacacggtgaaaccccgtctctactaaaaaaaaaaacataaaaattagttgggcgtggtggcgggcgcctgtagtcccagctacttgggaggctgaggcaggagaatggcgtgaacccaggag

SEQ ID NO: 117570 - DNA, 839 bp, Homo sapiens
tagcaaaacttcactgtgaacaagacacaccaatggaaactcctaagtcttttagatgaattattttggggtttttttgagagagagtcttgctttgtcacccatgttgggagtgcagtatcatgatcatggctcacagcagctttgacctcccaggctcaagtgatcctctcacctcacacccctgagtagctgggaccacaggcacacaccacatgcctggctaattttttttttttaatagagatgcggtctctctgtgttgtccaggctggtctcagactcctgggctcaagttatccctcctacctcagcttcccaaagtgctggaataataggcatgagttgccatgctcagcctagctggattgttttttcattgaggtataattcacatgactatattggtttttgcaggtttgctagacagaaaagtcagggaatggtgtcttcataggggacctgaatttcagcaaatccctgtcttgcccggcatcctgtggaagcctcagagcattctgcgttggatgacagttacatgggctcattaacatgcgataattataactgcagattaactctttatattttcttttctgttgggtttccttccttacagtaattttttcttctttggtatttttatttcctttatgtctgcctctcttcttttttttggctcctccctttcttgcaaatacatttcctgagcatctgctctgtgccagccctttgctaagtgctgggtgcacagtggtcagcaggactgcccggttcctgccctcctggagctcacagcctagcagaggtggagcacagtcagtcacatcatgtctgca

SEQ ID NO: 117571 - DNA, 374 bp, Homo sapiens
aagggcaggtgggcctagagtcacttccttttcgcagaggacgattaagctgactttatgctcataggagagttgtttgggagataattaacacttcctttccaaagaggaattaagaggttagaaaatgtgtgtctagaagctgggaagaggttggaggattgctcagtgaggagcagcaagtcagtgtctctttcagatatgaaggaggtgaagtagaatttataagaggtaaaaagagctaagaacactttgttttaacctataacttaaattcctttgaactcttgactcgttgggggtattacattgtttatagtaggtattagaggggttttcagttttcaatgctctattcatttctcatagtctct

SEQ ID NO: 117572 - DNA, 351 bp, Homo sapiens
ctatttaaagtttataccataatggtgagaatgtcacctagcacttcttaaaaaatgaaatgttaatgttcactaatggccaaattgacttcatttttaaaaatcagtactatggaaggtattgttcaaaccactagttccatatgtctccacagaaggctaagaatatatttcccaaaaaagtcttacttttttaatggaggggatatattagtgtcttcaaatttttctattattattcctcactttatgcagcacacgtgttcctgaaaaggggtttggaaactgaactttaacaacaaaataaattgcatttttaataactaccaaaacttgctacttaaaggtatt

SEQ ID NO: 117573 - DNA, 336 bp, Homo sapiens
caatctttattgaatacctgttatgagccaagcacagccctgggctctgaagatccagatgtgagcaagacagaccaaaatctctgtccactcagggcttacattctagtagtggaaacagacaataaacaacactaagtaaaatctatagattaaataataagtgctaaggagcaaaataatgcagggaaagggatatgaaatgttaagaaaggctaaaacatttttgaaagggtagacagagatggcctcatagacaaggttagttttgtttttggtattattttggacttacagaaaactcagtgataatacagagagttcctagaatttctg

SEQ ID NO: 117574 - DNA, 783 bp, Homo sapiens
cctctcaccacatcctgaggccactcatcattgaggccattttctttctttctttctttctttttttcatatttttgagatggagtctcgctttgttgccaggctggagtgcagtgacgcgatctcagctcactgcaacctccgcctcacgggttcaagcgagtctcctgcctcagcctcccgagtagctggaatcacaggcgcgtgccaccacacccacctaatgtttgcatttttagtaaagacggggtttcaccatgttggccaggatggtctcgatctcttgacttcgtgatctgcccacctcggcctcccaaagtgctgagattacaggtgtgagccaccacgcccggccgaggccattttcttctacctccaatagatacatttagaatctgtctcttttacttcatttcccacagctaacagtccattccaggccaccatcacaccatcatcttttgcctgaagtgcataagcctccaacttggtccctaaacttctctacccagtgagctctacacaaaccagaccatgctccctccccattaaggcccctcacagcttcccagtgcattctgacagtgctctctgcacctcttcgccctgtcccacaatgcatgagctctcttattcttttttttatgagacagggtctcactctgttgcccagcccagattgtagtggtgcaatcatagctcacaacagccttgacatcctgggctcaagcgatacccccatctcagcctcctgagtagctgggactacaggcatgcgctacc

SEQ ID NO: 117575 - DNA, 266 bp, Homo sapiens
tgcaattttagaaaatatggctggggagggcttcactgagactgtaacatttgagttgtgccctgaactaagtgggggagtggacctagcagatatccagaaggaagagcattccgggcatctggaatctggaatgggaagcagaaaggctctgaggccagaatgtgactggcgcctgctttcaggaggccagtgtggctggagtcctataagtagaggagaagggtcagctcagtggttcatgcctgtaatcccagcactttagg

SEQ ID NO: 117576 - DNA, 234 bp, Homo sapiens
gaaatgttttcaccaagattagctcctcccacagcccaggcagaattcctgatccttttgttgtacaatttccccacttctaatgtaagctaaatgcaggctttcgtggagaggaaataatgtacgcttgaaagttaacatcacagtagaaaaggctcccggacaagaagggcagaccaccaacacaggaggttgatgataaagctactaggaactttcacccagctgtttcca

SEQ ID NO: 117577 - DNA, 228 bp, Homo sapiens
tgtatcttctatggttccttttgaaaactggaatataatccgcaccaggaggcagtgctgtgctggagataataaacatatctagtgctcgatctatttatatctgcagttcatgaatttatttgtctaccaacacaagtttctttgttttttttttttttttttttttggacggaatccccccttggcccccaaggtggaatgtgaggggccgcacctcgggcacag

SEQ ID NO: 117578 - DNA, 110 bp, Homo sapiens
tagggaggctgaggcaggataatcgcttgaacctgggatgccgaagcggcagtaagctgagatcacagcactgcaccccaacctgggcaatgtagtgggactccatctca

SEQ ID NO: 117579 - DNA, 870 bp, Homo sapiens
  misc_feature (870)..(870): n is a, c, g, or t
agcggctgggtggaaactgggatttgaacggcgggcaggaagtactcgagtagggagtctggcctagtgaaagtctctgtttcctccttttcttacttttcactcaataaaaccctgctttacacacccttcaaaccatctgtgagcctgaatttttacggccatgggacagacaaggatcctgtctttatctaaactaaggaaaagtcctgcaacatttgtggtgcacaacgtggggctcgagaagtggaaaacgcctattttggagtgaaaccagggccgccttatgagctaaacagagtgtgttacagcttcaatagactaaacaagctctaaatttatcttcctatggtcacgggatctcatatattctggctgtcattgtcataataagccactcttggtcatatggaaaagcattcagctgctccctgcctttgctcacagcgtgtggtactctcttagaagctattcctggttcattggtaatttgctaaaagaatgccagtgggaacagaacagaagcattttcaagattaaattggcaatggttgtgactgattggatgaaggaagtaagggggagagattcatcagagaaagaaggcttctttaagcagcagaattgaggaatgagtcagaaaataaaagagcaaacaggctcatgggcagaagggactagccttatctgagtctttgaactttgaacctttgagttaatgctagaatgaggaattgtgaaagatcaccagggagccttgggaagctaaggaaaaaggcaatgaaaggcttttacctagaacctgagagacaacatggcctaatactcttgattcagaatcctggtctctgaataaagattaggatagcn

SEQ ID NO: 117580 - DNA, 249 bp, Homo sapiens
ctgaaaatagtctgctatgcttagaacacaggctggggaaaggagaaagagttgaagctggagaagagtgctggggaaaattcatgaggtcttagaccctgctgaggagtttggcctttcttttgaatgatccaggtaagagagtgacacaaataggcagactgaaaagcattaagtctggagttaaggagagctctgttgggaacgtcctcacgacatggcagctggcttaccccagagtgagtgatt

SEQ ID NO: 117581 - DNA, 470 bp, Homo sapiens
cacctcccagttctctctcaccctctctctccctgttacgtctctctccgatctctcctgcactctcagctctcctcctctctcttcctcctggccttttttccctctctgattctcaggcctggccatgttccatccagctcagccctgtccacaggagagtaggaagcagtgcacatcctaccacacccagcactcactccagcccagcagcccaggcgcaggcccaggaggaggagatgagggagatgaggtactgacagataaaaatcccttcccggagatccccagcaggtaagatgtggctaactgggagctgattgaaaagggagggacctgttcaccctgcttgttttcccacacagctgcacactccagggatgcagccaagcctgcatggcccctgcaaccaacctcccagtgcctgaaaagggccaggctcagccttggggagagcagtgtttgggcct

SEQ ID NO: 117582 - DNA, 181 bp, Homo sapiens
cctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttctt

SEQ ID NO: 117583 - DNA, 755 bp, Homo sapiens
aacagctctacctgcagtggggtaggagttcccctgggtaacaccctgtaatgccaagagaggttttaggattgagtttcagggtggagtccagaaatgggggtgtaaagtaatcgtttcaaagaagtgtagtctcaagtgtcgttgggttgttagggttggggaaaggagagctgcagctgtgaatgtaaatatatagatcactcgttcagaaatcagggctgcttgtcacaaatgcagtgctgccaggttcctgagatcatacccacataccctcctagtgagagagtctgctaggatggggagcatcaaaactggcttatctttgtgcctctggggtgtttgcacaccaatttatatttaccatagtaatatagtatgtaaagcttagtaggttaagaaatgttaaaataaaacttagatttatcctagattatgtttttgttaaaacttggccattctttggaaacagaactattttaagtattctattagcctgttattttttcctgaagagactttgttgctattgttaatatttatccctaccttttctttaaagcaatagagttaatgaagggaagtatatttatttatacctgtattctgtgttcttgctactagaagtgtaacttggggaccagcagcttctgtatcaccagggtgttggttagaaatgcagagtgactccaccccatagccactgggtcagaacatgcattttaacaagtgattgcaggttcaagtttaagaga

SEQ ID NO: 117584 - DNA, 356 bp, Homo sapiens
tgactattaatcttaaaaagggcgagaaaggaaagattaggtcagatcagaaagtaaaaatttgccctcccattcatcaggctaggaagtcagacacagatgaaacattaaaaagaaacaacgtttcttcaaagattaggtcagatcggaaagtaaaaaatctgccctcccattcatcaggctaggaagtcagacacagatgaaacgttaaaaagaaataacgtttccttaagtgactccttgcaattataaatgtgtcataaggatacccttcgtgggtgactacttattcttactgagaaaaattgttttctaaaaatcacagaccatcagaaactttgttgtttgccattgtg

SEQ ID NO: 117585 - DNA, 383 bp, Homo sapiens
gagatagattacttaggaaatgtaaaactaataatgcacccttatggtggagaacgctggcagtcacctccaagagacccaacttggcttcactaataatgggaaggctatgagtgaagtgggcttcacctagaactgacgtactccctgacgtgaggcaatatgaagtacccaataccaccactgaggtgttcttgccaaaaaatatttaatctgcatctaatcaaacctctcaacatatttccagtctacaggaaatataggagagaaaggaacaagttaaagcataacatgaggaaaccatcaaatccagaatacaggatactttacaaaacaatctggctaaattcttacaaaagtcaattttctttaaaaataaaaat

SEQ ID NO: 117586 - DNA, 381 bp, Homo sapiens
tactgcatgttctcgcttataagtgggagctaacattaaggatgcatggacgtaaatacaggaacactagacactgtggactaccagagggtgagggtgtcggtttaaaaactacgcatcaggtactatgctcactacctgggtgacgggatccatattccaaaccttagcatcaagcaatattctcacataacaaatctgctcgtatatcccctgtatctaaaataaaagttgaaataaaataaaaataaaagtagagctactgggaaggcttaaaggggcaacatgggtaaggggacggctttgatccatttgatttccctgagagtgcccttccttcctttgttgagagacagcagctccacatgcatgcaccccggg

SEQ ID NO: 117587 - DNA, 303 bp, Homo sapiens
tcaaaagagaatggctatacatcaggctgctttataacaccaggttcacttcaaaatactactttatctcttgacaaaatccgaaacaagatatttcaactgcaatagtagggttaaatcaattccattctgatgaacttgtggtttgctcgcatgcctgtaatgagaataaacactggtaaaatacctctctaactggcaatttgtgatttaaaacattttgtcaatttcaggttggtatgtactctccatggatgttaactgacattacccaggaagagggatttatggtagtgaggcagc

SEQ ID NO: 117588 - DNA, 289 bp, Homo sapiens
tcaaaagagaatggctatacatcaggctgctttataacaccaggttcacttcaaaatactactttatctcttgacaaaatccgaaacaagatatttcaactgcaatagtagggttaaatcaattccatctgctattctactactcctgaaggattattcaggccccctcccttccctacacatcaagctcgaggatttgcccccgcccagtactggcaaattagctttactcaacatgccccgagtcacaaaaactaaaatacctcttagtctaagtagacactttcac

SEQ ID NO: 117589 - DNA, 153 bp, Homo sapiens
atgtgccattctggagagagatgttgatagtctaggaggctatgcatgtgtggaggcagggggtatatgggaactttctgtacttcctgctcaattttgctgtgaatctgaaactactctaaaaaataaggtctattttcttaaaggtcattt

SEQ ID NO: 117590 - DNA, 361 bp, Homo sapiens
tggtctcgaactcttggcttcaagcaattctcttgcattggcctctcaaagtgcatggattacaggcatgagccaccatgcctggcctgaactctgacttctgagccaggccctgtggggtgagctttggctcctgtcttgagagctgcagattctctctcagcctggctgcagattccagattcttcctgtcaatgccatctctcagataggtcccagccacttatatcctccacagccccttctggaagtgtctttgtctccctgaacaaaaattcaatatggaagcagagttagccaggcacggtgcctcacactcgtaatcccagcactttgtgaggctgaggcaggagggttgctt

SEQ ID NO: 117591 - DNA, 302 bp, Homo sapiens
caatcatggtggaagacaaaggaagagcaaggggatgtctcacatggcagcagacaaagagagaaaaatgagagccaagtgaaagggaaacctcttttaaaaccatgaaatcttgtgagacttgttcccttaccaggagaacagtatggagaaactgcctccatgattcagttatctcccacagggttccccctaaaacacatgggaattattggagctacaattcaagacgagatttgggtggggacacagccaaaccatattaatcctaaatctcattatcaccagatattttaattttc

SEQ ID NO: 117592 - DNA, 176 bp, Homo sapiens
acatctgcaccccgaattctatgtgtaacttaatgctcttatgtccaactatctactccctgtctccatgcggttgtctattaaatatctaataattaaaagttcaaaatgaaactactgctttctcaccacacaccaactcttctctcctagattccccctactcagttacagca

SEQ ID NO: 117593 - DNA, 152 bp, Homo sapiens
ctcctggattgttctgtgttccttttttttcatattttccttctctttttgtgaatgttttgtttttctatcccttctatgctttttttcatttcagcaaatctttgatgctttcttatttttggataatccttttctttgaaaattagatt

SEQ ID NO: 117594 - DNA, 766 bp, Homo sapiens
acaagccagtaaaaacagttaacacatattttaatgacaagctcatcatcaagaaaaacaaccgtatactttgaaaaataatttaactcatttctgattaagaatgaaaagaagagaaaactatatactatcttcgtttttctggggttttttttgttgttgttgttagagacagtgtctcactacgttgccccggctggtctctaactcctggcctcaagcgattctcccatctcagcctcccagagtgctgggattacaggtgtaagtcaccacacctaacccatttgctacctattgaaaaaccacagtattgggagaaaaccctatcttgttaaagccatcttctgggaaaaccttacccaaagcagtcaactgcctatttagcatctgtcaatagttctaactctacttcatgtttcagaacactgacacacaaaatgtggtccacaaacctctagtggtccccaagactatttcagaggatctactagtttaaagctactttcataatgatattgtctttttttaaaaaaaaaaacaaaactgtgttttgagtaaatgagtatttgcaccaatggtacaaaaccatggtgttaaatgttctgatgccttatttgaatcaagagtatgatattaaattcacagtatttttatttatttatttatttgtttatttatttatttatttgagatggagttttgctcaatggtgcaatctcggcccaccgcaaactccgcctcctgggttcaagtgattctcctg

SEQ ID NO: 117595 - DNA, 396 bp, Homo sapiens
aagcaactcttgctagggaagactccagtaatggcaaaaaacaaaatcatgcaaagatgcaatgactgctcaaatcaccccaaatcagaaagtggcactggctgctaacagaagcctgaagtctcccaccagtgagaagtccaggcccaggaaacaaggcctaaaggggctggcacagtcttcatcctagccaaatgcaatcactccaaaggaagtcccacatcagagatcaaaggcctgctgagtaaggagagacaggccacaggctgatatcccattgccaaaggaagactgtcctttgcaagtgtgcctggtggagctctggacccaagtaataggagaagctccaagtctctacaagtagacctagcagagctggctgagtcagcaccccac

SEQ ID NO: 117596 - DNA, 302 bp, Homo sapiens
atggctatcgacggtgtctgactgggcttcttgttccagtctcctccccttccgtctagtctccacactgttcctattaccatcctaattcagctctgtctgacttgagctctggttaagtctgcaccctgttcaaaacccagcagctgcaaaagccctcacagtagtcaaaactccttagcttgacatttgagggctctctggccagacccttatcatgctgcagaccttcctgccctgtcccccaacattcctgcaggtacccggcagccctgttccctgcctgcacagaatgggcatac

SEQ ID NO: 117597 - DNA, 932 bp, Homo sapiens
aatgaaagtatctcctccagcctacagacaaaagcaattgaattacttttcatatatgctggcactgccctcaaagtatttctcattaggttggtgaatgaagtgtcttccagacctcttagtagagaatactggagagggaataggggaggtaagtgaatggtcacagtgataaatccactccatcagttctatttcctttaatcttttgacttcttcctctatattatgctatgagtttttaggcattcaacttcatttagtataagtcaatgctgagaccaaaggagcaaacaattagaaccactcctggctacttgaacgagaacaatgaattcagaatctctgataactgcaccataccaatacattcagccaaatgcaaaagcatgtttctttctctctcacatcatcatcatcacccatttctgtacatattcctgaaggttttgctgctttgtcagcaaaaaaaaaaaaaaaaaaaaaaaactttaaaaaaattacatataatccttttcttcccattgtgactgcaaaggtgcagcatgatatagtctgactccagttacaggtatggaaacatgagtatcgtgggaaggggtatgaggaaactagcttccccatggatggtaactgtcttaagcaaggttgttaacacagggaaggatggcttctgctagcaggagagactcagagtttggagacttgaagtactatgtgtccgcaattccccatatacagaaatgtattcaaaagattattagcagccaaaaatatcacatgtacaatttaaaaagtgggtatttataaattgcaattctgtttcctcatattttcttaaaattaagcaacataagatttcttctatttggttttgttaccatgcatttgattaatattaattatcacaacttcacactaagatcaggcag

SEQ ID NO: 117598 - DNA, 270 bp, Homo sapiens
ttatgagtacgaaatgaaaaaatggggcaaagggcttggcacatggtcagtatcaatagatcactagatggtggctgaggctcacatcaggacttccaatgctgcttttttaaaattattattgtttttgagacagagtcttgctgtgtcgcccaggctggagtgcagtggcgcgatctcggctcactgcaagctccgtctcccgggttcacaccatcctccggcctcaggcctccccagtgactgggactacaggtgcctgccaccacg

SEQ ID NO: 117599 - DNA, 741 bp, Homo sapiens
acccttgagccgtttgctcaggcctgctcccgccctgtggagtgtgctttcattttcaataaatctctgcttttgttgcttcattctttccttgctttgtttgtgcattttgtccaattctctgttcaaaacaccgagaacctggacaccctccactggtaatgataattttataagaaaaagctgagatgacagcatgagataaaaaacataatcattcaatttttacactactaactattcattggcaaatcacaaaaataatagctatgacaaactgtacatcaactaatggcataagaccataaaggaaaactctgctgattaaggctttgggtaatatgtcattctagacagccaaggtttacaaatagcttaaatcatttccattttcaagctttaatccttgtggatatgaaactttctcagatgtattatatacttctccaaccttattaaacagatcatactaaatttaatttccttttgctttatgatcgggaattgtcattgcaaatattaagtattgtgaaatgctataacatggtgatattcttagacttattgaacaggaggtagctggccccatgttgaaacaattttgagttcattgtgtgtttaaatatgggagatttcctgtaaaatttaaatttaatttattttgaaagatctgtgtagctttcatttccatttggctacaatataattctccagccttattaaacagatcatactaaatat

SEQ ID NO: 117600 - DNA, 455 bp, Homo sapiens
gaaaacatattttccttgtacctacacctgcccatcttttcccagtgaatgcttgtgtacctccaaggcagaggactcagtgccaatcaaggtgccaattacatcctcccccttccatctttagacaactctgaacgttaattaggtctgaataaaaatttgtaatgacgccaggggcggtggctcacacctgtaatcccagcactttgggaggccaaggcgggcagaacacttttgaggccaggagttcaagacgaacctggccaatatggcgaaaccccgtctctactaaaaatacaaaaattaaccaggtgcagtggcatacacctgtagtcccagctacttgggaagctgagacatgaggatcgcttgagcttgggaggtggaggttgcagtgagccgagatcacaccactgcactccagcctgagcggcagactgagactgtctaaaaaa

SEQ ID NO: 117601 - DNA, 353 bp, Homo sapiens
taatttttaaaattgtcctttcaaaatatttctttgtataccatatgactcatcaagtatattttaatgaacaatatcttttgattgacttgatgatacttcttttaaataaaacaatgtgacaatcattcaaaacttggcagaattaattgacagaattgctcctgctgtgtaaaagatctccacagtagttgcaaaaaaggagctatgtaggtcttacttagcaagaactaaatgaagatgcttatacagcagattttgaattacatattttataccaatgtctttctctattttagtattcagagttaacaatttgacatagcatttttcaacagcttcacagataacag

SEQ ID NO: 117602 - DNA, 132 bp, Homo sapiens
cctagaccctgccctgcagagcccgtggccgcccctcttacccagccacataccagctccccttgacacgccttcctcccaggccaacatgtcacacagatgcccacacccctgtctctgcctgaatctgtg

SEQ ID NO: 117603 - DNA, 730 bp, Homo sapiens
ggtccagtgaacgctttatccagcttccccaattttggggaattcttctgcaatttaatattcttcccttcacccactgaatttagggatgaagagctgagctgcaaagatgagttttgtgctacagcagcctttttaggtttacagatcatcaggccctgggtctctagctgagaatcagaaagtaaacagacaaagagttcagcctaaagaagttcaagtcccagagcagtggatctcaaccctagctgcacataatcattatctggagagctgtttaaaatacaggttccaatataatcaattagttctgggaattaggcttccatgttttctgaagctccttaggagtttctaacaggcagatagggttgagctgtgccattggtactaataggctctaaagtgagcccaccctctcatcagagcatggtgtcaagcgactctccttcctaagatcccatcgctgacaccaagatacctataagaggatcctgtgagtggagaggctcctggggtaacctggcagggaaatttgtctattgtgtttactgaaaggcattgtagtactgccactcagagctgtgcttccctttctgaaacagtcaagcagttccgggcacatcaaaggagattatcattcctctggcaccggctttgtttttcgctgcctctaaaagaaacaggtccacttatctccagaatgctttcccagaaagctcagtccctg

SEQ ID NO: 117604 - DNA, 300 bp, Homo sapiens
cccattggtggggactgtggcaggtaccccatccctgtgttgtttgatttcccacccccccctcccaagaccctcattcccatgagcaccccacccacacaggcaagggccttgaggggacccagcaagtcgtggaggacagcacagccttggagaggaaatgtgtcagccacaaggttatgatcccggggatccacataagagcatgggcgtgcacgtgggtggtcctccctcagccagcttctcaacagcttctcccaaaggtacacctggatccagtaccactgagacccaaagacg

SEQ ID NO: 117605 - DNA, 618 bp, Homo sapiens
actagatccacggtaggctgagatgggaggatatcttgagatgcagagagtttgaggagtgcaggtgagccttgagatgctgggctacagagcagaaggcccagtctcttaaagaagacaaatttaaaaaacatagcaaataaagcgaagcggctgctctattttccattctcaccagcagtgtatgagggttccaagttctccatatccttgacatgtgttattatctcactttttcattctacccatcctagtgggtttgaagtggtatttccttgccttttagtttagcatttacttaatgatgtccagcatcttttcaggtccccttgctcagttgtttatcttccttagaaaaatgtatattcagctgggtgctgtggatcacacctgtaatcccaacactttgggaggctgaggcgggtggatcacttgaggtcaggagttcgagaccagcctggccaccatggtgaaaccccgactctactaaaagtacaaaaattagctgggtgtgggggcaggcacttgtagttccagctacttgggaggctgaggcaggagaattgcttgaaaccaggaggcagagattgcagtgagctgaggttgcgccactgcact

SEQ ID NO: 117606 - DNA, 388 bp, Homo sapiens
tgttttgttcactgctatatttgaagtacctaggatagtaccagacacacagaaggtactcagtaaatgtttgttgcaagactgaatacataaatgaatttgtatagaaggatattcactgcagcattgctactattggcaaaaaatcagaacaaacctaaaggtcattcacaggtaaatagttaagtaaaactgtggtacattcatactaggaaataatatgcggaaattaaggagtgcaaatatatccataccaatttagaaaactattaacagtatattggaaatacatatactgttaataaaaaaagtttcagaaatgtgtgaatacatatgactgtctatataaagtagtccttgttaaaaaaaaaaaagtctggaaggttac

SEQ ID NO: 117607 - DNA, 193 bp, Homo sapiens
ctacaggatccgcgcctttctctgatcattggctattctgagtctctattagaaagacagagctggcttgtggagggctaatggcgatgccagggattcctgtccacagaaatgcacatcaggtgaggataccactggctcctccgagacggagtgacggtcttgcatctttcggcatttctcattgcgtatg

SEQ ID NO: 117608 - DNA, 447 bp, Homo sapiens
agccacaggcaggacagggggaatgatgtagagttgatttctgaatagggcaggaagctggtcaatggctcctatagtttctgccaagttaattcaataactatttatggagcatttactatgtgaaaagcattttacccctttctgggtatacaaaagtgagtgggatggagtctttatcctaaatatgcttatgatcttataatggagctaaggtatgtactccattaattttaaggctcaaaacttataggtatgtcctctaagaaccgagagggtcctggaaccagagaaggtgaaggctgttagaactgtaggaatattataagcatattggccaggcgcggtggctcacggctataatcctagcactctgggaggctgaggcaggtggatcagttgaggtcaggagttcgagaccagcctggccaacatggtgtaatcctg

SEQ ID NO: 117609 - DNA, 1211 bp, Homo sapiens
  misc_feature (1211)..(1211): n is a, c, g, or t
gattgatgttttcttccccaaatgctaattcatgttggaagtagaggcctttgttttttatactttaaaaaacacaagtaaatgatctagtcagagcatttaacggaaggtatcattccttttttttttttttttttgagggggagtcttgctctgtttcccaggtgtgggatgtggccaggggatatggcgtctcaagttccacgtggcgaatttccaacctcccggggttcaacgcggattctccgtggtgctcaagcctcccggagcaagttggtggatctcacaggtgtggcggtggccaacccaaggccgggggctaaattggcggtgtatatttcccacaggtaaagacacacggggggttttggacctatgtgttgcgcgccgggggataaagttctggggacactcctctgggaactcttgtgtgggatacccggcgccacctctgtggagctcttccaaaaaaagcgcgcggggaggatcaacaccaggggatttgagaagggccccaatgtgggacgcacccccgtgggcgccaccaccggggaaaggggctatcaaataaatctctctgggagagacgcccaaaaatttgcgcgctgagatttgagaagaaatctcttcgtggcgtcccataaacgctactatgggtgggcgccatttggggcggccaacacgtcctatttaaatcccacaatgggtgcctccacagagtgtcatcatctacaacccctgggggtaaccctcttggcaggcgaccccatctaacagcacaactcgggggaggcgggcgggagtcaaaaggcattcggacacgacctcatcacttcaacaccacatcacttcttcaaccggcccaaacaacagcggcggcgcgttggggacatatatcaacaaacataacggcgggggggtgctccaaaatacaaaacgtgtggtggtcaaacgggggggagatatatttctatgaacagaactttccaatattttcaccagctgtggtgctgatgggggcgagcaaggaaatcaaaacacaggcggggcgagagagtgggacataacggtataatgtaaccacactttttttaatttacaaaacggagaaaacatttttggcgcaggaggaacatttattagcaggatattagcagcaggaaatatattcttttaacacaaatatatagcgctctggttaaaggcaaggn

SEQ ID NO: 117610 - DNA, 345 bp, Homo sapiens
cttcctgtggcaatcaatcaaactaggaattaaaaactatttacacttgaaaatgaataacattggccgggcatggtggctcacgcctgtaatcccagcactttgggaggctgaggcaggaggatcacgaggtcaggagatcgagaccagcctggctaacaaggtgaaaccccatctctactaaaaatacaaaaaattagccaggtgtggtggcaggcgcctgtaatcccagctagtcaggaggctgaggcaggagaatggcgtgaacccgggaagcagagcttgcagtgagccgagatggcaccactgcactccagcctgggcgacagagcgagactccatctc

SEQ ID NO: 117611 - DNA, 209 bp, Homo sapiens
agagggaggcctgggtggtgcacctccagagctgcccaggctgggcctcaaggaagaaaaagattttcatttgtcagaggcggaagggagaggtggagggaacagcacagcagcggcccaggggcagggaagcacaggaccattagggagacacgagaaagcccatttgtctagaacagaggattcaagcagtgcaccaaggaaaatga

SEQ ID NO: 117612 - DNA, 393 bp, Homo sapiens
ggcccagttctgcttctgaaatcagttcctggtattaaaagtctctgatgcattcttcagtatgtcggttggcatttttcaactccggaatttcagcttgactctttttaattatttcaatctctgttacatttatctgatagaattctaaactttttctgtgttgtcttgaatttctttgagtttcctctttgttaagtttatctgatagagttctgaatgtcttctctgtgctatcttgaatttctttgagtttcctcaaaatggcaattttgaattttctgtctgaaaggtcatatagttctaggatttgtatttagttatttttctaatctactttgacactttataatttttagttttctgccaaactttcaagcttggatttattgt

SEQ ID NO: 117613 - DNA, 327 bp, Homo sapiens
gtatactcaggagagcagatggcttcctccttccgtgtagggtttggaggctcttgagtggtttttctttattgcacttaccagtcccacattcatccctggcaagaggaataggaagactgtgggtgattcagatcaatcagttgggttgaaacaaatgctaggaagtcaaccacaatagactttgtccaaccaagccaatcaatgccatttccttgtatttagtagtttatttcctatcttttaagttacatgttcttttgagaaaatttgggaaatataaacatgtatgaagaagaaaataaaatcactcataatctcactatt

SEQ ID NO: 117614 - DNA, 393 bp, Homo sapiens
gttgtttttaagtctctaaacaacttgggttcaaagctgcgggtagcttagaacctgtgagctctttacttgcctgctcaagttctgcctcaaaggcattactctagccagagaagtagcaagtacaaattgttcatgcatagcaattgtttccctctcttctctgctctttctccttcccctgctacctttccacccttgtattgacccctgaacatcaaattaatggcagcatatcaggattctgtgtggcacttatatcctttgatgctggttttgtgcctgtactacagttctcatggcaatggtttcatggtttcagtctcaaaatatggggtttggaaggaggcttggtggagagagagagagtagagagagagagagcaaagaaaa

SEQ ID NO: 117615 - DNA, 136 bp, Homo sapiens
gttcagctcagccctagagcttctgcaaaccccatcctttcactttaggtcactgcccttcaagcagtgcaatttgactttgaaacattttatttgtttgtgttactaagtaacactttaacaagatgtatgtggc

SEQ ID NO: 117616 - DNA, 545 bp, Homo sapiens
agggggcgctggggaacctggggggcttggataagaaggggaggagggcctgcagggggcgctgggagacctaggcggggcaggggtggggaatgggtaaggagggaagaagggccttgcagggggcgctgggagacctggggtcggggggaggataaggaggggcaatgggagaggatggggaatggggtgcttagagacttgggtgggaaatggacgcagcagggactgggcggggagagaccttacaagggttccaggagatgggttggggtgggctggacagggcagagtggagggtgaggagggccctctgtgagccacagagacctgagcaggagctaggtgggggctgggaatgtgcaggaaaggagacgtggaaggagggggagatagggcggcaggggtgatggagattgacagggaccccagacatgggggtagggaaatggggatggaaataaatggaaaaaaagaggcttcgtggtgggaaagaggaggaactccgagggctccggggcactgaggtgtgcagagttgccggg

SEQ ID NO: 117617 - DNA, 383 bp, Homo sapiens
aagggcttagccagcccttgggaacattacaggcactcagtagtggcagcactattagggtgacatttatgactatcatgcatgcttgtcctaccaaaacaggagctcttctagaagacctgctcaatagagcaccatgtcccaaggaaaagagctctgagtagggtgtcaagagacaaggatttgagccccattctgtaatcacctggctgggtgacctgatggaaatcaacctctattgaacttgttttccttatctgtaaaataaggttttaaaatatccctttcttgtcataaaaatcatgatttaaaagaaattttaaagacgtaagaacatgcttgtgaaatgttacgtggaataaaagcaggtagacacatagttt

SEQ ID NO: 117618 - DNA, 643 bp, Homo sapiens
ggccatctttgaatcttctggcagactagagaatctcagtctcagaaataagattacagtggtttaagtttttcatatgtacttattatacacaaaaataacattaaaaggtaacagtaatgatgacaatagtaatagacttagggctctagatataggaattttagataccaccttaaatatgttcagggagataagaaacaagattcaaaatgtcagagcaaacaaaaagaaggcaaatttggaaaagaaccaagtagaaattttagaactataaaaatacagtaactgaaattaaaaactcgatgtacaggtaggtaggtgcaagtagctggtagtcccagttactcggggggctgaggcttgggggtagctggagcccagaagttcgaaaccagccagggtaaaatagtgaggccctgtttgaaaagaaaaatggggtgggagggggtggggaaaacagaaaacttagtggatgagtttagcatcagattagacatacttgaaaataagtgaactggaagatggcttagaaggagagatctggaatgaagcttcaagatacagtattacagaagaaaggaaaagatatagactatacatcgaaaagttttcgcaaaaattggaataatgaaaggagagg

SEQ ID NO: 117619 - DNA, 319 bp, Homo sapiens
aatcagctcggtcctggttatcacgcatggtggcatgtgctgtaatcccagctactggggaggctggagcaggagaatcacttgaacctgagaggcggaggttgcagtgagccaagatcgtgccactgcgctcctaggcaacagagtgagactccatctcaaaaaaaatttttttgtagagacagggtctcattatatttgcccagactggtctcaaactcctggctttaagcattccgcctgccacgacctcccaaagtgctggcatgaaccaccgcacccagccaatgtgatgcttcttaaatttgggtcctgtcct

SEQ ID NO: 117620 - DNA, 575 bp, Homo sapiens
ggaggtgcatctgcaggtgcagatggtgtaaagtacagctgcttgggtgctgaccccataaaggaacctggagggtgtgttagttttcgttttgtggaagtgccaaggatcaccttgacttgtgcttccttttctcattctcatgaggtgggtggagcatgtgcagcggcatgatctcctgcgtggtctgataacatccgcaagagtaattagaacgtcagaggttaaagtcaccgtccactgatgggttttcttgctctctaaaaaacacccttttcactgtttttctttgacttagcagcaatcacgcaataaactccatttctgcttccattcgtgtttcccttttacttgcaggaaatttgcttataaagtgtggagggggaaactctttaccatttttgtaagttatgctgtgctgttttgaaagggcttctttagcatcaagagatgccagcttggctgacattaaattagataataatctttccctgacccttcttcatgcttgactctaaaaagaattcaaaaaagaagcaatatttgaaactataatttgcagtttatgtcaagat

SEQ ID NO: 117621 - DNA, 189 bp, Homo sapiens
atctcattttatccttatatctgtttctaaagaatgacaaacatacctcctcttacctaggcccaataattgtgagatcgtatgagggaggcactctcttgtaataattccctaatcaatggaataaatgtggagaaaatcgagcatgatgaattgccttttgagttgaattaatcctcagctggcaaa

SEQ ID NO: 117622 - DNA, 298 bp, Homo sapiens
ttgacttatttggctgagacacactttctttactgtcctaggatgcaagagaaataatgtctaggatttttctcttcttgccaatgagcagaaaccactttcatcttaaaacacagctcaggtcttagaataagtttgttttctgcttctttattcttctgctccattttactaagtttaccttgttttttttttttgtaaaaaactatataaaaagtattatagcagaaaaatggactatttcacaatgaatttgtcacattataattttatataatactgtatttatatttaatat

SEQ ID NO: 117623 - DNA, 307 bp, Homo sapiens
cttgtggccctggccctgccatggccctgtcccagatgctagccctgccaggtgcttgtcctggccctgctgtgggcctggctttgtccctggttcttagatgaacctggccctgccctgcccttgcccttgccctggcactggccttggaaatgtccgtggtcctaaccctggccctgccctggagctgccactgtcttggccctgccctggctctggccctgccctggacgtggccctgccacagccccagccatagacctgccctggttggtcgtgccctaccttaaccctgtgctaccctggg

SEQ ID NO: 117624 - DNA, 257 bp, Homo sapiens
aaatgagtgttgaattgagttgcggtgaatatagcccagacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggtacggaaa

SEQ ID NO: 117625 - DNA, 196 bp, Homo sapiens
acatgagcaagactacatctcaaaaataaaaaaatataagaagattggcctgtcctcctgctgtgttatcatagcccttcttagtatatctcccacagccctcatcactgccctgcaggtgacttaatagattactcatttgcctcttctctttgaggacaggaaccacaccattcatatttatccccagtgcttc

SEQ ID NO: 117626 - DNA, 688 bp, Homo sapiens
gcaccatcatagctcactgtagccttgagcacatgccaccacacccagcactgaatgttgtctttttcttttctttcctttttttttttagaggcatggtcttaactatgttgttgcctagggtggtcttgaactgctagcctcaggcaatcctcccacctcggcctcctaaagtgctgggattactggcgtgagccaccatatccagctcctatcattctttgaccacttctttattttctgtcatgagaatatgttccagacccctcttatacttcccatgcccagccctggaatctccatttctccaaagagcattggcttattttagaggagactggtatttagcaaccaaggcctgagtcctaggtatactcactgctactgaggtgtcctttctcctaggccctcacagcaaagttcataaatagatgtacatacatacatgtatgtatgtatatgtgtgaaccatatgcatatacatgtttatacacatccacacacatctgcgtttgtttctctaatcatattaaaaaactatgagttcctactagtagccaattccatgctaccatcacagcagtcattataccctttccatatctgtaactctaatctaaaataatgagaaatctgctgccagtagccatagtatatttacttattagctcaatactagaatatatga

SEQ ID NO: 117627 - DNA, 687 bp, Homo sapiens
ctagtcacctctctcacgattgccactgtgcccgttggtggccccaacagatggtgcccacctggaaggcgggattttttggatctcattcagttctcggtccctaacaacctgctcagtgcccagcatagagcaggcaaggaatatgtctatttatgttgatcagaagaaagggagaggaggagattttaaatcaaacagttatcctaggcacatttttcaaaactgtaggaaaactatagcaaatacttgtattagcatgtcctgtgtgccagagagagaagcctgagacacagggggtaaataagtccacagggtatctctgcttcaaagagaaaaagagttaaaccttggggggtcgggaggagctacctctgaagtccttgctccctgtgccttagaggtcacagtgactccataacttcaccctttggataaagcacaggttcaggttgctgtgcacagggaggagcaatatatctcggcaggaggtctctctcaatgaggtaccagggatcctgttgcatccatttgggagggtctgggagtcagcagtcccaactgggagctcctggagctcgatttagaaaagggacagggataatgctatctggggccttggcatgaaagggcttttctttcccatgtccagactcccgtgagagagagagaagggttccaagtctc

SEQ ID NO: 117628 - DNA, 677 bp, Homo sapiens
tgccaggggcgccagcgtctcggggctgccctaatggctcctgctcagtgcgcggcgccagcgcttgtcttgtcccggctgcgtctctgggccccacgggcccctcctcacatggcaactattgtggctactagtccaggcggcttagcctctggagtgggtccaggacccgctccagctgacctctgactccctggggccaacttagccctggtcttcccgctcctccgatctcccacgcgaatcgccgccatgagctaactccccacccccgggcagacccgggagagctttgattacctggggtcttctgcttcctcccagacgtcagctccgcttcaggaatcgactgagactttggctcagagtttggttccattcttggacacggattcagctggagagctgccccggggccagagcagttcgctgctgcacactgggatctgaatgacaagctgactcggcacagaagtctcccagaggtggttgcaatgctagactgggatcagaaccaggccctagctcggcctctttgcctcaaaagtaagtttctaactgtagatctagatcaggctgcagatcatcaggcatatgaaatacttgttccacctctagatagaaatcaaaagcaaggaactttactgtttcgcccaagaaccggaagaaagatctag

SEQ ID NO: 117629 - DNA, 224 bp, Homo sapiens
gaggctctcagggagaacgtatttcctgctccttctggctgttggcagaagtcaagtcttgtggctgtagggtcgcagtttccttcccttgctggctgtaacctaagggctctttcatgcttctggaagctgctgcattccttggcttgtggcctcttctctccatcttcaaagccagtaatagcgggtggggtctttctcatgctctgtcttttgaactcact

SEQ ID NO: 117630 - DNA, 841 bp, Homo sapiens
gggggaaacaggagctttcctggaagttccttcagtagatttctatttatatctcattggcgagaacaggatcatgcagctactctggttttaatttttttgctagttttggtttgtttcgtttttatataatgatgttgacaccataaatgcagcttccctaactatagtgaggacagaggaagaaaatattttacgactgaggatgttgcaacactaaacaaagccggatcctattagtgaggaagaaaagattaattgatatgcttggcaattaggaatcggccatcgttgttataatgtgccttttttgaaatttggcaattacttactgtttaaaaacctattattattgctttagtgcgttaagggtgttagtctacacaaatgccactggtacctgcagtacattaaagaatattaggaatccttttaatctcagaggtaaaatactttgtttctagaaattgagataaaattcacatattataaaattcacccttttaaagcatacaattgagtggctgtggtgcaggttgagcaccctagtctgaaaatctgaaatgttccaaaatctgaaactttttgagctctgagatgatgctcagaggttctgctcaaaggaaatgttcactggagcattttagattttcagattagggatgcccaaccagtaagtatgttgcaaacattccaaaatccaaaacacttctggtcccaagcatttcaaataagagaaattcaacctgggattcaaaatataaacatcatatttttataacgcctggaattcagtaaaagcctgggattcaaaatataaacataatattctatttcatta

SEQ ID NO: 117631 - DNA, 891 bp, Homo sapiens
tgcagtggcaacgtgttccggtcctcttccacatcacggaagatttgctctttcctctttgcgatgaatcttgctgctggtcaccctttgggtccacacagcatttatgagctgtaactttcagtgcgaaggtctgcagcttcattcctgaagccagcgagaccacaaacccaccgggaggaaagaacagctccaggcgcgccgccttaagcgctgtagcactcaccgcgaaggtctgcagcttcactcctgagccagcgagacgacgaacccaccgggaggaacgaacaactccaggcgcgccgccttaagagctgtaacactcactgcgaaggtccgcagcttcactcctgagccagcgagaccacgaacccaccagacggaagaaactctgaacacatccaaacatcagaaggaacaaactccggacacgcctcctttaagaactggaaagactcaccgcgagggtccgtggcttcattcttgaagtcagtgagaccaggaacccaccaattccggacgcacttcctccggactgttggtgcactgagtgatctgaagtgctccctggccaccatgaatgtaagcaggtgaggcaaagtacccaggcttggcagcagaggctgggctatgcacacactcttagcagccagacagtggacctgggcgtagctacaggtcaggagggcctgcagaacagatgtgcccagtgctgcagagaactcggccccactttctcctggcctggtagtcagattaggctagagctccgtcagagaaagatggggagcccagggagataggtccctatggccgtattctgctggaggtgtgtggtgcacaaagtcccccagctctgtgctggcttaagcctcttctttgtctactgtc

SEQ ID NO: 117632 - DNA, 700 bp, Homo sapiens
gcctggcgctgtggaggttccaatggccgccatgttgtctcagagggacacaccacaggcttctggaactctggctccattttgtgggtgcaagtttctggcttccgttttaaagagcaagagaacctatcagcgttgtcaattctaagaaagtgagtgccaagagcaggctgtacaagaagcatggcacaagaatctgcttctgaagagggcttcaggaagcttccactcatggtggaaaaggaaggagagcaggtatcacagcgcaagaaagaagaaattgttccactccataagttccctcctggaggatgtgtgagacaccaggctgcatgttagaaacggctgtgctccggaaggctaccagggtcatcgtgagggccttgcagatttcagaaatgaagtgacctgccttgagtcttccctcagcctcctcactccactgtagtctcaggagagtgaggacaacaaaactctcttctccccacattaccacttcagcgctgacctgtggcttgagaatctaatctgtgtgcaccgtggcaaagtcttggttttacaggtctcacctgacagctagtcctgatttttccatgatgtgtgggtaaaaagtgggttcttgaagggaaacctcaatgtagcttagctcttgagaaaacagtatgtgcatatgcttcttggatagaaaaagaaaaaggaa

SEQ ID NO: 117633 - DNA, 352 bp, Homo sapiens
  misc_feature (340)..(340): n is a, c, g, or t
cttgatttccttcctgccttcactctaagttgagcaattccatgtcaaagataggatagcactgggagggatgatactagagtagcctggagctctatatgacacatcacatatgcaggtcagcttcaccttctgccccaagctcatctgcgctatgtactcttcaaaaccactgatgacttcctgttcaccagttttgaacttgaaaggtttgtttctgtcttcggataaatcaaatttattcccattttggaacacccctatgtagtgcgctacacacacctgggcagaaagaatggatcatgccatgagacagtgaggttagcacactgtctcgtgncatcgataaaca

SEQ ID NO: 117634 - DNA, 781 bp, Homo sapiens
cactattaatgaagttttttgaaaaaaatgacattctgaacatattaaatgacgttaaattaaaaaaatcaaaagatagtaagactgagaaggcttttccaatcctagagggattcagaagtaatttcaaaacaaagatggggaggaaagcttctccttcctccagcaaccttttctctccttacatgaagctatgactttaacctcttcttggctgcaaagtgaaatctatttttttaagggtgaaagaggtatgagtacttaggagaggaataaaacaacacgtattggattctatggtgccaagcttgatttgcctctggcttggccattccaagaagagcttaagctttttcatcttaactctgatgcacaatcttaatttaaactgtatgagatttgccctgatgcacaccagtttcatccgtttctggtatcaacaaaatcaaagcgtctaactttttcaaacacaaagggatgaattgtgaatacctgctgaatttccacaagtcaacaacctaacaaaaccacaaaaaaagacgaggtaacttttttcttaagtgaaaagtagcctaacactagaaaagagaacatttatttctgttaatctgggcattaataaaaggtgctgggccataattatagttccctttgtcatttaatagagaggtagaaaaatgcagatttttattccctttgcctagggcggaacctgagattctgcatttctaacaggctccgggtgattagatgtcactgaacgttgtcacattgtgtacca

SEQ ID NO: 117635 - DNA, 308 bp, Homo sapiens
tttcaccatgctggccaggctggtcttgaactcctgaccgcacatcttaaatcttcatcacaatcctatgtactgttatctctattttattattatagaaattggggcttaggccatacccagtggctcaaacctgtaatctaagcactttgggaagctgaggtgggtggattgctcgagtccaggagtgtgagaccagcctgggcagcatggcaaaactctctctctacaaaaaatacaaaaattagccttgcatggtgatcgcaccactgcactccagcctgagtgacacagtgagaccctgtctc

SEQ ID NO: 117636 - DNA, 873 bp, Homo sapiens
gtccagagtaaagcacattcttatttcagtaaagggttgtgtgaagctatggcatttttcttaccctttagttgccaaatggtctaaagaactactagcgttttaaagagaggaaagaaatgtatctgttttcagttggaaagtagcattttggtacatcatgctttgctttgtttcttgctttttcatctttttggcatcttttttaaagatcttatctgccaggaagttccttttttcttttttttccctttttcgtggatcagctgctttttggaatcaatgccacaattttaggaccaaatcagtgatgctgcagtagtttcagggttaaaagcactttggttaatgtgaaattcattgtcaaatatacttcaggacaaattatgaaaatgatagcattgagattcagctgtatccatttctattcatggcttaatgaatattttcaggcttagtgttatatattctcattagcaacatattcatgttattttacttattttaaaaaataaacaactaaaggttagccaccatcttctcggaaatattaacagcatccattgtactgcagtcatccagtcttctgtggaagtcagttgcatgttatttactttaacaaagaatttcatgtccaagggaattctctatatgggatctcttttctctgggtgatttattttcactggcaaaatggtacgtttctagaggtttgtgtgcttatgagtttggtttaaacttttccttgaaaagtaaatgcttgatcccctcagagtccaaccacctagtgataatgaagaactgaaggatagttatttcaatttcgacgtcttaaaagtgcttaatgagcaccttttcatacctttaagggga

SEQ ID NO: 117637 - DNA, 620 bp, Homo sapiens
gagtttcaataaccaggtaaacataaataatattcatttatttataataacatttattgagcacctaataattgtcaatcaaggtgataggcactgaccatcagccaaacagcaaaatagcaatggaccatactccataggactggaaagtctagcaggaggttgcagacaaatccgtatgtcattacaactaagcatgaagaaagcttgcattaataagtcatgtgctttggaaacacacagcaagacacaaagcccagactgggaaagtccagaaagattcctgatagaagtgaaaggtgacaccagaaagtctctcttcaccttagcaagcagaagctgtccagagagaagagacttccaggcagagagagaaaaaatactgaggcctaaggtagcagctggcagaaactgcagagaggaaagcctgactagagcatggaatacaagagagaaggagacagagaagtgggaggggcatctgatcagaagcatccattacagtagactcatctaccgtcctcctggaaggaaacataaatgaacttttaaagtcagtccatcttggtgattcagtgatgcaactccatgtaaaagatctctcctcttaataccagaac

SEQ ID NO: 117638 - DNA, 798 bp, Homo sapiens
cgcccacagagtctgacggattctccctgtgccaggtgcccaggtcctcagcagcagcctcatctgaaggttcctacccagagggcacagcagccctctatgataacctcttcagaagagcccaaagtccagagaagaccaacaatttggggccccagccagtctgggggaccactgggaccagttacccccaaatcttgacagggtagcccaagaggcagagctaccaagtcagagcacgggcagagtaagacggcccaagctgcccaggcaggccaatgcagatgtgcttgtcagggttgaagcccctttggcagggcagaaagggctgcccagtgcctctgtacagggggctctctgggcctctcagtcttgggacaatgtgtaggtagtggtgggtgatgcttctcaactgccggaaggccaagcaacacagaaagtaaggtgaaggcctgggccccagcctgtttgctcacctgtaagatggcataggcagcagtgaggggcagatgtgggcagccttgaagtgtgtggctgggtgggggccagcacttgggaagtggaggcaaagatctcctagggcccagtccacattcctcacgttctgcgagggggacactgccctcaggccctgggagctgagaagggctgggaccttaggacatcagttagacaccaagcagaactctcccggggaggcctgagcagatgaccatgaggtcacagcctgcccgggcaccaaggacttctacctgccctgccagagtgtgggtgccaggggcccagttgccaggtgac

SEQ ID NO: 117639 - DNA, 492 bp, Homo sapiens
aaccctccatgtccaggctgcattgtgtatggttgagtggactcccatcacatccaacagggcctaagaccaaaagaggaaagacacacagctcatgctggaggctgtgtgctgtcaccatggtgaatctcagtttgcttgcacagaatggcccactgcagctgcaacttaattagagttgggccaaaggaacaccatgacatgggtaaccagaggcagctgccacaagcagttcctttgtgccaagcactgtgcaactgagtaactccatccctgcccatggcagacatcactaatcaattacagcattcttgctccataagtccagacatggctgcaacatcattcctcacatagtgctccaggcaggcattaccggtgtgattggagttggaagggtcaagaggttccatggccattatcggttgaagatgaaggaaggggccatgagccaaggattaagggcagcttctagaagctggaaaaggcaag

SEQ ID NO: 117640 - DNA, 502 bp, Homo sapiens
atatggtggaaattctgtattatgatttctactgaatacttcatctcaactctgtgtttagtgatgtcatgttaatggcaggaaattggccacagggggagtatttttggaaaaatgggcaaaaacactacaaatcaaggcttgtttgtttctttttcgggatgattgtcagacttaagaaaatgatggagaaaatgttagtaatggcgattaaacttaaaaatgcattatgtcggccgggagcagtggcttatgcctgtaatcccagcactttgggaggctgaggcgggcagatcacctgaggtcaggagtttgagaccagcctggccaacatagtgaaatcccatctctactaaaagtacaaaaaattagctggatatggtggcaggtggtcgtaatcccagctacttgggaggctgaggcaggagaatcacttgaacccggcaggcagagatcgcgccattgcactccagccctggcaacagtgcaagactccatctca

SEQ ID NO: 117641 - DNA, 233 bp, Homo sapiens
agtcacagtagtagcgcccagttttcagagaagtacccctgttatcattctgtgatttcctctagtgctaatagaaacaaaatatggaatctaccaagtacccgtaaatatcctatgattcttatctttctttgatactagcactgggagtgcagtggtaaagagtcatacttcttttttttttttttttttggagacagagtctcgctctgtcgcctgggctggatggagtg

SEQ ID NO: 117642 - DNA, 501 bp, Homo sapiens
tctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaa

SEQ ID NO: 117643 - DNA, 296 bp, Homo sapiens
  misc_feature (12)..(12): n is a, c, g, or t
ttattcctaaancagcgagtttgaagtctggcccaggatcgtctagattttgacgttctccttgtctttgctgtgtacccctgggagaaacaaagggtgagaagaaacaagggaaaggagaaacatttgtgttttccaacttttcagtgttgatcaggtatgaccattgctatgaggaaatagacattggggattactatagcatgagggagcggggaaagggttgaaaaactaactgttgggtactatgatcactacctgcataggcgatcatttgtaccccaaaccttagcatc

SEQ ID NO: 117644 - DNA, 443 bp, Homo sapiens
caccctacaatgcacaagacagcctccccgacaacatcttgggggctcctcatccaaaatatcagtagtgctgaggttgagaaaccctgacctaggtggacaacgtatagtctctttgccacaaccaggacggggtgtagagtgagtggactagtcaccgtagatgtgcaaagacacctgtccctggcagaccataatgtcaggagagttcagcagcagcccagacctaggctctggggttttatcagatttgtcccagcttagtggggctcttgtcctcaaagaggctttgttttgtttgtgtctttttgttttattcatttctgttttaaaaactatttttattttttgtaggaatagggtctcactattttgctcaggctgggcccttgttttattcatttcttgatgttgaattctgaagcagagacccaggttggagc

SEQ ID NO: 117645 - DNA, 829 bp, Homo sapiens
atagctcatggagcctgacatatgttagttctcctttgcctaaaaacaccaagatctggaaaaatcaaaaatagagctttttttaagttatagaattctataaatttcataagtaaagtttaatataactattagtatgaagtgaacaaccactaattttctatcatagagaagtagtaagaattactggaatctaagaaagtcccagagtaaaataaatgactttattttcacccctaggaaacagagatatcagataataaactgtttttttttctggaaaataattgacaataaatttaaagataattttattaaagaaaaggtaaataaactatttgcaaaacaagattctaggcagaatagcaatagcaaaatcagagaaataaaaaaaggcaatagcaaaatcagagaaataggaaaacttaggctaaaaaaacacttgatattgatcttagcgtaccagtatgaaaatagggaggagaattgaaagacttttttattctggggtaatgtgtttttattgcctgtttaataatgaatatccataaagtttgtgatcaaggataatttttgaaataataatattttgaagaagtatgagaaaaactggagtgagaaaaagatagtggggaaatattagaaatatagacaagccggttttttttgttgttgttgttgttgttaaaacttttcactattttcctgttggtttaaagtccaaaatttattcatccgtccacctatccatacatcaacccattcattcatccattcagttattcaacaaatatttatgtaaggacaagtgatatggagaaacagacaa

SEQ ID NO: 117646 - DNA, 539 bp, Homo sapiens
tgcgtcgacttctgctctgaccttctgctctttttccagtgtagctacaatctcagccacctggctggtggagatgtgaacatcttctttgtccaccagctcaatcaccttgacgaggtcgtcgatgttgaccttgccatcctatgtttcattcagtgctgcccgtaattatggtgtttctaagaaagtaaccaagaagccagtatttttcactgtaatagttgcagtggtgggattacttgccagtattagaaaatggagaatgggaaatggaaaatctcattggattactcctccttacattactgcgtttggatttgtagtcttaacaaggcaataaatggaaggggaaagaaggaatcaattcatggtaactagaatgtaatgagcactttcattaagtcacaatttaatttgtattctttcggaaattcttttctggttttaagcctaaaggggcctgccttgaggaggtgaggaagataagcaggtgtgggagggggtgtgggtagtgggcagggggttgaagagagcaagaa

SEQ ID NO: 117647 - DNA, 728 bp, Homo sapiens
actaagagatttagagtctgggctttaggtcacccctggaaggactggaaactgaaaactgagaggatccacatggacaatcaagcatgcctctgtgatgaagttccagtaaaaaccctgaacactgaggcttgagggagtctctctggctgggaatactccatgtgtattggcacatatcaaagccggaagggtaatgcactgccagactgagaagactacaataaatacctaactcttcaatgctcaggcattgaatatccacaagcatcaagaccatccaggaaaacatgacctcaccaaacaacctaattaaagcaccagggaccaatcatagaaaaacagagatatgtgaccttccagacagagaattcaaaatagtggtttcagggaaactcaaagaaattaaagatagcacagagaaagaatttggaattctatcagataaatttaacaatgagattgaagtaattaaaaagaatcaagcagaaattctggggataaaaatgcagttgacataataatgcatcagagtctcttaatagtggaatcaattaagcagaagaaaaaattagtgagcttgaagacaaacaatttgaaagtacacaattagaggagacaaaaaaaattttaaacaaatgaagcacgccccacaagatctagaaatagcctcaaaaaggcaaaagcccaagagttattggcccttacagaggaagtagagcaaatag

SEQ ID NO: 117648 - DNA, 581 bp, Homo sapiens
tgcatggtggtcggtaaggaggctcttgcatgttggtgcaaggcagatacctcgtggaggtaggactcccaggacaaggtgagatgtggatgccttgccagatctgggtatgaagttatgacttttctccctctaacttccccaaagtcacctgaaacagagacccgtaagcacagaaacagaaaggacaagttattagaatgggaagtttctgattgtgagggaagccccgtggcaaaccgagacacgtccaccaagtgctctccgggaagaatggcctgccaaggccgtaccatcccaagcacagcagcagcatggggtagcgcacgcctagcatagtcactggagaaaaggaggcgggattaatgctttctttcctgaagctgtgaagatgagagtcaaaaatgagacgggaggaagaaagtttaggaagtgtacccaagtgtttattttgatattttactctcaaaaagttttatgttaaaaactttggaaaccctgccagcttattagttcactatttctttaaagagttctatttaaaaagaaagtaactcagaactgagtaggaagacatgttc

SEQ ID NO: 117649 - DNA, 371 bp, Homo sapiens
gggtaaaatagaggcaccattcaatccactacaggggttgagaagaaataaaatattacaaaatgctccctgataagaaataaaatattacaaaatgcttcctgataagaaataaaatattacaaaatgcttcctgaatgtgatttagaagtttttttgtttgttttgttttgtttttaaatggagtttcactcttactgcccaggctggagcgcaatggcgtgatgtcagctcaccgcaacctctacctcctgggttcaagtaactctcctgccttagcctcccaagtatctgggactacagatgcccgctaccactcccggctaattttttgtatttttagtagacatggggtttcaccatgttggcca

SEQ ID NO: 117650 - DNA, 472 bp, Homo sapiens
ggttcttgctctcaaggatctgacagtctaggagacgaggcagacacagacacagaatgtctcaatggactgtaccaagtgccactagagagggagacacaaggccatctcggaaacagagaaagaggatctaagtcactattggtggtgaagggggggggtccccactgaaggcgagcctctgagaggtgacagctgagtctctcagcataaatgttagccaggcagggaagaggtgtaggacatgggaaagtgacaaagacaggcctgagtgactcgtacagatcaaagaggcaaggataactcccaggtttccagcttaggccccggattaaacggagacatcaggccaatggattaaaaacagaagcactccttggtgccagtggagcagtgagccccttcctcacctgcacacgtgagctccaagtggaggtgcttaccgggaagtcggtacaaatgtgaagttcag

SEQ ID NO: 117651 - DNA, 163 bp, Homo sapiens
aaattttcctcacccaaaatggaaaccccatacccattagccatcatccccatttcccctggccactctcagctctaggcacctacttatctactttcggtccctacacacctgcctgttctggatatctcatatagatggaaccatatgacatgtgaccttt

SEQ ID NO: 117652 - DNA, 334 bp, Homo sapiens
aaaataaaattttaatgtaagaaaattgaaggaaaaaatggacttttgtgttatgtcttcccttactttgttctgtctgtatattcctatattgattcggtagtagcaatgcataattttcccacaaacttcatccttacatgtagagaaagtgttgataaaatattcttgcaataaagtgctctttgcaaatatgtacttcattttcactgtttattcaattttcttaataccatataagttcttacaggagagcttcagattctccatacaaaatggttaatctaaaactatgctggatagagtaaaacccttgctgagcttcttagaaaaa

SEQ ID NO: 117653 - DNA, 149 bp, Homo sapiens
ctataaattatcaagaagcagccaccctaaaatgtaactaaaaggtgcctataatcttttcataaacgttgattggaaggatactgtaaggaatcaaccaagaggagtgttggagaataagacttgaacaatatttctccagcattgtc

SEQ ID NO: 117654 - DNA, 829 bp, Homo sapiens
gcaggagagacacatgacacaaaatgaaagtttccatgctagaaatggacatggatatatagaagatgtgtgacatccacaagtcagaatggaaaagaaagcaagacatagaatttataagaataaaaactcacatagagataagagaaatgagctttcatggtatctgatgtaggcttttgggaaattgccaccaaatatttttaaaattaggacacattttcccaaccataagcataaatgagttagccttgatatttgcttcatgaattgggtaaaattaagctgagggccagatgttttccatctgtgttttagattatgctaaacataaaatgattagaaagcacccatatatgactggtttaactctacatgaaaaaatcagatgacatttagacactgccttagactttagaaaattttagtgtattttgatgtcagaattttgacaagtaatgaaaatattagatgaatagttttactgtaaaacaaacttccatttcataataggcataatgaatcttcataatgctgaaacaactttttgaaaagtgaaagctgcagattttccaagtggtatcaaactaagagttgggtttatttaccctgaattacatttggtatgaggtagacaaccaaaatgtattagttaatgtggtttattatgtgttgtgcagatactactatagttcatatgcataggctgatttatgaattaagtctcaaatatccaatagaggattatacttttagataattgctaaagacacggaaagaaaagtgcataaagtctagaaagggaagtcatcaaaatgtcagcatgaaa

SEQ ID NO: 117655 - DNA, 867 bp, Homo sapiens
agacctgactagaaacatgagacagagatgcagcgggttctccatggctgataaagatgagacatggtactatatatgatatgactcgtaggtgacatcctggtcttgaattgtgcttgaatgctacaacatataataaaatgaccaggagtggagaaactcgaatgtacagaagagatccgaacggacattcggatcgtgatgtcggcttctgtcaactggacatccaaatattgtctcgatatcaggatcacagtcccccacatgcataagcataaatgagttagccttgatatttgcttcatgaattgggtaaaattaagctgagggccagatgttttccatctgtgttttagattatgctaaacataaaatgattagaaagcacccatatatgactggtttaactctacatgaaaaaatcagatgacatttagacactgccttagactttagaaaattttagtgtattttgatgtcagaattttgacaagtaatgaaaatattagatgaatagttttactgtaaaacaaacttccatttcataataggcataatgaatcttcataatgctgaaacaactttttgaaaagtgaaagctgcagattttccaagtggtatcaaactaagagttgggtttatttaccctgaattacatttggtatgaggtagacaaccaaaatgtattagttaatgtggtttattatgtgttgtgcagatactactatagttcatatgcataggctgatttatgaattaagtctcaaatatccaatagaggattatacttttagataattgctaaagacacggaaagaaaagtgcataaagtctagaaagggaagtcatcaaaatgtcagcatgaaa

SEQ ID NO: 117656 - DNA, 1708 bp, Homo sapiens
tatttgccttactataactcttagaaaaaaggcttacaacttttgaaggtttagcatgatgtcagatgtccatttgtcatatatggcctttattggcttgaggtatgtatgttctatatgtaatttgttttgagattttgtcataaagtaatgttgaattttctaaaattctttttctgcattcacttaaaagttataattggttctgagatccttcatctttctcagaatctaggaggatgcatctgtacctagaggaggacacaaaggcatcatatgttacattctcgtgacatataatgtctactgcttataatgtctactgtgagtttctgactccccaaatgaaattgaggcccagaaactttcaactgctttgttcgttgaataatgccaagtgtctggaaatgtgactattcagattaaatgcttaatgtgtgtgtgttgactaaataaatctcaaccagaaccttctcagatattttgttgaacgtgggacctttgtttttttttgttgttttgttttgttttgtttttgttgttgttgttgttgttgtttaccagcaggggacccctgttttgtctatgtcaagaacaaagaccaggcaaaagaaatgtcaagccgcatttacaaatgcaaaaatggacttgtttttgatatgcttttcccaacaataagggacatgagtcattggggcatgttacagagagtttcagtaaaattcagaaaaaaataataaatatgaacagccacagcatgcccagaagcctttttatggagccaggcatggttgacctgctttccatgtctcaaaacattagtccctacaagaaccctatgaggtttatcttcttttcacccattttgagagaagaaaagttcagctcagagagctgcaggaacattggggacatctccaagtcacagccaataggtggcagtcatcagtgtgtcttggaagggacaaacattgagcttctgaacagctactccagaaactatggtgctgtggtgaagtcctggttaggagcctatgaaaatggtgaaggaaaagatggtcccagcctgcaaagctgaagtcaggaacccaccaggatctcccttctccctagcctggtggtccacatcatgcagatttactctagattcagcttagactcatttttatactactcgggggacaaggagggaactacagtcagtaacagcagcatgagcctcaggtgctttggggattgaaattcagaccaggaaattccaatacatcagtgcatgtggaggacatgagtatttaaggagaaggttctaggcttccgaagtaaaattggatgtggaggttggggattgattcaaacattaatactttcaagcgtttctatggtatttgtcagctgtggagcaacagcacacatctgtattaatagcctgtgttaagagattactgtgaatcctgaaaaacatcctcattgtagagatgagaaaacacaggcttttgcacatccaatgtctccttaaagcatgtggttcagaattgagaacgtgcagagtgagagtggtatgaattttcctgtaagctacctgaagttctgtttgctgtcatgtggaagaaaagagccttggagaagttttatttttttctgtttggaaagaatacacagagcaagatgatttacaataaaccttttgacctaacgaaaaaaaaaattt

SEQ ID NO: 117657 - DNA, 1180 bp, Homo sapiens
ggctgaccctgaggattcgcgcgtgttgtttaccagcaggggacccctgttttgtctatgtcaagaacaaagaccaggcaaaagaaatgtcaagccgcatttacaaatgcaaaaatggacttgtttttgatatgcttttcccaacaataagggacatgagtcattggggcatgttacagagagtttcagtaaaattcagaaaaaaataataaatatgaacagccacagcatgcccagaagcctttttatggagccaggcatggttgacctgctttccatgtctcaaaacattagtccctacaagaaccctatgaggtttatcttcttttcacccattttgagagaagaaaagttcagctcagagagctgcaggaacattggggacatctccaagtcacagccaataggtggcagtcatcagtgtgtcttggaagggacaaacattgagcttctgaacagctactccagaaactatggtgctgtggtgaagtcctggttaggagcctatgaaaatggtgaaggaaaagatggtcccagcctgcaaagctgaagtcaggaacccaccaggatctcccttctccctagcctggtggtccacatcatgcagatttactctagattcagcttagactcatttttatactactcgggggacaaggagggaactacagtcagtaacagcagcatgagcctcaggtgctttggggattgaaattcagaccaggaaattccaatacatcagtgcatgtggaggacatgagtatttaaggagaaggttctaggcttccgaagtaaaattggatgtggaggttggggattgattcaaacattaatactttcaagcgtttctatggtatttgtcagctgtggagcaacagcacacatctgtattaatagcctgtgttaagagattactgtgaatcctgaaaaacatcctcattgtagagatgagaaaacacaggcttttgcacatccaatgtctccttaaagcatgtggttcagaattgagaacgtgcagagtgagagtggtatgaattttcctgtaagctacctgaagttctgtttgctgtcatgtggaagaaaagagccttggagaagttttatttttttctgtttggaaagaatacacagagcaagatgatttacaataaaccttttgacctaacgaaaaaaaaaattt

SEQ ID NO: 117658 - DNA, 173 bp, Homo sapiens
attctgggactagaaaggaatgtgcttggatattacaaatatgagagcagaaataaaaaataatttggaagtttgggggaaaaaaggaaaagaaaacttccagaaagtatgacaaaaagaaaacagaagagaaagagttagaaaatttaagaattaattcaggagtttaagca

SEQ ID NO: 117659 - DNA, 409 bp, Homo sapiens
agtatatatttgcatcttgattgaaaaatatgtaactggaaacattactgtttaataaaaggtaatgttttatgaaaagaaagttagcctggctctgctaatactgcagcattaaattaaatgcttctttaaaatttccccttttctcgatggtaattaagttaaaacatgaaaaatatttgtattacatgtaatctgacatttaattgatgttcttgccacagacttttcccttgttttattgataaaaggaggggccctctctggaacagatacctaccagtctttggtcaataaaactttcggctttccagggtatctgctcctctctgttcttcagtttttgtatccttttatagcaatgataagttacaatataatagctggagatactttgagcaaagttttt

SEQ ID NO: 117660 - DNA, 385 bp, Homo sapiens
gcctttgtctagccacatgcctttcagggctgagaaaaagccatagagagctttagcagcaacagtcccatctggccccaggactgcctcttcacctatgctactttgttctgctggagattatacacaaggtaaagagggaccctcctatactcctgcactaaagaagagaagcaagtcccttctatcttaaaccaacatcgttcctatgcgaaagaaaagattagtcatgatatgactcaggaaataaaattgagactggtggccaggcatggtagctcacgcctgtaatcccagcactttgggaggccaaggcgggcggatcacgaggttaggagttcgagatcatcctggccaacatggtgaaatcctgtctctactaaaa

SEQ ID NO: 117661 - DNA, 540 bp, Homo sapiens
gttggccaactactcacgcccatgtccacaaccatgagccagtcccacagctgagaagccaactaagagtatgtgagtgagctgtgaagcagacaggttcaaccacataaccaacatcttctgagcaacttactccacagcaggaatacagatgtgagcaaagcagacctggtacctggcctcatgaagcacggatgctatgagaggatatggacaagtaaacaagggaacacaattcagtgtgatcactgctttcaaggggaagtccaggggaattgtggggacacaaacaaggggcacctaacccagtctggaagatcaaagtgggttcccagaggagtaatatttaagctgagacctcaaggatgaataggaagtagtcagagaaaagaggagagagggagcaagcatgttgggcagaggaagagcatgtccgcaggccccagagctcagaagaacgtggtgcaatttggagtcttgctcaggaactaagtccacaatgctagggcactcctgctgtatggagtccactacatcttg

SEQ ID NO: 117662 - DNA, 729 bp, Homo sapiens
gtagcggcgggaggctggcactagcccgggccacgataggtcggactacagctggtagcaactgggggtcggaagtggagcccagacaacagcggaggagaaatttccggggcagaaaatgaaggtgtccgagagactgacaattctcttctgacttcctcagtgctaactggctttgggtatctcctgcagcaaagtggccgccccgccctctcatcccctgcgacccagcacccttcttccttgccttgaggctgcgccttagacagcccggtgggtatctgtttaccccttagcactaagggataagtgcacagtaagtgcagaatcatacagtgtttccaaatcctcagggtagacgtgtgagcttagtaaatgagaggaatagcggacgaacctctccgtgtgtttgtgtctcgagtgccctcatctcaggagcaattttaataacttaacagttgcggtcacattactttgaaaatacaaaaaacgtagaaatcagagtagcaaagaaaattatggatctgatgctgtgccagaattgatcacagttgctctaaagccctggggtaatagttaatatttcatgtgagcctccacttaaacgatttatcaatactcagtacaccactcttggaacagctagtaaaacttcaggtgcattataaaaagtacagtaatgcattggcttcaacttgcatatttcccaaacatgggcgtttgcaagaa

SEQ ID NO: 117663 - DNA, 778 bp, Homo sapiens
attctactgtgacctgttgctgaggtgatctgatgatataggtcttgcctttcattttaactgccattctggcaactgaacgttggcagtaaatgcacctcacttgtctcagaggaaccacaatgggatgtgtttatagttgttgccttgaagtgtgttgtggcgaggatgaaatagtgtatcctaggatgccaggggaatccaccgtctgccaccgcgagcgtgagaagccaatcacctatcactggtatcactggcatcccggccatatataccctagagttgcatcaatggaagattacgatgaggacctggtgcaggaagcttcatctgaagatgtcctgggcgttcatatggtggacaaagacacagagagagacattgagatgaaacggcaaatacggcgactacgggagctccacctatacagcacatggaagaagtaccaagaggcgatgaagacatccttgggagttccacaatgtgagcgtgacgaaggctccttgggcaagccattgtgtccaccccgagatactctcggagacgttgccaggctctgtgaatgaaaaagggtatgctttccatcaggaagatcctctagaggagtttatagcagaaccatctccctgaagcatccaaatcagaagtctcctcactgttgcccatgcagaccacaggcatccaaaccaacggcgacctggaagacctggagggagcatggcccaggcagacacagactcctgaggaagccacagaagttcacctgatggagggggac

SEQ ID NO: 117664 - DNA, 178 bp, Homo sapiens
tcaagctctgtgctagggaaggacaagaagtacatgttaataggatgggacagaaaccacctcctggcatgggagtggggcacacatatgtgcatgttcatatatgtgtcagaatgcgtatttgtcagtgtatgtgtgtcagtgcacataggtataggggctgtctctcagaattcct

SEQ ID NO: 117665 - DNA, 430 bp, Homo sapiens
acaatgtgcatatgtaccctaaaacttaaagtgtaataaaaacaataataaaataaaataaaaaataaaagaaaccttgaggttattcctaaataattttattcccaatcatttgccttagagattattgattgattgggaaagaggcaggattgctgctctctggctgggaactgagcagaacgtgccacatggtctccattgcaaccattgctcttacagggccatggtgccacatttatgccccagcaggctcatcttttcctcaggtctctaagatgttttcaccagaactgctgaacagaaatgcccttcagaggtcagctgagatgttccttcttaattttctttctctgcaggtctgactaaagtgctggattattttatctttcctgttcccctgacttccacttgacttgtttgtgaacag

SEQ ID NO: 117666 - DNA, 756 bp, Homo sapiens
gactctctgtagactatttctgtctggagaaaaggatgggtaggtggatggaagctgtcactacaatactagtacaaaagttagatttaaattcatgtttctttgcacacggtaatctacataaaaaagtttttacttcatatgtagatgaataaaagtgccaagttatattaattctctgataaaatagttttgtaattccaaagctactgggaaaagtccaacagacacatattttttaaatttctaaaagcaaaactagcactggaaaaaataacttggtccagaaatattggtttgtattgcttggaattgtaagcattgtgttgttttaaggtcctttttacccttcaggatagagccatggctttcactggattcccagaggcaccaatgtcacagaaatgagtcactagttttctcagctcttgaaatacgtatctgaagaccagtgaaaatctgacttgtcaagactatgattctaattactagggtttcttgagctcactgtttttgctattaaatattttcttccttcctccagaaattctgtgtttgaggattttatgtatcccttgtgaaataatccccaaataatgaaaattcaacaatacaaagtgatgcagagacaatgatccttgacaacagtagtatagatatctgctcattaaaaaaaaaaatcaaaggccttattttagtctatatctagttatttttttctacttttcaatgtttctccctatctttctagaatta

SEQ ID NO: 117667 - DNA, 436 bp, Homo sapiens
ggtgcatgcatgtggggaagctggcatggccaggaaactggtttgagttatggagaatgggcatgggcacaggggccaaggtgaagttagatgagtgggcagcgcccaggacagcaagggctttgtggactttatcggagaagcagttgggaaccactgatgtcatgtgatgaaagttcatctttggaaggataagtagtgggcagaatgcgtttgatggagagagaccagaagcaggaaccaagtcagaggcttctcttttatatattttacctttggcaacccaggggctcatttacccatttgtactgtaagaacagattaatgggaagctctagatactcatttagccagtcatccgtggggcctgtgcccggctcccctgccacttcacccagaaagcaacttgtgaaatatccagctcattaaacacatc

SEQ ID NO: 117668 - DNA, 736 bp, Homo sapiens
ttcatccttcgaggagggggccggcaggtgtggttgcaagctggactagcagcccagcggggcgagacgggggagtaggaattgcgggggcctggtatttccccagagcctcctcccaggccagggagatgccacagtgcccgactttggaaagccaggaaggggaaaactccgaagagaagggggacagttccaaagaagatccaaaagaaaccgtcgcgctggcttttgtgagagagaacccaggggcacaaaacggacttcagaatgcccagcagcaaggcaagaagaagaggaagaaaaagaggttaggattgaaagctggggaatggggagccatgttggtaataacaggaaggacttggagggaagggggtcttggctgatgatgagagagtaaaggagaaactgtgtgctgagactgtcaacatctcaccacttttggttcatataaaaagaatctacttcgatgatctgttttatagaatcaaatgattgtgtgtgtaatctaaaaaaccatgccttgtcctaattttcattctatttgtgtttaggatgcctttaaaaaatagcaggaaaagaagatttccttgttttaagaaggcgctgatttgtcctggaaatttagtacgccttcagtatgatagcaccatactgacttatcaggatccaactgcagcttgtgcattccggttcttgtttaatatttcaccatgccttgctccattcagactga

SEQ ID NO: 117669 - DNA, 253 bp, Homo sapiens
ttgatgagcatgggaagaaaggagtctctaaacatttttgtcaccttccttaattctgccttttttatgttagagataaataatttacttgtgtgagagacagagcaatgatgccatttacctgctctgtcccctgacgcttctagcagtgaaatggaagctttataagctctatggcttctcaggtcattaaagccacctccctgcttcacagaagtcagatatggccatgtggatatgcctaccacttatg

SEQ ID NO: 117670 - DNA, 254 bp, Homo sapiens
agtactaaaatgtgactgggaaaaaagcaagacaaatatcatcttttgaagataggaaatgttaatttgccaaccaattgttcaccaatcttggtttctggtgtttgttggtacctctatttggtggggaggattttataaagttaagagagtcaggtgaaaaattacagttcataaaatgtaatccttgctaatagaagatatttttaaatgtccactaaaagaaaatatggtttttgtacaactagcaatca

SEQ ID NO: 117671 - DNA, 283 bp, Homo sapiens
ttcgccagtgtcaaagctgactcacacctgaagatgtctttattattattattattttttaagagatgagatctcactcaggctgttcttatactcctgggctcaagcaattctctcaagtggttgggactagaggtacatggcaccacacctagctgaaaaagggaatcttaatgagacagttgagtatttatgtagatgttgaagtgcttttcgtatttatgaactgagttcgcatcctctactcacttcttaaggaatctgttatcagaattatatataa

SEQ ID NO: 117672 - DNA, 640 bp, Homo sapiens
ccccgggctggggctccgctggggaaccggccgagcggcgcgcgcggaggtgtccggcggccaggaggatggccaaggtcccggagctggaagacaccttcctgcaggcgcagcctgcgccccaactgtccccggggatccaggaagactgctgtgtgcagctcctgggcaagggcttgctagtctatccggaagaaacagtgtacctggcggccgaagggcagcccgggggcgagcagggcggcggggagaaaggcgaagacccggagctgccgggggcagtgaaatcagaaatgcacttaaacaatggtaacttttcctctgaagaagaggacgccgacaaccacgacagcaaaaccaaagcagcggatcaatacctgtctcagaagaaaaccatcacgcagattgtgaaggataaaaagaagcagacacagctcacgctgcagtggcttgaagagaattacattgtatgtgaaggagtttgcttaccacggtgcattctttatgcacactacttagatttctgtaggaaagagaaattagagccagcctgtgcggccacctttggaaagacaattcgccagaagtttcccctcctaacaacaaggcggcttggaacaagaggccattcaaagtaaga

SEQ ID NO: 117673 - DNA, 407 bp, Homo sapiens
atctttgtcactgtctgtgaagctgctcagagttggattcagactcctttgatagcctttttttttccatttttaaaaatttatcttattattttttttgagacagagtctcgctctgtcacccaggctggttttacagtggctcgatcacagctcactgcagcctcgacttcctgggctcaagcaatcctcccacctcagcctcctgagtagctgggactacaggcacacaccactacgcctggctaatttttaaaaaaattacttgtagagactgggtctcactatgttgcctaggctggtctcaaactcctgggctcaagtgatccatctctgccttccaaagtgctgagattgcaggtgtgagccactctgcctggccttgcctccatttattttaaatttaa

SEQ ID NO: 117674 - DNA, 360 bp, Homo sapiens
tagatttgacaacttttaagaactgtacagtgttcacttggactgcgaagccccatttgaaatttctgttagacaattcaacgtgcccaaccttctcctttggttttgaagttcaatgtagaacagattcttaattgggaattaagaatgcaccactagatgtagcatcgcggcctcgtgtccttaagctctgtgaccttggactaagtcactgtaaaatgggagatgacagtgcctgacttcctaggatcgttgacaggattgaatggcaatataaagcccttagtacagtgcctagtggataagtgctcagtaaatgttaactacaacgagtaaataattctgtttgatggacattga

SEQ ID NO: 117675 - DNA, 241 bp, Homo sapiens
attgcaatatttattggaattgaacctatagatgaatttgggataaattgacatcatcggcatatgtatccagcctttcaatctttgaacataatgtaaccctctatttaggtcttatctgaatatttcttgaatttgtctgctttgtatctgtacttttgttgctgggtcaaattctcattgtttcttacctggactgttgaatagctttcaactccccatctttggtctatcttttcca

SEQ ID NO: 117676 - DNA, 331 bp, Homo sapiens
ggaacctggcgccttctacagagaaaaaggtcaaggctgtgaccttgtgaccttgtgggactgtgatcgccactgtactccatcataggtgacaaagcaagaccttgtttcaaaacaacaacaacaacaaaacattgaattctatactttaaatgggtgaattgtatggtatatgagttatatttcaataaagctgtttttaaaagacaataagaatactaaattttttttttcagttcaccccaaaagaggaacagagaaacagcaaacagatgagacaaatgcaaaacactaaaatggccagtccagccaaatccagccaaatcaaatg

SEQ ID NO: 117677 - DNA, 465 bp, Homo sapiens
tctatagcgtatttagtcctggaaacaacatggtgatttaatttacaaatgaccaaaaatgcctttggatttttgagaaagttcaaagctactttgaacatctacatcttgcctagagacctgggcaggaacttctgccttccacattgatcagagctaaaaagtctacactagctgcccttatggagaacctactacatactcaatattttagctacacgtccaatgtttatttcattctaacccaataatcctgcaaactgagtaccttcaattttaggtgaggaactaatagagattacacacagtaaatagcagacttaggattcaaacctaagtttgattgattgcaaagtctacgtctttccaccagtcctaagaggataaaacttcctcctacgtccacactccagtgcccaccagccttgtccctaataaaattaagttgtatcatttaaaaaaaaa

SEQ ID NO: 117678 - DNA, 346 bp, Homo sapiens
aagtcctgtgaaatataatagccaacacattttaagcagagggaaaaaagcatgttcaaaatctgctgcattctctgtagagacaaagtaataacaaaacatccatggaatttaattaacatagaaaattatttaaaaacaaaaacttttctccttaaaattgtcatttttctttctgtattatctatttttttccatgttgccttatgaacacagtgaatctaataatagagcagactggcttttatatccctttacttaaaaattcaacaaagttaaaattccacgtaaaggtaaagcttagataattcaaagttatgtcatgttctaactagtcagctctcct

SEQ ID NO: 117679 - DNA, 856 bp, Homo sapiens
gctggcaagtgctgcagtttttgtttatgactcggttgtgtcagtgggagacagaaattctaaaagatactgcaagcagatcctggtcgatttctgtgagtgctataagttctgggagaaatgatcttgggctttagatgttatcgctgtggcaattatatttcttctggtctcacagaagcaagtgtcattaagagctttaaatatttgaaattagaaccatatgagttattttgagacctctagttactgtaattaaacatacacaggtatatatgaatgaggacgttatttatgcatgagcaagggaagcttttccatggctctgattattggcaggcaggggtggtgaggaaggaaagcaagatggacacatctgacacatttaaagcccagtttagccagagtaaggattttgaggtcctttctctttgttcagattgcgagtcgatggtaggactttgggagggatgtagcaaaggggatgtaataatggcaatagctcatgctcatgaaacacataggttccaggtaaaatgctaagctctgtgcatatgatcactcactgttacactcttggcaatgttattatctctggcttaggaaagtagatgacatgcccaagattacatttgtagaactgtggtgtgaacccaagccaccctgagtccagatcccaaaagcttgaccactgttttattttctatggggggttacatgctccctcagtaagttttagatttttaaggtgccattgttgagcagaagaacctttagagctccttatttcttttgtggcttttcctgtctcagggaaggtgcaggcagaggaagttaaattccgatcactctgaag

SEQ ID NO: 117680 - DNA, 277 bp, Homo sapiens
gtgaacaaggtgccatcttggaaacaaacagcagccttcaccagacaccagaccttctggcaccttgaccttgcgctttccagcctccagaaccgtgagaaatcaatgtttattgtttataaattacccaatctgtggtatttttttaaaacagcataatgggactaagacaccatcagaacttgggaccaaaagaatacttttgccctctgagagctgattcttaacacagaataaaaatgaagaattactttaaagagatggactacctcaaggg

SEQ ID NO: 117681 - DNA, 165 bp, Homo sapiens
gtaattctgatttatgcgttattttagtttgacttatttttaacaaaatattagaaattatgctttaaaatgtttaatgtggactgaaattttcatcttttgtttgagaatctatgaagtgtatcatatacgtggcctaaagcaaggtgtgtattttgttattct

SEQ ID NO: 117682 - DNA, 342 bp, Homo sapiens
tcccaatcaacataggaaatctggtgtcactgagatgggcttccactaaggtggtgtctgaactccttaaccagactttcctaggagtcaaagctattttgaagtgtttcaggaaatagatgtggttttgatgagaaattatataattcaaagtcctgtggctaacaagtcagcaaaagttctatggaagaggagagagacagatttgcccatattttagctcagggcttaatgtataatttataaagcaggtggattattcctgaggacaaaaactattcctaaaattggtcccaagtaggcctcttttgaaattggattccctacaatcccattcacaat

SEQ ID NO: 117683 - DNA, 368 bp, Homo sapiens
atcaaaattcctatgttgaaacctaaccccaaatgtaagggtattcggaggtggggtgtttggaaggtgattgggttatgaaggcagagagctcatgaataggatcagtatccttataaattcaatcccaaagaatccctcacccttttgccttgtgaggacacagcaaaaaggcactctctatgtaccaggaagcaggccctcgccataatgaatctgggttccttgatcttgaatttcccagcctctatctatctatctatctatctatctatctatctatctatctatctacctacctatctattaatttatttgagatgagtttcactcttgttgcccacactggagggtagtggtgcgatctt

SEQ ID NO: 117684 - DNA, 815 bp, Homo sapiens
atgaagcttaaatttatcagagattaatagaggaaagtgtaaattgtttaaaaggcaaatgtaagaagttgagaactgtctttctctggagtgaacatctgcttagtagattgacatgcttgtgagaccaactaagtattagctacttcctttttagagataggatcttgttctatgtgtgccaccatgactggctaatttatattttagagatgagagtctcactatattgactgggctagtctcaaactcctgacctcaagccatccttctgcctcagccacccaagtagctgggattacaggtgcaagccactgcacccagcctagtactagtcctaggtttactgggaatttttctagtgattctgagaaacctacatctttgtgcttttattttttcagtgtgacagggacagttacttcccccaatatttatttattttttatttttttaagacaatgcttatttttcaactggatctacagctactcagaataaagactacatttcccagcctcccttgcagctagatgtggtcatgtgactaagttctggcccaagaaatacagcctttttgaaagggaagatatgctctccttcctttccttattctatcagctgggatgcagatgctgcggtgagctacatggaccatgcagatggagataacactctaagaagggtggaaggaacttggggttgtgataccacagagcagccatgttatatgagagaaaaacaaacttctattttgtttaagttatggtcactcagtctcctttactgcaatggtatttatatcctaaataata

SEQ ID NO: 117685 - DNA, 406 bp, Homo sapiens
gcctcccacgtagctgggattacaggcatgcgccaccacacccggctaatttttgtatttttactagagacagggtttcaccatgttggccaggctgtctcaaactcctgacctcaggtgatccacccacctcggcctcccaaagtgctgtgattacagtcgtgagccaccactcccagccaaatatatttgtttttcttcctttctttctttttctttctttcttttctttctttcttcctttctttctttttctttctttctttctcttttctttctttcttttctctctctctctctctttctttctttctttctttctttctttccttcttcctttcttcctttctttctttttttggatggagtctcactctgcactctgtcacccaggctggagcgcagc

SEQ ID NO: 117686 - DNA, 404 bp, Homo sapiens
acctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttcc

SEQ ID NO: 117687 - DNA, 620 bp, Homo sapiens
tgccactgtaggaaacaaaactagacagagatttataaggacatacttgagaaacaaatgaatcagaatgttatgcaaagattaatagaatataatggaaatggttagtaaattagcaagtaaattcttggaactatcaggtattagcagaatctcaaaaaggatctcagataataattacaaataatgaacagctgaagatgaacaaaagttttttttgtttcctagaaaagaatccaagtttacttagttaattgaaataaatagaagcagttaaaatggtttttctggaatatattattgttaaaatgttaacatcagcctacttaaggttatcctttggccaagttcagaaagagatagagtttaaaatctgccataaaaaccacagaaattaaaagaaaaagcaagaacgactacaataaacatacatttacttgggcttcaggacaaataacatatcaaaaagcacatgtgaacagcctaaacttgcttattaaaaagaattagaaagtaattgactggattaaaaaataaaattcaacaatcttgtttaaaaaacatacatatttatgctgggtgcagtggctcacacctgtaatcccagcactttgagaagc

SEQ ID NO: 117688 - DNA, 184 bp, Homo sapiens
gaaaatccattccttgaattgaaggtttctgtgatatttcaagaaatgggatagaatcaatgttctgatgaacaacatttaacaattttgtaagtaaaggtaaagtcgcattaaatttattcatgcatgtggttatttttgaatcagccacacacttgcaagcaaattactgatcaagccttat

SEQ ID NO: 117689 - DNA, 254 bp, Homo sapiens
gcacgagcccagttacattggaatttcagataaacaaggaaaaaaaagtttttttgacacagggtttcactcttgttgctcaggctggagtgcagtggcatgaacacagctcactgcagcctcgacctcctgggcctaaggaatcctcctgcctcagcctcccgagtagccaggaccacaggctcatgcctggctaattaggaaaaaattttagtacaagcgtatcccatgcaatgtttgggacgtacttatgc

SEQ ID NO: 117690 - DNA, 638 bp, Homo sapiens
cccttcttgggagaagaaccatgatccatagggctgctttggtagtctgggaacattaacaccctaccggtcaaaatgttccatcagtatcccgaactgagagtatttcccaagcattcaacatacaagggatggatgaaggacccatgaattcctaaataggcttaaagaacagatgagaaaatatgcaggtttagaaatggaagacccactggggcaagggatgctaaagcttcattttgttactaagacttggccaaacacctctaaaaacaactacaaaagatagagaattggaaagattgtcccagagactaacttcttagagaagcatataagtagggacaaagagcagcagaaacaaaaggcaaaaatcatgctgtctaccttacaacagagaactctgcagtaggagacacaaggaagtaaaacttacaaaccctctaggccaccagcgaccaaactgtatacaagggcttgagtttttcttattttttagattttgtacttctgagctggtaaagggggcatttacgaagctgatgcctcctcccccaaggggcacttcttcaaggggaagagagttgggggcactctttggaggtgcaaggggacaggaagtctgagtatcctttaca

SEQ ID NO: 117691 - DNA, 404 bp, Homo sapiens
gaatgtttgcctcgggagtttattgcaggcaaattatccctggaaaatactgctgggaaaggtgctgaacaaacaacatctacatttacacagttagatattcattaaaacagaaaatgcccattaaatttagagagatgctaagtgccagattcaagaacagaccagtgcagaaaagttggtgcaaatttctccccattgtgtaccagggataagtcaggttgcatagcagtaacttttcccaggtaaccctcactacaagactgtcaagtgtaccttgcaagaagtgagttttcttttttcctaaggaacataatgagaaggtcagacagtaggatttcaagcaagaacagtagcaattacatctgaacaaggagttcactcttgatattccaatgggcccg

SEQ ID NO: 117692 - DNA, 181 bp, Homo sapiens
tctggtaaccccctcctgtccacggtttctctggtggcccgttctgtccacggtttctctggtaaccccccccgtccacggtttctctggtagccaaccgtggactagtactagtccacggttggctagtagtctacgctggaatggaattgactagtccacggttggctactggactagt

SEQ ID NO: 117693 - DNA, 673 bp, Homo sapiens
gaccctgtctcccattctgagaatctgggttagaactgcaacatacaaatttcttttgggggatgggtacaattcagcccgtaatacccttgccctaggaaagcccttatttctacctttgcctgtcaaactcctacatgttccaggctcactctgaatcaaacacctacatgttcaaggctcactctgaatgtcacgtttccatgaacttctccttaactctgtgcatggttgcttagctgccttttatgttctgggaggcccccatgacagccaagtccccaggcgcaactgctgtgatgaaggctggatttttgcttccacctcttggggacacaaggcttgtatagcccctggggcccacgaggcttgtatggcttctggggccctgctgttcccaccacaagcagtccccttgggctaagcatcactcagggtataccatgtgtggccatctgtataattcatgagggaggactgtgtcacccaggcactgctgctcatttgcaagaattatgggctttgacagaactccctgtcatgcaggcctccttgtcatatctgtggtaattactattcctcttctaattacttatcttatccacatggcccctttcagctgcagcacaggagactcctgtcctcttctgcagaggcagctgtgtcactgcca

SEQ ID NO: 117694 - DNA, 319 bp, Homo sapiens
ggctaatagggatctttgacacatacgctttttctccctttccagctggccctgttgcttaaagtggcagaagtagatgtcatgttggcagacagttttgttcactgtcaaaactgggtttatctaatgtgtatttgaaacaaacaaaaaaaaatcaataaaatgagcagctttgggagccagggtgaaggcggttgagataggacagaactccagaggactcttaaacattattcaggaagctctgaagctccctcagtctgggattccagaaaaagattgattaggcaatagtttaccttagaccatgaggagatgg

SEQ ID NO: 117695 - DNA, 393 bp, Homo sapiens
cagttttgttccatattcctatatttcctatactgatgagtgtcaattgcattataatgtacattcatcagaccttcaacaatggccatgtaaaatcttttgccatctgcagacaatcatttttctctgattctttcctgaaatattttgtgagcaactataatacaaatgtgctttgtctttaaggaaattcttggaaaagactaacaattacatgtttctgataactttaaaaccatcccgttgaactaggtaagaatttcctgaactctcatggaaaagcaggattcataaaattgctaacccaagattaagcacaacagaaattaattatatgagactgaaataaccgatgaggatgattgtaatttttgtcgcttttttgtttcaaac

SEQ ID NO: 117696 - DNA, 403 bp, Homo sapiens
caatatctgtacaagagaaaagtttttactgatgtcagcacttcttccctcacaaatctctctcatttttcttctcctttcttttccctctggtttaccttcctcttacggtattctacctttcctttaaaaaaactttttatttatttatttacttaattgataaacaaaaatcatatgtactagacttttgaaaatggctgagagtagattttaagtgttctcaacacaaaaaacgactagtatgtgaggtaatgcatatgttaagtagcttaactgagccatcccacaatgtgaacatatttctactttccctttctatcatgctttctggtacataactacttcaggactacctctgagacacatggtggctttgtccttaagacatgtcttattgctc

SEQ ID NO: 117697 - DNA, 327 bp, Homo sapiens
ccccctggggagtgggcaggggctgtgtgaaccctgcggatccctgtcatggctgccagcgcccgtgggcccaggccaggctctgcccctgagattccatggcctcagaggggccctcctggcgcacactggcagctgagctcgtcggtcctgaggagttagcagccctgggaggtgaggatggcatttgggtgccttatagatagggccaggtggccatgcctttggcattcttgaagactcactgcgggtggcaatgacggtggtatcatttgtgcttttgtcttccagtaaggaaagcgtgcagagtttccaggtttgcaaatt

SEQ ID NO: 117698 - DNA, 547 bp, Homo sapiens
atttccatcttaccaggtcaaaccaaaccagtcagtggggctactttttatagtgctttaatctgaatttagagctgatttttaaaggagtctttaaatgttaatggtatactaactaacgaatagtgcctcattatcattcttgagtcagatacttctgttgatgggagaaacagaagaatccttccctttgggtgtgttgagctcccccaaagccatcagcatctcttttgacaaatgctagtcctttctctgtgctttggaatcaggttcctgcatcatcacccggactgtaaaaagtatcataagcctcccttgccagatgccaactcgtggggcatttcaacagagtttctttgaaatgtttacaacgtattcttcttgataagcaatgaacttaacatttagatgcaatccgtgaaaagaaaaaaaaatctgaaaaatatctcctgcatcaggtctgtgttatttatgtattgtgaatgttttcttaattttattggctgtatgctttcttacacataataaaaatattttgtgaactcaa

SEQ ID NO: 117699 - DNA, 344 bp, Homo sapiens
ctcggcctcccaaagtgctgggattacaggcgtgagccactgcgcctggcctgtttatttctttattatctctctttccctccactaggagagatgtctcccgatagcagggatctcgtctgtattggtcattgctataccaccagaggtaggcataattaggtttggtttttctataatataaaagatcaaagtacacagtgtctacagtggttgtagacaaatagacatttattcctctcatataaaagaaatgtgggggataggtggtcaaagctcatatgatagcccccatgatctaaaaacataggcttcaatctttctgctccactatcctcaacaca

SEQ ID NO: 117700 - DNA, 218 bp, Homo sapiens
atctctatgagaactacaacccccttgggcctctagcatctagtctagtgcctggtacagattaggtacagattagtgcctggtacagatattttttgaataaattaataaataggtggtcttatcctttgctatattgataatccactaattcatatctctagctcagatcagtcttctctactccaaatttctattcagttgctccagaatgaaat

SEQ ID NO: 117701 - DNA, 278 bp, Homo sapiens
atgattaatctaagtaggatataaattgctcaaaggaaatacctctattgcatgtatataattcattttaaaatattgattattttttaattttaccataatggttgcaatagaggtgtttatggaaaagagttcttagtgtttttatcctagaaatataaattgtaaaatatctaaaacaacagttgttactttttaacactcctttaaatacactttgcagctaaatccacaaagtctaccagtctaaggatccacctagccaattaaaattttta

SEQ ID NO: 117702 - DNA, 396 bp, Homo sapiens
tttataaattacacagccttgggtatttctttacagcagtgtgaaaatggactaatacagctgctgactcttcctcctatgacagatgagttcttagttcacttacattactccctttctttctcacaacacagttacattgctcttgtaaagtcctctctatgttacttttttcactacaaataatatgactaaacttcttatttttaatcctattagtgataggtaaattatcttgtctcctcgctttataatatgaagatagagtgcagttgcaatatgtgtgcacttagctcatacgtattagctaacttcatctggccagaaaagaagaaagtgggtatgaggaagaagtgagagagaaaacgggggcaggaggaagacaggccgaggggg

SEQ ID NO: 117703 - DNA, 627 bp, Homo sapiens
ttattcccattgttacgtattttgcagttttgtgtcatttttggaggaaatttcaggcatataacaaaatcctatgtggacagaagttagaatatgtaagatacaaatgatcagacaattcaatccttactttgacttctggatgttgttatgatagaatactggaacattttgaaggacagattcaaaataagaaaattaagtcctttttttttctattcttaacataattaggaatggattagaggaattagaggcaagttatcctccagataagcttaaatcccattttaacaattctcaaggaataaaaaaaattttctttattagtggaatcacttgataatttttttttaaaaaagctcagaagttttccttgccctataaaaagtaagaggagggatatctttttttcaattacccagccaaaaggggaagaagccagagctagacaggaactacaaaatcaataaggtcttttttcatgtatcttatttcttcttcctgaggaatattcttacctgtgtgtttgtgtgttgtttatttatttatttataaaaatatggagatattatcctcttcttccctcttccattcttttttcttcggtaaatctcctttctttct

SEQ ID NO: 117704 - DNA, 189 bp, Homo sapiens
caaccccaacatctacagattgaaaaaaactgaggtccaaaatgattgagtcaaggtaccccaggaagtcaaaggtggttcccacatgtgtcagacctgcccggcaaactggcttaatactcgacatgcggccgggcgcagcagctcacacctgtaatcccagcttttggaggccaaggcaggtggatc

SEQ ID NO: 117705 - DNA, 128 bp, Homo sapiens
gtgccactacactccagcctgggtaacagagtgagaccctgtctcaatcaaacagttcagagggggctcccaatcagatacaaacaagatccaaaaggtaaagttaataattttgtagacctcatgtg

SEQ ID NO: 117706 - DNA, 141 bp, Homo sapiens
cactctagagtttataatagattaagagaaagctataaatcataaaccctaagaattatcacatctagttcgatgccttacatagttttaattcaataaatatttgttctaatttgtttgtgctacatgattgctatgtta

SEQ ID NO: 117707 - DNA, 517 bp, Homo sapiens
ccatttgctgaagaccacttcctgggcttactgacttcaatgtgcagtttcattcatcctcacaacctcctaatgaggtgcagattatggtcctcctggtgtagatgagaaaacaggcctagggaggtggcacagaagggtacagccgagcttgaattcaaactgaacctgtgctctctgcatcacagtgagatgacccaggaggatatcatgttcagcctgcgggcagggtggggcagggcatgagcatggacccctctgccagctttgcctctgtggtcctcacctcccacatctgcatccagaggaagaattatgcttgcatttgctgagtgcgttatacatcatctcctttaattcccaggtcctagccaggtactgttatttgtcccgtgttacagatgtggtgacgagctcacttgctgacttttagtagtggaaccaggatttgagtctgtgtgactctctatcctgagttcttaacaaccatgcatttaaaaaaaaaatttatatatta

SEQ ID NO: 117708 - DNA, 244 bp, Homo sapiens
agttttgtactttatatgagtgggattatatagtatctagtgggattatatagtatctactcttttatgtctagcttctttcattaaacattacattgatgagagtcatccaaactgttgtatgaagcagtttattctttctcattgctgtaaagtattatattatatgactatgacatactttgttatattgatctctatttgattgttgatggacatttgggttgtttacagattgagtttt

SEQ ID NO: 117709 - DNA, 465 bp, Homo sapiens
acctaccagctggtcccttttgccttctccatcctctttcctgccactctttgcactttgtgctccggcagcaccaaagtgcttgttgcatttgcctgctccatcatgttcttgcatgcctctgtgtcctactcatgctcatctgtccattttcctcatcttgcttcctcatttggataactctgacttactctgtagaatcagatcacatggcatcttctccagactttccttgggtgccatctgcaggaaacctcctctctcgctcccagcctcctcattcctggcacaaagggcagcccctcactgtgctccttccgcactgtaaatccattactgacttacatcagtgtaatgaaatcatccatgcacacacccatgtccttcttgacactgtaagctttgtaagggccaggactcactcctctttataccctgtacttttcagagtaaatggaacattat

SEQ ID NO: 117710 - DNA, 330 bp, Homo sapiens
tggtgtttggtccccaagtgacaatctctgtcttttttgtaaggtttccctctcagcgcatttaaccgcttaaaccctttatctccttgagaatctgaaataattgaggagtggacagttactagtcagatgaaaataccagctttgtggtgagtaatagcagactagaaaaatgcagcttgccttgtaatcagagtaggccctctctcacctccccagcccgccctggggacgcatatgggcaagtcgggtctgcacagaagccatgtgagtgttgcttagagtctagcctccccatccctaccccccttcgagcacagcaacccacac

SEQ ID NO: 117711 - DNA, 644 bp, Homo sapiens
actggctgtgagaccctgggcaaattacttgacttctccttgcctcagtttccacatctatgaaatagggacgatattcgtacctaatatacttcataggatggttatgaggacttgatacatgaacaatgcttagaacagtatctggcaaatattaagttgctaagaaaaattattggctgctgctattatcataattattattattccactaatggaatgtaatagtctttctgcctctagtctctctctaattttagctctcttacatactactgacatattaacattcctagaacttcaatcaatgctaaccccttgctcggaaatcatccatagtaaaaaataaaagtctgtatgtcttatgctatcattcaaagctatgatctagtcttgaactgtcttccaatatatcttctcaaaaaacccactggatgtgagtcttggtcccttgaacctgagctgtcatctggagggctagaagagaactaggtccttattggcggtgtggcctgctgagatgttcactggaggagagatgccctatggtcccctgctggtatgctttgtttccaggctggtatccttctaagtgaatatgatactgactgtggcctgttcaggtctagttaagaagaccctcc

SEQ ID NO: 117712 - DNA, 124 bp, Homo sapiens
gaggcaatagtaattttggggtagtttggcctatgactggctataggaattttagaaactaagtattgtgtcttacagcttaaggtgtttccccaaaattgttttggctattctagtttttttg

SEQ ID NO: 117713 - DNA, 548 bp, Homo sapiens
tctgttagaattaacatgtaaatgtatgggtggattacttataaaggaagttgctaggaagaatcagaaaacataccgtatttacgtggacaaatgtctgtcacaggagcgtcagatcaggattgctgaaggagagctgagaatgaaaccaccatttattcagcactcagaatgctccaggcagtgtaatctcattccatcttcattcatgactccagacaggtattgttattcattgtttatacttgagaaagcagattcagagaagttaaagtatctaccacaaggtacgaaagtagtaagtagtaatgccagagtacaagcctaggtctgcttccaaatttcgtggtttcggatttagtgccttcattgtgtttcacctacaggttaagaagttgttggtaagcaagaaaatatttaagacgctgggagaatccaaaaaattgtctagttgtgtgtaacatagtctcaggattcttacagtgtgcaattttattcaccccctcatattcaaaataacagtatcagtttgaccttgaaaaaagacc

SEQ ID NO: 117714 - DNA, 919 bp, Homo sapiens
tcagtggaactggaaggcgggacggcgagtgcgggagaaggtctccattggccgaccgctctagctgtagcggagacccccaagtagggaaattggggcaaaacgcggagcgctccaggctcctacgggctgtgcggtgccagggctcgactgctgagcgtcgtgggctccgagagggacgcgggcggagggcaaagagcgtcagatcaggattgctgaaggagagctgagaatgaaaccaccatttattcagcactcagaatgctccaggcagtgtaatctcattccatcttcattcatgactccagacaggtatggccaccagtgctccagatttacattctatttacctcacaaccccagtggaaaaagaatatctctttcctgattggtccagcagaaatcttggtattaactctgactgcccacacttgaatatgaactattagtaagtactgtggccaagagtttgcttcgggaaagaatatgataaagtcaccttatctttcatgtttgctcagaatagtgaggtgattctccacaggaaaactggaatgctgttactagaagaagaaatactggacaaagctaatagatgtccccaaaagtgatgataataattttattcaaataggttcatagatcagtctggtgggcttgttttcacattttatttaagaaaaactcttgtaattacaagttccccagtctgtaaatacagatgagattaacaaattttgttattttttgactgcctctgctttatagcacccctcccctccaaagacttccccaccaataatttctgggacttcctagagagtgtctcatacttacaaacatacctgcctctactggtcatcccactaggcaagataccaggaccactgctctgccaggcaacagtctatccctcttc

SEQ ID NO: 117715 - DNA, 638 bp, Homo sapiens
tcagtggaactggaaggcgggacggcgagtgcgggagaaggtctccattggccgaccgctctagctgtagcggagacccccaagtagggaaattggggcaaaacgcggagcgctccaggctcctacgggctgtgcggtgccagggctcgactgctgagcgtcgtgggctccgagagggacgcgggcggagggcaaagagcgtcagatcaggattgctgaaggagagctgagaatgaaaccaccatttattcagcactcagaatgctccaggcagtgtaatctcattccatcttcattcatgactccagacaggtattgttattcattgtttatacttgagaaagcagattcagagaagttaaagtatctaccacaaggtacgaaagtagtaagtagtaatgccagagtacaagcctaggtctgcttccaaatttcgtggtttcggatttagtgccttcattgtgtttcacctacaggttaagaagttgttggtaagcaagaaaatatttaagacgctgggagaatccaaaaaattgtctagttgtgtgtaacatagtctcaggattcttacagtgtgcaattttattcaccccctcatattcaaaataacagtatcagtttgaccttgaaaaaagacc

SEQ ID NO: 117716 - DNA, 574 bp, Homo sapiens
tcagtggaactggaaggcgggacggcgagtgcgggagaaggtctccattggccgaccgctctagctgtagcggagacccccaagtagggaaattggggcaaaacgcggagcgctccaggctcctacgggctgtgcggtgccagggctcgactgctgagcgtcgtgggctccgagagggacgcgggcggagggcaaagagcgtcagatcaggattgctgaaggagagctgagaatgaaaccaccatttattcagcactcagaatgctccaggcagtgtaatctcattccatcttcattcatgactccagacagtgactctgaaaatgaagtaacatcatgagaagaggaaaccatatggaattattacacttctctttccacatgaacagcctggctattctctgcccttctgtactaaggcctatcctctggaatcatagggtggcctggaagcctcaaaaggaaattctcccttgtggtcagagggaggaactgctgtcttccatcacccttcttcacactgcaaatatgacttggaatagagtccatgcaaaaatagttttatgcttctgaa

SEQ ID NO: 117717 - DNA, 601 bp, Homo sapiens
tttgctcattagctattgttaatgttagtgtattttacatgtggcccaagacaattcttcttccaatatggaccagggaagccaaaagcagaaacacctctgctctaaagacattagtatcagaatcaccatttattttgaaaattattatctttaccttttacatatgaatatgtttactaaataaaacatataattcataaatcatttatacttttaacaagttctagcatgtattaatatatttttgcattaaaataaataaaatggctttctgagattgtaaaacagactaacatttaaggcaacataaatttgtaatgatttctacatctacagtgactctgaaaatgaagtaacatcatgagaagaggaaaccatatggaattattacacttctctttccacatgaacagcctggctattctctgcccttctgtactaaggcctatcctctggaatcatagggtggcctggaagcctcaaaaggaaattctcccttgtggtcagagggaggaactgctgtcttccatcacccttcttcacactgcaaatatgacttggaatagagtccatgcaaaaatagttttatgcttctgaa

SEQ ID NO: 117718 - DNA, 169 bp, Homo sapiens
ataaaacttacccaagtacattataaaagaatacattttaaactacttcaattgtcattcaggcaattaaaatacagaaaaaaaagaataggtcaggcacagtagtggttcacatctgtaatcccagcactttgggaggccaaggcagtggatcactggagcccaggag

SEQ ID NO: 117719 - DNA, 356 bp, Homo sapiens
gagacagtaactcaagaatttgtattctgaaaataaccaccttataaatttaaatattttaaaggcaatcatgtgtatacacacatttaaactcaattttaatgctaacttttcaaaatcaagtatttaactggaatatattttatagtcagtaaatggtagaggtattaaaaaaaccaattataaatggatttcctgttgattaatcctccccttacgtttttgattaggtgaagaattacatgggcattacattgtcctctggttcataaatgtagtgtaactagaagagactaaaagttaagaaattgcaaacagacacccaaggacaggtcagtttcagtgcccaaactgac

SEQ ID NO: 117720 - DNA, 482 bp, Homo sapiens
gataataacatagattcttgtgaaagacagcagttctacaaagattaacggtcctctgtccgttaatcttgccttgtagcaggcacatctccctgtgactttgttttgctttgttgtcttatgtctaaacaagcattgcacctaaggtagacatggtcctcctcttgcttttgggaacaccctgttctgtctgtagagtaatgtgttctttcactgtttcacttgctgaataagcttgcttgcacattattctgtggacttgccccaaattctttcttgcatgaggtccaagaaccctctgttgaggtctggatcaggacccctttctggaaacacagccccacagcgagcccttgtcaggtcgagtggacttgtggggagcctcctcaggtgcacatgaacagacccgtggttctagcactgggggtccccagcactccactgacctatctgttatgtgccatactagccgctactccaag

SEQ ID NO: 117721 - DNA, 218 bp, Homo sapiens
aggccttcccattgatgacaatagtgactccatgtgattgtcaggtggggccctagcacaggccagtgtggagatgctcagcagagatacaaccctgagggtggggatgtgccctcgacacttcaggagggacacagagacagccaagggaaaagtcaccaaaccacagcaactgctgactccagattagaggaatatgacgcctctgtgctttcatg

SEQ ID NO: 117722 - DNA, 545 bp, Homo sapiens
  misc_feature (116)..(116): n is a, c, g, or t
  misc_feature (121)..(121): n is a, c, g, or t
gaagcggcacagatacagcggtcccagctcctggccctttctctctggcagctgttcctgagggtctattccacctccacttttctttttttctgagtcggagtttcactcttgtngcccnggctggagtgcaatttgaatgtgtgaaattgccaatagtctggtacatacgtcggcccaccagcagccttcaaagggaattgagaccattttaaaaatcagtgaggtaggcagtgcgtgggcgtgtgtgttttccacggaaccaatagagagatttatgctagatgcaaaatactctttaagtcattgagtacaagaatgggtcattaggaaggtggtggactcgttttaaccatccgaggcctgctgggagttttctaatctgtttagaatcctctggtggctccatactgcctgtggaaagaaatgcattttctttggtctggcactttccattctggctccaaccgtatcttccacaccttccttttttgcacctcattctccagaaagattccagtgactcctacttccctggacatggg

SEQ ID NO: 117723 - DNA, 543 bp, Homo sapiens
tctgggaggggtgcactgggtcttctacctgccacgcacagcagctacaaaacttcacccaaaccaaaaagacttttgaaacatgcgatctgagcccccagacctacttccagcaaagggcttttagtaaaatgatgtcataagtaaaggctaaccaggtatccattaccaccaaagagaaaactggcccaaaatgtaaaagggtaagtggaggcaaagataatattatggacatacagaagaaattcctgttcctaaacgtttcatgtcatggcatttcaagaagagcctagataggtgtccatctcagatggtttgggtatagtcttgactgcagggaggaggtatactagctatcccaccctgttttagcaactgttttattacttcaaacatctttgcctcctagttcctctatcctgcccttgttggcccatgaatcaccaatttgcatagatgagtacactgaagcattgcaagtattttctcatggcctcaaaggacgtgtgctgttgacagactgcagctgaaaaggaccaatta

SEQ ID NO: 117724 - DNA, 442 bp, Homo sapiens
aatttattacttgggtcactttggccgagttatttaacctttctaagcctcagttttctcatctataaagcaggtactttaaaatagctcccttgtggaagtactgtgaggattaagtgagataataaatgtaaaaacacttcatgtagttcctggtatatagtaagtgctccataaattgatagctacctgtattggtcaggatatgctaactggtgtaacaaatagacccaagaatgtgtgatggcttagagacaatggaatcttgtttcttgcccctctaatggtctaagaaaataccaggttagcagtgaggctcaactagagaccaggtttctgacagctctgccgtttttttttttattttgagacggagttttgctctgttgcccaggctggagtgccgtggtgcaatctcggctcattgcaacctccacctccc

SEQ ID NO: 117725 - DNA, 385 bp, Homo sapiens
tcaggtaagcatgagtattcattgttttaaattgcataatcaaaatgacatttaacaaaattacttaaaaacatacatatcttgacaataaaagtaacactaactttttctctttctgctatttaacaaattttatgcacaattaagttcttcatgtgacttgtataagacaaaatttgaggcacttccatactacaaatagtacaactccattacttttcaagagcgtgttttcctgccaaaggaccacacaatgagctccatatgtgcaagtgaaaactacattttgtactgccacagtaaacagatgggatgcaaaacatctgccccttgaaaaaggcaaaattagactcaaaacaagaaacctggttcctttcattggctc

SEQ ID NO: 117726 - DNA, 466 bp, Homo sapiens
aagcacaagatgccacagagacagggatgtgggatgatggcagtgatagacagggacacaggatgaaaagggctttgggcctagtgagaccctgagcagaggagccagctggtaccatgagataataaatttgtgtgtgtgttttcgtttgtttgttttgagacagagtctcactctgtcgcccaggatggagtgcaatggtgcaatcttggcttactgcaacctctgcctcctgggttcaagcaattctcctgcctcagcctcctgagtagctggaactacaggcatgcatcaccacactgggctaatttttgtatttttagtagaaacggggtttcactatgttggccaggctggtctcgaactcctgacctcaggtgatccgccctccttggtctcccaaagtgttggggttacaagcatgagccactgcgcgccaccttgtattgctttaaattaataagct

SEQ ID NO: 117727 - DNA, 397 bp, Homo sapiens
ttcctcagattaaaagtttctcttttccccccacagttgttttcaagccatgaatacaaatcataaatatagtattattaataatctaatctgtcctgtaatttttacagtgaactatttacaaactgaattgggcaactggttcatcagacgttaagaactctatgttcttagtaccaacttcagcaagtaactgattatcagagtctactgagtattcaagaaatttgaggccatgtgcggtggctcacgcctataatcccagcattttgggaggctggagtgggtggatcacttgaggtcaggagttcaagaacagcctggccaacacggtgaaaccccatctctactaaaaatacaattagctgggtgtggtggcaggaacctgtaacaccag

SEQ ID NO: 117728 - DNA, 380 bp, Homo sapiens
aggaacactttgagcctgccaggagaggcgctgcaatgaagccgtgatcatgcacatcgcactctagcctggataacagagcatttccatacatcctctgaaatctagacagaggttcacaaagctctattcttgacttctgtgtacctgcaggcccaataccatgtgtaagctgccaaggcttggggcttgtacccattgaagaacagcctgagctgtacactgacccgttttagccatggctggagctgaagcagctgggatgcagagcaccatgtcctgaggctgcatgggttgtcggaagaggggcacaaaaccatttttccctcttagggcttcaggcctgtgatgggaggggctattgtgaagttctctgacat

SEQ ID NO: 117729 - DNA, 552 bp, Homo sapiens
  misc_feature (5)..(5): n is a, c, g, or t
gtagncactccacctcctgggtcaagcgatctcctgtctctaaatacaaatttaatcctcctgcttttaaataaatatttaccaatgattttcaaaatgtttcttgttctcacagctgatatgtggacatgctttttaattttataaataccaaatattccaaggttaactttttggttttgagtaatgcagtatattttcttacattttcaacagtattaattacttaataaattaaaactcatgaggtctgacgtttctgaacatgttttctgtatagcctatttcctctcctgggagtctcttatcccttcttggactgcctatttcaaatcccctgggtttttttttttccttggacaaaagccacattcgaacaaatccccctgggaaggttacaattaccaaaaattccaatttaacctagtttaaatgataagagaatttatgggctcacataattgagaagtctgaagatagggtgaccctcaggtggattggagtgacttaccagtatcagcaggaactggatttccttctacctctcaattt

SEQ ID NO: 117730 - DNA, 149 bp, Homo sapiens
gccagacccccaacagggagacacggcacagggaactcagaggatgatggtgttcagcggattctggcatgaggaaagtgaccaattgctacttcctcccagtgccctggaattacccagactttcccattggctgtcttcttgcaggc

SEQ ID NO: 117731 - DNA, 582 bp, Homo sapiens
cactgactctcttttcagactcagcccacctgcacccaggtgaaataaacagctttattgctcacacaaagcctgtttcgtggtctcttcacactgacgtgcatgaaatttgttgccatgacttggatcgggggacctccctttggagatcaatcccccatcctcctgctctttgctccgtgagaaagatccacctatgacctcaggtcctcagactgaccagcccaagaaacatctcaccaatttcaaatccgtacaagaaggcaggaatgtcaggcctctgagcccaagccaagccatcgcatcccctgtgacttgcacgtatacgcccagatggcctgaagtaactgaagaatcacaaaagaagtgaaaaggccctgcccggccttaactgatgacattccaccattgtgatttgttcctgccccaccttaactgagtgattaaccctgtgaatttccttcccctggctcagaagctctcccactgagcaccttgtgacccccgcccctgcccaccagagaacaaccccctttgactgtaattttcctttaccttcccaaatcctataaaagggcccca

SEQ ID NO: 117732 - DNA, 251 bp, Homo sapiens
caccacgccctgctaatttttgtatttttagtagagacagggtttcaccacattggccaggatggtctcgatctcttgacctcgtgatccacctgcctcagcctcctaaagtgctgggattacaggaatgaaccaccgcacccagctagaatttatttaaactctagggaaaccaccaaatattttttgaaagaattataatcgataggagagaaaacagaatgatataaaatgatcatttaaaatcaaag

SEQ ID NO: 117733 - DNA, 492 bp, Homo sapiens
tgctctattgcttcagtgtgctggcccaggatgcggccctccccacttgtgttcctattactgggaacacaggcagcatccccagccaaggggagctgagattcaaggtggtccagtgtttgcagggtccagctacaggatacacttggtgcatattagttcccatacttcctggctcagcctcttgtgagtcaggctaacaggagtcagtctcctgcacttgaggaattctggaggtacttgcacaacagtgctgtgggatgggacttctggtaaaaaaaaaaaaaaagcatcagggtaggtgcaggcttacaggagtcaatgaaactaggactcacaatcagtacactgtgtgtgggcatggctgtgcttgggagtttgtaatggcaacacagacacataggcaatgacggacactgccccgtgaaatacgtaagtgtgtgtgcagaaacaaccagttgctcacggatacaaggaatggggactgcccct

SEQ ID NO: 117734 - DNA, 496 bp, Homo sapiens
gccccctcccctgtgccatgtctcctcttcaagtgaaacatagttcctgtcccacctggtaccatgctgttcagtcatttcagtcagggaaccacctgggcagggtaaaaatttcctccagccacctgctgctacctcccatccccttcaggaaactctcctccagtttgagtccttgatcctgtatgatttctgctgtggagttataggaaatcacaagttgggaatgctgcccaagggtagagctcctgtatttcctatcactcacagcaaacgaacttgtttttgctctattttctttgctccccaagcaggatgagttcctcgtcataacttctttacccttcgggccatctgctgaccacacaggaatctgctagttccatctgaaaactaaccacagtcttatggggagaaaaaaagtccctaaagaccccccacatacacaccctttccccaacacgtcttcatctgcttcatttaaaatgttatggcc

SEQ ID NO: 117735 - DNA, 394 bp, Homo sapiens
cctgagaagctctttattctgacatatattcatgcattcatttattcactcaaccaacaataattaaaatagactaaaagcctaagagaagtacagtgtggtgtataatacgtaagctccagggccaagcaggcaggacttctctcaccagccacgcaacctctctaagatcccattttctccactgtaaaatgaggcttatcaaagacctacctcacaggttcatcaggaggatttcataccataatagtacaccgagttgggggaggaaccaagttggccgaataggaacagctctggtctacagctcccagcctgagcgacgcagaagacgggtgatttctgcatttccatctgaggtaccgggttcatctcactagggagtgccagacag

SEQ ID NO: 117736 - DNA, 584 bp, Homo sapiens
atcttttgtggggtacatagtgggttatttggatcccagtggggacttctgattcaagtaatatattctccagctgatctttggaagcatcccttcttggggtttctattcctctggggtcccctcaccttggcaggctctcttgcttaatattctttcagcatggtggggcttaccttgcgctcaagaatttactctcttgtgcccctccaaaccatgggaatatccttactgaacactcttttttcttccgatacgatggaaagctccagtcagtgagtatgatgcccttgtcacaagtgcttcaaatactttaggaaggaaatggtaggaaatatctccctcccctctttgtcttcctcacatgaatttatttcaaataatcccttctattaatctctggcctttttttattccccagcttgaaaggggttgtagtcactagactggttttgctgtcttttgttaatatctcataaggaagtatcagacatctctctttagaatgtgtgtttatcatccattgatctcagttttgaagccttagccaaaatgttgaagtactaggaaaagacctagttaac

SEQ ID NO: 117737 - DNA, 457 bp, Homo sapiens
cttccccttctcctctactccttttaccccaccacttccctcatcattctcagaacatgatttggctttgtattttatttgaaaatttgagaactccattccatttgcatgtgctccttccagcttttcccgaggaagagggctctcctcttttggtcagagccactttctttccttaccttgctctagattccacattcccccctgcttagcgtggctttctaagctgtctgttttctctggcttgtatcttttacctctccttctttactgcatctactctctctgcccctcccctttttgtgggcataaaattcacatcccttgtattttgtaaataaaaaaaagaaccatattctccttggcttctttctttgctttttatttctatcacagttcagctcagaaatagccactctgctttttgtttacttctcatttccccagagcctggcga

SEQ ID NO: 117738 - DNA, 394 bp, Homo sapiens
cgcaatgagcttggcaccacaagtgccaccacagaaatagctggcattattattgcctcctcagcttaccacagcctgtctcaggaactgactcacaaaatagaaaccactgctccaactctaagttacagcagcaatttgattctctcatggttgtagttctccaaaattgtagaagtcttgacacactggctgcagctcacaaaggaatttgccttattttaggagaaaaatgctgtttctgggttaacagcttagggaaagtccagaattaagttagagatcttataaactaagccatcctaaacacgccactgagagctagttctcccagggtgccacctggttccaattctcatggcatctcattttcttgggatctctggcctttttc

SEQ ID NO: 117739 - DNA, 268 bp, Homo sapiens
tggatgctgagaatcagttacgatgtacggtgcttgggaggctgactttgatttcagttacagccctgctgatccttagcacggtgactgcaaataggttactccaccttcctgagtctcagtcttcttagccgaaaagcacagatcatcatcataatagctaacattaactgtgtgcctggcatagggtctgaccgctttattcaagccagctcccagacataccttgctggactgtttaatgcccattcgacaaagaggagatcga

SEQ ID NO: 117740 - DNA, 394 bp, Homo sapiens
cccaaagtgctgggattacaggtgtgagccaccacgcccagcctatgccaataacttttacagcttagatataatggacaaattccatgaaaaacacaaaccatcaaaattccctcgagaacaaatagagaacctaaataactttacattaagaacttggtcttttcctcttggaagccccctctctctcactagagagagagctgatttcctttctttatctttctctcttttgcctgttaaacctccactcctaaattcctcatgtgtgtccgtgtccaaaattttcctggcacgagatgatgaacctcaggtatttaccccagacaacgtagctgcttcatactggggacctcgtcccagatatcaaggtacagcattcatcaaaacgcaa

SEQ ID NO: 117741 - DNA, 576 bp, Homo sapiens
tcggctctaccttgtcgagctaggatacagtaggggaagggtgctgagctgctgaaggagaagcagaactcctggcttcatggccatggttgcaacgttcattctttctgaacggaattccagagggagctgcgtacgggagtgcgaaggccggctctcctaattcgttgtggcattcacgtagggcctacttctgactcgaaggtttacaaatatatctgaaaggtttcttaaattaaaaatcaatccaacaggcaccagtccgcgtgctgcatcataatcggatgtgttgacagagtggaagtggctgcaggaatttctaccattcttcataagcctgcagtgccgctttataattttgaattgtggcccgttaagtgcctctcattagggcttggcatcccttgggttctcttgagatactgtcctgatggtgatacatgtcacaatacaggagtgggtatcgtgtgtctgctacgcttgggctgtccatgctttgaagggaagaccgctatggttggtgtgtgctgtatatgtgagtggggcacttttggtaagagaagtggtgtgtgggat

SEQ ID NO: 117742 - DNA, 1239 bp, Homo sapiens
gcattaagctgggcacagtggctcacgcctgtaatcccagcactttgggaggccaaggccggcggatcacgaggtcaggagatcgagaccatcctggctaacacggtgaaaccccatctctactaaaaatagaaaaaaatcagccgggtgtggtggcgggcgcctgtagtcctagctactcaggaggctgaggcaggagaatggtgtaaacccgtgaggctgagcttgcagtcagccaagattgtgccactacactccagcctgggtgacaaagcgagactccatctcaaaaaaaaaaaaaagaaagaaaaaagaaaatgagcacattactgtgattttacagcaattaaagtgattataagataataccacaaacataggtacaccagcaaattgaataaccaaatgaaatggcaaatctctagaaacacaaagcctaccaagactgaatcacaaacaaagaaaaaatatgggtaaaccagctgggcatggtggctcccgcctgtaatcccagcactttcggagtgcactccattgcactccagcctgggggacaagagcgagacttctcaaaaaaatagaaagtaggggtaaacctataactagtaagaacattaaattactaattaaaatcctttcaacaaagaaatacccctgactggatggttttaccagtcagttctaccagacatttaacgaaaattaatgccaatcctttgcaaactctttcaaaaacttgaagaggaggaaatactttctaactcgttctatgaggccagcattgccttgatgctagggtcagacaaagacactacaagaaaacaactgaccaatattgcttatgaacattggttaaaaaattcttaggaaaacagtgccaaactggttgggcacagtggctcatgctggtaatcccagcactttgggagattaaggcaggtggatcacttgagctcaagttcaagaccagctgggcgtggtggcccatgcctgtaaccccagcactttgggaggccaaggcgggtggatcatgaggtcaggagatcgagaccacagtgaaaccccgtctctactaaaaaatacaaaaaaattagccaggcgcagtggcgggcacctgtagtcccagctactcaggaggctgaggcaggagaatggcgtaaacccaggaggctgagcttgcagtcagccgagatcgtgccactgcactccagcctgggtgacaaagtgagactccatctc

SEQ ID NO: 117743 - DNA, 455 bp, Homo sapiens
accagagatcctcatatgtgtgccataaagccagatcaccgcatggggacttctgcttggtagggaaccacccctgcatcccctctccactgaaagctgttttcatcactcaataaaactccccacccaggccgagtgggcaggccatctcctgcagcaggtagtgtggcccactgaggcctgggcagggtgtcaccagccagaggttcctggcttacaaagtgatggagaaaaaatcctgtgtcactgggccttgatttccacacccttgttaaatgggagtgtcagatgagaggataattctttccagtcttgaatgaattccttgctcacttttttgtaatcccataggctgtattaatatgttagtgtttatcttgagctgaaattatcattaacaaatttttgagacaggataatctttggagatccatctgatctgggcctgaaataac

SEQ ID NO: 117744 - DNA, 523 bp, Homo sapiens
gatgcggttggatagcttctcctagacccctcactgggagcctcggaggccgtctgcgggggcaggagtttgagaacagactggccaacatggcgaaaacccatctctactaaaaatacaaaaattacccgggaatggtggcacaggcctgtgatcctggctactcaggaggctgaggcaggagaattgcttgaacacgggaggcagaggttgcagtgagccgagattgcaccactgcactcggacaagccaggaatctttgtgattacacacattttcttctaacctgaggatgctgaatataagttcatgtttccttggtgactcagtcatccatgactgtagatcaggtgcaaatgtggattttgcagtagatggtgtgggacagaggcctgccaacttggtcacgggtcttctacacacacctcttctgttccctcttttatgtaaccacctactgcagggaatgcaaggctgtgtgctcctctttctgctgacagcagaactcacctatcttctgcct

SEQ ID NO: 117745 - DNA, 823 bp, Homo sapiens
cgtggtggctcacaactgtaatcccagcactttgggaggctgaggcaggcagatcacgaggtcaggagatcaagaccatcctggctaacacggcgaaaccccgtctctactaaaaatacaaaaaaattagccaggcgtggtggcgggcacctgtaatcccagctattcaggaagctgaggcaggagaatggcatgaacctggcaggcagagcttgcagtgagccgagatcgcaccactgcactccagcctgggcgacagagcaagactcccgtctcaaaaaacaaacaaacaaacaaaaaacaaacttaattctagatggattaaaaacttctatgtgaaaggcaaagcttgaactctaacctattcctatttagaggaacatataggagactatcttcaagacttcaggctagagaagaatttcttaggacacaaaaagcactcaccataaaagataatggtagattctactcccaggtatataaaccctaagaaaactctgaaacataaataccaggaaaatatacaagaatgttcacaagactcctctgaaatagcctcaaactggaaactaaatatttatcagaacagataaataatgtgattatatattcacaggatggaacattatacagcactggaaaggaatgcaacaactgggacaaatcttagaaaaaatattgactgaaaaaaacaaattataaaagacaatatatgtcatctttataaacttatttaaaaaagcaaaacaaaacatgttgtacagtaaaacattaaaatgtagacgtaagccgggcgtggtggctcatgcctgtaatacca

SEQ ID NO: 117746 - DNA, 687 bp, Homo sapiens
cacatggaatatgaagtcaagaaagggagaaggctttgtatcccccatccgaaggctggtgttccccaaggccgggcgccgggcagcctgtaggagcagcgtgagccggcggcccctgcactcgatgcccctttatccccccgactacctcatcgacccccagattctgctgtgtgactacctggagaaagaggtcaagttcctgggccaccttacctgggtgacttcctcactgaacccctccagtcgggacgagctcctgcagctgctagacaccgccaggcagctgaaggagctgccgctgaagaccacggcggagcaggacagcatcctgagcctgtctgcccgctgcctgctgctcacctggcgcgacaatgaagagctcattctgcgaatccctacgcacgagatcgccgccgcctcctacctgcaggacgacgcgctgcacctgctagtgctcaagaccggtctgggtgtggacccggtgccggccggcgtggatgccagcccaggcggcgcaggacgcgaccccggcccgccaggcggggcgcccgagaagcggcgggtgggcaccgcggagcggcgccacaccatctgcagcctggactggcggatggggtggggtgggggcgccgcggaggcccgggccgggggaggcggcggcggcagcttggagcgccagcgcgc

SEQ ID NO: 117747 - DNA, 299 bp, Homo sapiens
ggttttgtttatttccatatatgagcacttaacacagtacctgtcacataataacaaatgtgaaatatttgtggcatgaatgaaagtttctgtatagttataaacatgaaataacgttttattttcttgtgctctgtcgcagaggctggagtgcactggcaaaatgttggctcactgcaacctctgcctctggggtttaagcaattctcctgcctcagcctcccaagtagctgggactacaggtgcatgccaccatgcccggcttattttttgtatttttagtagagatgggatttcac

SEQ ID NO: 117748 - DNA, 3902 bp, Homo sapiens
tcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaacaaaggtctggttaagaatggtaacctgctgttttctttaaaggagagccaaagacttgtgctttactctgttttggttttgggggaagtagtagccattttgatcatgaaaccttttagtatttgtgagttgattgtactgtgtaagtagatttatctaaagttaactgttaaagttagctagccttataaaatgtaaaagtaatgaaaattcatcagtttctctaagccagtgaatgtcgtcttttgtaatattgtgtataagcatttgtgcccaccccagcttctgctatcactgtggtcaagtcatgggtctgagtaaaagaattcttgagtatgtgactggtgagaaataactaactatagtcagtacatgtacagattgttaaaattcaagacaaaatactttcactaaaaaaaaggattcgtctcagtaaagaagtattcagttgctgtcacttacatacaaatggtggtgggtagcagtctcaccatttttctactctctttttgctcgttttaaataattgagtaaaggttttatttgtaaaatctatctgtaaaaagcacctgtaacgatttatatgtcattgaaaggaatggcccagttactttttaggagagattaataacctacctggaaattaactgcagtgtttacttagattttttccccctaataagagtctaagtgtgttaaatttttaactgatgatatggttacagtgttgcaaggtgatctcttcccctgaaaaatctgcctatccttttaagaaaaattagacctactaaactaaagcaaattttactttcatcattagcacctaaacaagcaagcagtctactactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaagaaaataaggcacaataagggggaagaacttaaacctcaacataatatcgtgtccaaaaatgtgtatttagaaaaataaaatcctgtggagtttgttatcctaatgtttattttatactagataaggtgacttgttttcttgtattgaggtcttactgtttcagatttgtttttgtttctgttctaactctaagcagacagagctcacaagtctttggcatccattttaggttgtacactcagagtcatcttataactggaaactgtcaggtggtcccccaccccagtgagtgtatgaaagagtcaagaaaaagattggaaacaaactattgggtgaataattggttgctctattattattattattattatttgcctttttttaatcaccatttatttgtgtaatctttctccattgattggctgtcattcttataatatctgaactaccccataaaataattctctgacttaaaggcatttagcttttgcttatcgtttttacatcctctattcaactaagacactgtcttgagagttattttttccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtgtttgtggtgtcttccccttgttaccccttctgccctttttctctgactatggtaatttggtctttaggctcatatcagtctccccgagacattctgcagtcattatcacctttttgggtggattttattttgttttattttgttttttttaaaaaaaataactttttaacattggtgcatatttgcttgggatagagcttgtgtaatttaccaatcgtattgattgtaagtgattgtgccctgcagaggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaacgtgtgtattttgtaaatgagtgtgtgccatcttattctaatcttgagattactttcttacacgtttttaatggagggggcttttttaggtgaaaaataaagaaatggctaatctgcatgagcaaacacatacttgga

SEQ ID NO: 117749 - DNA, 3848 bp, Homo sapiens
tcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaacaaaggtctggttaagaatggtaacctgctgttttctttaaaggagagccaaagacttgtgctttactctgttttggttttgggggaagtagtagccattttgatcatgaaaccttttagtatttgtgagttgattgtactgtgtaagtagatttatctaaagttaactgttaaagttagctagccttataaaatgtaaaagtaatgaaaattcatcagtttctctaagccagtgaatgtcgtcttttgtaatattgtgtataagcatttgtgcccaccccagcttctgctatcactgtggtcaagtcatgggtctgagtaaaagaattcttgagtatgtgactggtgagaaataactaactatagtcagtacatgtacagattgttaaaattcaagacaaaatactttcactaaaaaaaaggattcgtctcagtaaagaagtattcagttgctgtcacttacatacaaatggtggtgggtagcagtctcaccatttttctactctctttttgctcgttttaaataattgagtaaaggttttatttgtaaaatctatctgtaaaaagcacctgtaacgatttatatgtcattgaaaggaatggcccagttactttttaggagagattaataacctacctggaaattaactgcagtgtttacttagattttttccccctaataagagtctaagtgtgttaaatttttaactgatgatatggttacagtgttgcaaggtgatctcttcccctgaaaaatctgcctatccttttaagaaaagcaagcagtctactactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaagaaaataaggcacaataagggggaagaacttaaacctcaacataatatcgtgtccaaaaatgtgtatttagaaaaataaaatcctgtggagtttgttatcctaatgtttattttatactagataaggtgacttgttttcttgtattgaggtcttactgtttcagatttgtttttgtttctgttctaactctaagcagacagagctcacaagtctttggcatccattttaggttgtacactcagagtcatcttataactggaaactgtcaggtggtcccccaccccagtgagtgtatgaaagagtcaagaaaaagattggaaacaaactattgggtgaataattggttgctctattattattattattattatttgcctttttttaatcaccatttatttgtgtaatctttctccattgattggctgtcattcttataatatctgaactaccccataaaataattctctgacttaaaggcatttagcttttgcttatcgtttttacatcctctattcaactaagacactgtcttgagagttattttttccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtgtttgtggtgtcttccccttgttaccccttctgccctttttctctgactatggtaatttggtctttaggctcatatcagtctccccgagacattctgcagtcattatcacctttttgggtggattttattttgttttattttgttttttttaaaaaaaataactttttaacattggtgcatatttgcttgggatagagcttgtgtaatttaccaatcgtattgattgtaagtgattgtgccctgcagaggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaacgtgtgtattttgtaaatgagtgtgtgccatcttattctaatcttgagattactttcttacacgtttttaatggagggggcttttttaggtgaaaaataaagaaatggctaatctgcatgagcaaacacatacttgga

SEQ ID NO: 117750 - DNA, 413 bp, Homo sapiens
gagggatagcatagggagatatacctaatgctagatgacgagttagtgggtgcagcgcaccagcatggcacatgtatacatatgtaactaacctgcacaatgtgcacatgtaccctagaacttaaagtataataaaaaaaaaaaaagagagagattcagtaactcatccagagccacacagcctaagtccaataatccttgccatacactctgaacttatctattgttctaccatagagcgtcaattgattttgggtggggccaatcattccatgcttttttaagctcctagatgattccctagtacaaccagaatagagaaccattccactacaggccgaaaccaaaaagaaagcttgctaatgtcgcttggaaagaataatttccctccacatcccaccccaacacacata

SEQ ID NO: 117751 - DNA, 233 bp, Homo sapiens
tgagacccattcatggatctcaaatccaaaaatgtgaaatgctcaaaatctaaaactttttgagagctgaaatgactatcaaaggaaatactcatttaagcattctggattttagagttgggatgctcaagtaatatttgcttcaggtaaagcaaatattaacctgaaaataatccaaaatatttctggtcccaagcatttctttttttcttttctttttctttttttttttt

SEQ ID NO: 117752 - DNA, 344 bp, Homo sapiens
aatccaagcacatcttgctcaaaaacaaattcaccgccgggcacggtggctcatgcctgtaatcccagcactttggaggctgaggcgggcggatcatgaggtcaggagttcgagaccagcctggccaacatagtgaaaccctgtctctgctaaaaatacaaaaattagctgggcacggtggtgtgcacctgtagtcccagctactcgggaggctgaggcaggagaatcgcttgaacctgggaggcagacattgcagtgagccgagattgcaccactgcactccagcctgggtgacagagcaagactccatctaaaaaaaaaaaaattcactatcctcccagccc

SEQ ID NO: 117753 - DNA, 372 bp, Homo sapiens
gctagggttctggagtctgtggacacaggaggcagaggacatgtgttaagatgttttaagaaatgaatgttgatctggatatgaaaatatttttcagccgggcgcagtggctcacgtctgtaatcccagcactttgggaggcttaggcgggcggatcacaaggtcaggagatcaagaccatcatggctaacacagtgaaacctcatctctactaaaaatacaaaaagttagctgggcgtggtggcggaggcctgtaatcccagttgctcaggaggctgaggcaggagaatggcgtgaacccgggacggagcttgcatgagccaagattgcgcctctgcactctagcctgggcgacagagggagactccatct

SEQ ID NO: 117754 - DNA, 180 bp, Homo sapiens
gtcctaataactcactttctcatcctcagatctcttactaagcattcacctcacagaagggccttccctggctgcctggctcaagcagcccccagccccgcctttgtccaccactgtctccctgtctccctgagctgtgcgttctgacctgccgcctggaaggatctctgtgacacagca

SEQ ID NO: 117755 - DNA, 321 bp, Homo sapiens
attatattaagagaacccagtgacacattttccttctaaattaactttaaaattaacttttaaattaagttcaatctcatatcagtttgctttgtaagaaatagaatatatgtacatgtttgccttatttttagcatgttatattcattaaaatgttttagtttattcagcagatacatttagcatttctttcacaagaaagacagtgaaggaacaattaataacaggaccccagtaatacctggggggtttctacatctgcattttttgcaaaaatagaatagccttctaagaagctgtcagtggcatttgtgcagctgg

SEQ ID NO: 117756 - DNA, 300 bp, Homo sapiens
acgcctggccaagtatttttaaactcttggtttctagtgttattctcatcttcctattgctctgtatgcatcttttggtaactcctccctttacttgagctggcctggttctctactctttgaaccactgaagcttaactaaaaccatgccctttctaaccacagtccatgtgagttcccataattttcttgggttgttgtaaattaattcaatcatctgccatccattcatccatgtaatgcaggaaccacggtgtcacttcattcttccctccacttcactgacttccccgttttccc

SEQ ID NO: 117757 - DNA, 486 bp, Homo sapiens
atggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttacaatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggac

SEQ ID NO: 117758 - DNA, 319 bp, Homo sapiens
ataacacttgtggtaacatactcttattaattttccttttaggaaagaactagcttgtgagaactagtaatattatcgttgaagaatgcattatcaagcaaaatagagaagaaagctgcaaaatagatgggagacacaagtggatcctgccttgcggggaggatagaagaaaggaccctgtagtgacactgaattaataagctagccaaagatgtgggtattcagacacacaacagatgggcataggatctgcgtataaaaataacagagtgtgagagtaactgataaacctgctgtttctagggggatttagatatgc

SEQ ID NO: 117759 - DNA, 180 bp, Homo sapiens
gactgtgtgtgccaggtgcaatcagaggacacatatggtacatgtgtagttgtagtaaagcttgagagtcatcgtagtaactactttgcagacattctctatgaaattttaaaatgtttttgaagtagccaagctctaagttttcctaagcaagttgatttgctttgttcttagggaaga

SEQ ID NO: 117760 - DNA, 985 bp, Homo sapiens
tcaagtacaatagacagtaactaaattttccagaaaactttaaagatgcttttatctctgaaaggtttttcttttttaacccacttcagtcccactgatgttttcactagcttgcctccaggataatgcatttgatatcagtgaatgtgaatacacacttccaaatgctttgtgcaggctgatccactagctctctttagacttttgctaatcagaaattgctcaagaaggaaatttgtgagctgtttccaaattgcctactgccttagacttatgtaactatgacaggtttattgatgcagctgggagcaagtttttaatcttagaagaaaatgtttatttctaaatagaggtgcatatacttttcataaaagtatttctagaggctttttaaaatgctttgatggtttaaactaatagaaataataatctttaaatatgcttatcagtagcatccccagaattcacgtctttagtctttgtacgaattagatttcctggctaaacctgtgaaaaatctcatggtattaggaaatctgaatgttgtttctttgtattattcaggaattatatatttttaatttttaaaaagttaaatagatggagataatgttgcagtctgaaagggcagccctgagaacttataatcagtgctatggtggctgtcctgcattctttggggcagagcttcctgagttagtccccacagttactacctctccttcctcgcctttcctctcttgctgctctctccttcctatctttactaatttatcttcccatgtcaaccccttaaattctgctgctctttcatagaaatcacctcgttgtcccgcttctccaccactcatattctagattggtagatatggaccatacagatagtctaccatggctaccatcaaatatttttgttcacttcattgtgcatagttacctactagttattcattgggagtagtaatttgcaaattatttaaaagga

SEQ ID NO: 117761 - DNA, 319 bp, Homo sapiens
ctgcgtttccattaagaggagctttcggctcatctttcccacggctttgatgacgtgttacagcgaaatgtgatcttaagaattcaagagcctggaaggtggaggctgcagtgagccatgatcatgccactgctctccagcctggccaacagagtgaggcccttcttgaaaaaaagagaattaaaggactttgtctcatcccttggttcagtgttagctgtaggaaagagacggtgctgcctatatgctgtggacaagtaagtgctggaggtggcaatgcaccttttggtctcagtaagattttcatttactactggtg

SEQ ID NO: 117762 - DNA, 105 bp, Homo sapiens
tacatataaataacaacaaaacctggagagagttaaaaatattcattttataactagtagaattctagaatatggtaagcaacttcatcttgagggaaataggac

SEQ ID NO: 117763 - DNA, 164 bp, Homo sapiens
tacttagaggatcccatcacgtgcattgtgatccacgtgcattgtggatcacgtgcattgtgtcatgcaatcaatgaccaatgacagtgattgctactattgtactgtatgcctacacgtggtcatttaatgcttgaaccatccctacaaagaaggtatcaacc

SEQ ID NO: 117764 - DNA, 992 bp, Homo sapiens
ctatccagaagttgtgagggcgactcagctattctgaatccaatcctgggcaaagttctggacaagtctcaggtttctgccaatggggaagggatatgaagaagcggattgtttcccaggtgaggagaagaagagagccttaggcgatccactccaagagcttgaggtgcagccagttccgtctgtcctccagtcttccccaccccatccaactagctctacgaggcagagctttctcgtcctcatatcatatatgaaaagaatggccgggcgcggtggctcacgcctgtaatcccaacactttgggaggccgaggcgggaggatcacgaggtcaggggtttgagaccagcatggccaacatggtgaaacccgtctccactaaaaatacaaaaattagccggccgtggtgccacgcgccggtagtcccagctactcgggaggctgaggcaggagaatctcttgaacccgggaggcggaggttgcagtgagcttagactgcgccattgcataccagcctgggcgacagagcaagactccgtctcaaaagaagaaaaaagaaaaaaaaaggaaagaaaataatgaggctcagaatcgatggatcgcacagtcccacaacttcgcagccaagaccagactcgggttcacccccttcccaagtgtggttctgtaaccccgttttgctgccgccgatgcggatgcagagggcagagatggcccatccttagcagagaccaacctccaccctaggcagcagagcacgcagctgggggcttttctttctagatctcaaaagcctgctgtgatgggggatctggttctgccctttccctctctgcctctcctggcccgcctacccgggaactccccgcctggagcctctgggaggggagcggtgcaggccgcccgcgtcatctgatgctgtttcctgcaggagggagaagagcggaaaaaagtgaaactccgagactcatgcggtaccgagctgattgta

SEQ ID NO: 117765 - DNA, 538 bp, Homo sapiens
ggggaacaacaaaaatagtataaagacagtgatattattgtaaaacagtaactatataaaacccccagaaaatgagatctcttgcttggttctgttttttattcctttaaaaggcacctccaattttaaaagtagtcacttaggagaaatacttataaaatgagtagtatttccctctttactaaacttacttgaaatgtgcaaaaattcactgagatctatgagatcttttaagatactgacctgtctctctccactaagtaattgtaaactgtagaccctacactaaagaattctaggcttttacttagtttcatctttgttccctgagacctctttctgtctgcgtgtgtgtgtgtgcgtgtgtgctttttaaaaagaacagttcatttcctcttttctaatattctgtgttttatctgctgtggatttggaaatcagataaccaggtttgtttgtttattcagcaaaaatttaatgagtgactcgtatattgcagacactagtatacaaagattaaaaaagaaatgttcctatc

SEQ ID NO: 117766 - DNA, 394 bp, Homo sapiens
cagctgggaacttaggagggtagaagggaaaggatgtttttcttcccttacagtatccctcactacttcctcttccttcacttccttcttaaccagaacactcccccaaatcctacccttagttctcttctctcactacacgttccctaggctggcgcttctcagaacgtagtagttagaccaatggcatcagcaccacccgggaacttgttagagctgcaaattattgagccctaaccagactgaatcagaaactccaagggtggctgggctgcaacatgttttaacaagccctccaggagattcttacacatgcgaaagtgtggaaaaccacagccttcatgcagtcccatccgcctccaagacgtcagtccttatagacctacaactactc

SEQ ID NO: 117767 - DNA, 601 bp, Homo sapiens
gcggccgcctactactactactactgctcgaattcaagcttctaacgatgtacggggacatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaa

SEQ ID NO: 117768 - DNA, 471 bp, Homo sapiens
cctgccatttactccatggctaggtggggcttctttcgagcttggcatgactatgattcaattcttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaa

SEQ ID NO: 117769 - DNA, 680 bp, Homo sapiens
cattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaa

SEQ ID NO: 117770 - DNA, 770 bp, Homo sapiens
cattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaaggcaagcctggccctccctggccctgtctcctccctctgagctcctgtctaagattccagcccatgatccttcctctccttcctcctctagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaa

SEQ ID NO: 117771 - DNA, 713 bp, Homo sapiens
gctgaattctaccaaacatttaaaaaagaactaatgccaatccttcccaaactctttgaaaaaattgtagagaagggaataattccaaactcgtatcttggtaccaaagccagagaaggaaattaccaggaaagagaataataggttgatatctctgttgaacacagacacaatcattcttaacaaaatgcagtagtagcaaactgaattcaacaatataccaaaaggataattcacaatgaacaagttggatttatccctgggatgcaagcatggttcaatatatgcaaatcgaaaaatgtgaaatagcacattaacagaatgaaggttaaaaaccctatgatcatcttattagatgcagaaaaaacatttgacaaagccaacatccttttacaataagaactctcaacaaattaggtctagtagaagggtacctcaacacaagaaaggcaagctcacagctaacattttactcagtggtgaaaagttgaaagcttctcttctaaggtcaggaacaagacaaggatatacacagtcaccacttctatttagcatagtactggaagtccttatcagatcaattagagaagagaaagaaacagaaggcatcaaaatagggaataaagtgaaattgtcactgattgttgatgacatgatctcatgtatagaaaaccctaaagatttcactaaaagctgttagaactaatacatga

SEQ ID NO: 117772 - DNA, 294 bp, Homo sapiens
aataaacttactttctctttatggattcacctcgaattcttttttgtgtgaggtccaagaaccctttcttgggtctggatcaggacccctttccgggaacagtatctcctatgatagaaggctgttcctcaataaaaagggagaaactactgattctcacagcatcatggatgaatctcaaaggcattatgttgagcagaagccgaagaatacatgctcagttatgtgaaactctagaaggaacaaacctaatctggaaagaagcagatcactggtggcctgaggcttcagttg

SEQ ID NO: 117773 - DNA, 874 bp, Homo sapiens
atcacaggcctttcttcctccacccttcctgcctatgcgtatggctggatgaacacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagaggctaaaactccagttctggttgagacacagacagtggacaatgccaatgagaaatcagaaaaaagtgtgtcagtggaatatggtcatcgtcagcatggattggaagtccttggagtctgaagacttgaggaatttgtgagacacaaaaacacaggccagatctttaccaaaaaagggagccagttttcctcacagggactcttcacaccaagatttcaatgtggaacccagctggttggaagtgatttcatattgttcctggaaaaggctgtgggtctggaagatgtactatcaacagtgggcctggatcattcaccacagcacttggcagaggtgtgggtggatataccacatgcaaagcaaaactgcagcctgaccacccagtttatatagaatccctgcctccacctctaagctgccagccatttctgttccagcagccttgccagtcttggcctcaaccagcactaaatgatcaaagttatgagcacagcatacaaccgtgtatcatacccaagcaaaatcttcatggttgctttgttctgctgtgtgttctttagttttaggaagcataggtacttagagaaataaaactacccacacttcacccccagtgtctgccaagaaggggtactggctcactcttaacaatcaacccttcct

SEQ ID NO: 117774 - DNA, 766 bp, Homo sapiens
  misc_feature (507)..(507): n is a, c, g, or t
  misc_feature (586)..(586): n is a, c, g, or t
  misc_feature (626)..(626): n is a, c, g, or t
  misc_feature (633)..(633): n is a, c, g, or t
  misc_feature (638)..(638): n is a, c, g, or t
atcacaggcctttcttcctccacccttcctgcctatgcgtatggctggatgaacacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagaggctaaaactccagttctggttgagacacagacagtggacaatgccaatgagaaatcagaaaaacccccagaaaaccaaaagaagctctctgacaaagatacggtagccaccaagatcaaggcctggtggcggggcaccctggtgcgtcgggcactgttgcacgcagccctcagtgcctgcatcattcagtgctggtggcggctgatactgtccaagattctgaagaagaggcggcaggcagcgctagaggccttctcccggaaggagtgggcagcagtcacactgcagtcccaggnccgcatgtggcgcatccgcagacgctattgccaggtgctcaatgctgttcgcatcatccaggcttactggaggtgccgntcctgtgcttcccgggggttcatcaagggccagtacagantcacagncaacnagctgcatctccagctggagatcttgctggactcagggccttgcattgtgacagagtgtattcccttctcaataaaggaatgaagttggtccttttccaaaaaataaaaataaaactcttccagggct

SEQ ID NO: 117775 - DNA, 254 bp, Homo sapiens
ggtgtggaggccccaggttcttttgctttgtatgattaggacagggtgatattttctgggttatctcttgtgggaactgagccctccaaagccctcatttgtgcattgttgtcatagctgcccaagtgtgtggccttgctgagtttgacggctgtggaccaggtgatctctcgggtggtgaaagggaggtgctctgtgagtgcacctcagctttagcctcttggcttctccctggattgggatttccagggagg

SEQ ID NO: 117776 - DNA, 339 bp, Homo sapiens
gggaatgcttctaaaacttcaccagtcttacatgtctcctcctgtaatttttaacagtggaatttaaaaattcaactcaacttcaataaatactccaaaagaagatgatcccccaaacaggagtctttcctggccagaagtaagacccaccagcccttctgcagccatcatgctccagaatcaaagatacacatgaagtggagatcgatgcctcaagtgaagatgctccaaggaatcagagccttttattgttgctcctacctggactgaaatgaatctgagcataaaatgagaggaagctggcaggtatttacagtcatagcagcatttctcatgatg

SEQ ID NO: 117777 - DNA, 239 bp, Homo sapiens
ccaaagcccccagaccctgtggctgctgagcacttgaaccatggacagtccaggtgaggatgtgcggggagagatgcctcctgcctgtggctgagccctgcctgaaggagctgatgaggaaaagctcctaagcacaacagtgctgctcacctgggcatctagttggcagagtcctatcccagtgttcgcacccccagtttcctgggtcttaagttcagattatcaagtgctcctcctgc

SEQ ID NO: 117778 - DNA, 333 bp, Homo sapiens
gagtaatgctaaccttctcaatttttgtcaaccataagacaaacaatcctcctcttcctctacaatttcttgacaattatagcaccaattttgagccattcaaaaaccaggtctgtaagacactggataaaatgtatgaagtcaacaagaacaaccatactagatttcaggggtaatcacaaatcctcatcctaactgctaagtttgttagcttgaaacttgagggcaccaatacctcccagaattgttgggagactttaaaagcagagtttctcagccaggcgtggtggctcacacctgtaatcccagcactttgggaggctgaggcgggcg

SEQ ID NO: 117779 - DNA, 109 bp, Homo sapiens
tagccaccagggggatgggcagggcaagtatcgttatccccattggatggatggagaaactgaggctcagagaaaggatgtgacttgcccaaggtcatggcatgagaga

SEQ ID NO: 117780 - DNA, 353 bp, Homo sapiens
aggcctctctaggccgggcgccggttcagcgaggaccggaagcgcccgccgtccgcccttccgcctccaggccgcgggcgccaggccgggggcgggctggggacgccctgggagtgccccgggggccgccttcttccccgcaagcccggagcgggcgtcgctcccgcccccgcctcgtcttcagttcccccgtcgcttccgccgccgtgggtagaacagacccgagctgggagccaggcctgcggcccctcgaacactagccacatctggcccgccgggcctagcacggagagaggccctggggcttggcggccggggccgggagaggtcgcgcggccaaggacacccgaggg

SEQ ID NO: 117781 - DNA, 314 bp, Homo sapiens
cctagctgtgcctccacctgatggtcctttcctgccccacctggtaactaaagacaaagggcatataatcttgggagttctggggccctgcccactgctgtttcctctctatactaccacagctgatgctctctggacagcactacctaccggcaggaggccaaccagcacaaaaatagagcattaaactaccaaagctaagaactctcatggagtccattacaccccgctatcacctccactggaacaggtgatggtgtccatggctgagacccatagatggctcatgtcacaggagtctgtacagacaaccc

SEQ ID NO: 117782 - DNA, 637 bp, Homo sapiens
agaactcaaaactataagaatccttgaagaaaacctaggaaacaatattctggacaccagccttgggaaataatttatgactaaattctcaaaaattagttgcaacaaaaaaattgacaagtggaaataactaaactaacaaatcttctgcacagcaaaagtaactatcaacagattaaacagacaacctgcagaatgggagaaaatattcacaaactaagcgtttgaaaaacgtctgatattcagaatctataacaaacttaaacaaatcagcaagcaaagaacaaccccactaaaaaatgggcaaaagacatgaaaagacaattctcaaaagaagaaatagaagtggccagtggacattgaaaaatgctcaacattactaatcatcagagaaatgcaaatcaaaaccacaatgagataccatctcagaccatcagaatggctattattaaaaagtcaaaatacagccgatgctggggaggctgtagagataagggaatgcttatacattgttggtgagaatgtaaattagttcagccactgtggaaagcagtttggcaatttctcaaagaacttaaaacagaactaccatttggtccagcaatctaattactgaatatacatccaaaagaaatta

SEQ ID NO: 117783 - DNA, 261 bp, Homo sapiens
tcttttgagaaacatttttcatgtcctttgtcgagttcaataaaatgtatttaatgccaccatacataagtgtttttcaaatgcccttattgatggtcatttaatcatacatcttctgtccatagttagtaccttaaaaatagcttttctaatttttaaaataatcttattttagtaactaatgactcatgtctttcctttccttaaaagaaattcgccaatcgtgtaagtcttttcatgtgagatactgttcagtctgag

SEQ ID NO: 117784 - DNA, 806 bp, Homo sapiens
ctcccagggaccaaagggagaagggagagccgagaaagtggccctgccatcccctactggaataaccgccgccgccgccccatcactggtggccacatcccttctaatttgtagtggtgggtttctttccttgaagagcagggtacttttaaacagatagaggtaatgggaggattaatattcataggtaagtccaaacggaaaatgtttagcttccttacaccaaaggtctgctgtgtctgagattacactaagttcaagcaacatcatgtcagtgaagaagccattagctgcaggaacacactgagaagtgagggagcctgtctaccagaaggaaatggagctaggatctttgcaaactgctgagtagagaggagaggacgagtaaatgagacagacggaaaagagctggaagagagagactcctttatggcacatttttatcctgagatttccaagcattttatatatattgcatggtaaagaggaattgaaatagccaaaagaaatgaactaaaatgaaaagggaggggccaggtgcagtggcgcatgcctgtaatcccagcactttgggaggctgactgggtgtatcacttgaggtcaggagttcaagactagcctggccaacatggtgaaaccccgtctctactgaaaatacaaaaattagccgggcgtggtacctgtaatcccagctactcaggaggctgaagcaggagaatcgcttgaatccctaaggtggaggtttcagtgagctgagatcacgccacttcattccagcctggtgacagagtaagcctctgtctcaa

SEQ ID NO: 117785 - DNA, 281 bp, Homo sapiens
aacgccatttacaactatctcaacaacaaaacaaccacaaaccttcaaaaaaccgaaacccaatcaagcactgaatcaggataggaccaaatgatttgagatgtagtggaggatagtgctggaagagagataataggacagtaggagaccaaagaataaaaataaattccaaccaggaataggatgactttattaggagtggacaaaataattctgcttagagagagagaaaatctagtggatcaaacaagatttaaacttcaagatagttgtaaatggcg

SEQ ID NO: 117786 - DNA, 352 bp, Homo sapiens
gcacgaggaaggttaaaaaacactatctattcaaatccttagtcatgaggttgaattcattgaatcagagtgtgaatatatatctatatttgagacagaatgtgtatgtatgtgtgtgagtgtgagtgtgtgtgtacagtcattagacatttgcctcatggacagtggaggaaaacatttgctgagctgctttcctaccttaaagatttacaactgcactgttttcaagatatactttttatatctcaaataatgtaatatattatgtttagttgttgatataacaagatatctgaataccccataattgaaattatacctggaaataaatacttgaaatacttgcttcagt

SEQ ID NO: 117787 - DNA, 914 bp, Homo sapiens
agcggggttggcgcgggcccggggctggccagcagcctgctccgcgcggatccggggaatgcgtgagaggagagcagctctgagccctgcttccaaggggcgcgcccggttattcccctcgctccctcagtccgaccccgggcgctcccccgcggagattggtgtgtgagcagaacagcttgagaatgtgttctaggacctggttacctttccttcatcatctctcaacccatgtgtatattgggaaaatcagagaccggtcaagtcatgcctccaagaagggcttgaccagggtgggctttgtggtcccaccaagaagcttggacttcatcctgttgggggatggaccaaaggaggggtgtgagcagagaggcatccacaaggatggctcatcctccacccacttcaatcaccagtgttgtacagccattggggattacacgtgcagctttgtagcttgtgagaggtttgacgcatgcacctctgagatatgcttcagtgatagcagtcttagctcctccattgcacacatgaggagggtaagtggccagcctataaggcagagaggacacttgccctaagagaggcacaggtagaaagacagaaacaaacgtgtatcaagctccctgctctgtgctaggccctggcttgtgtgagcttgcccagtcctcacagcacaccacacaaggggtgatcacccccaccgctttgcacatggggtgcaggaacgtaaagtgacttgtcctggatcacacaaggagtaagtagtaaagctgagattcacaccaagtcttccagagcctcaaacctgtacgcttttcctgcctcccaaggctgggagagggagcacctgtaacagcagaactactggacgaaagcaaattcccatccatcgcctccacagccctgggagg

SEQ ID NO: 117788 - DNA, 298 bp, Homo sapiens
caggcttccacactactcacacaggggacaaaggccttcacagtaggtttagcttcaaaggcccagaggatctgcctctgaccagctacatgacctcaagctaagccttttaacctgcctcagcctcagtttcctgatctgataaatagggctaatgcccaccctcgtctctctcaagggagtgttgcaggcttgaaggagaaagtgtttgttcctgggaaacaattccccagtttactgaaagttttaagaaagaaaatagccgggcgcggtggctcatgcctgtaatcccagcact

SEQ ID NO: 117789 - DNA, 242 bp, Homo sapiens
acctttgtatagtactatttttaatggctatttaactatagtaagttggctcaagccttaggacaagtgttatacattaagctcactgttattatcggaagcttctacctctggggaagaaaatctattcccatgttccattagaaaataaaaaccattcatgaccctattcacctactcttgctaaatttaagtatgcaaaatttttagattcttattaactaaagccacattatgtaaaa

SEQ ID NO: 117790 - DNA, 839 bp, Homo sapiens
ggacttgcttgggaggagaactctacataggagctgggggcaggtggacctagatccaaccttcaacccctagtgaggggccaggcagaggacaaggcaacaactaagctaggtaaagttctggaaagtttccaagcccaggaggaacaaggaccactctggaaaaacattccaaagcccattgcatacctgtggtagagactaggggagtgattccagggataagacggacaaatgtgttccaggccccagctgatggtgggtgtggtcttcataatgagaggtggagctgagatttgggcctgggctgggaagaggagtacacagtccatctgatccacctctcttatggttccattggcaaaatcattcatcagtcgtcctatcttttcctggcgagcgctcacaatggcttcataagtgtttcaatacagtgtcccaggcagtcactacctatagattagagctgatgtgctggcctggggctctagagctgggcttcaggaagaatgtggtcagggccatcaggatggaacaaggtagctcaagaccttggaaagacaccctgagggcacaatcgtccttgcagtttaagatgacactttaaaaataaattctttcctaatgatggcttgagtcctgccactcaatgggagcatcagcggaacctgtagcatcttatttggaattgacattctctattgtaattttgttcctgtttatttttaagttttctttttgtttcactggaaaggaaagatgatgctctgttttaaacattaaaagtatacaagttgctttgttacaataaaactaaatatgtacacacaccaaaaaaa

SEQ ID NO: 117791 - DNA, 884 bp, Homo sapiens
ctgcactgcaggtttcctgcccttttgctctgtaagcagtaactccaaatgtcacttcataacagttcttgtcaaccttaggcaggatgtatcaatgcatgtcagatgggggtagataactttggggcaggttatcacaacctaagagttggtggagaaaacatgggaatgaattctagagaccacaaaatgaaaacttgaaagtgttactctttctcagcttaacgtttttaaatccaaaaaacaatttttacatttcttgggattcgaagagttgaacttcaggttgccgtggttacagtgtacagtatatattatcagtctgtaccagtagaccagtaccctaactactgaaaagaatatggcagttttccatttgtctagtttctgtatgtacaatttactatccaattaattacttaagtggatttcttgttcttttttaaaaacttattgctacattgataggcagaatagcttctgaaagtgaccagttttcaatttcataggaagaggtgactcattgaaaaatagctcaagcaaagtcagctaaaaaaaaaaaaaaactagggaagctgagtaggtgtggtcaattgataatgagctaacagctgattatcactatattctagaaactggaactttcatttataaaaaaagaggtggccggaaaattcatcctgtcaataacttttaaatttacattggcatggaatttgtaggaattgtttcagggcttaaaagggaccgttttccctctcttcggggactagtctttttatttaaggatgtgttatttcatttagagcctttaatggtacaggtatacataattcaatcctttatagatcctgaaattaattgtagattttgaaattttctag

SEQ ID NO: 117792 - DNA, 403 bp, Homo sapiens
atctagtcaaagcacattttttttccttcctctttgctgtttttttcctttctctttactgtttcttttcttggtgagacagccacttcttgagataccgacatctgtgaccagtggccttcccaaaacgttcctttgtgttaagatttgtcttaatttaacatgacaggggcactcttagccattatgaaactgaggaaacagcaagctaatttttgtatctttgcttcttatacgtttttatagtgaagtaacagaggctggaactcagaaagctctcaggaatcactggtaaggaactgaagcataaggaagttttttaaaaattcaaggatatatgtcattaaaatccagctagatttgatgcaaatgttttgtcatagttacacatatcatcattaac

SEQ ID NO: 117793 - DNA, 358 bp, Homo sapiens
catcacctctgccccacccctaccggcagcattcctttcctacctgtccagcctcttctctgtccccagccacattccccactcctgcccccaaactcttggcctagaaggccctggcctgctccccaggcctcctctgctaagccttgcctacctgtccccactgtgccccccactgcctgcgcatctctggccagcacaggcgtgggaggaactatggctcttcttccttaggaagagtctctgacaagtaggactttgttttcttcccagcatgcactgcagtgcaggtgtcttaacccttggcgcacacacaggatgaaggcagagagccaactattgagggtgggaattggga

SEQ ID NO: 117794 - DNA, 1157 bp, Homo sapiens
  misc_feature (1147)..(1147): n is a, c, g, or t
gctgaaataatcctgcctctgtctcccaagtagctgggaatacaggcacgtgccaccatgcctggctaacttttaaactttttttcgagacagggtctcactatgtcacccaggctggtctggaacttctgtcctcaaacgattctcccatctcagcttcccaacatgctgaaattacaggcgtgagccactgcaccgagccccatttaaaaaaaaataagttgctgacctctgtaataatacactttaacttgattgttcttttaagtgtaaagaaagaaaaaaatacccttttgattacatttgctttagtgagagccttggttttagagaaacctatgtattggacttgtgatgttttgggactactgttgtaatggggtgaagtggaatggtagatgttccagaaacttttcagtgattatgtacacctgtagtggttttcatcttgctgcaagctcccatatacaatgtgctaatactacttgggttatcttccagttaaagctagatctttgtagttttgaaacatctgtattcaaatatataagctgcttactttcttttaaaaaaaaacaaaacaaacgcgaaaaagacaaacacaaatagcacacacaaaaaacaaaaggggggggggggcgaaaaagatttctcccggagggggccccaaatatatgccggacccccccgcttcttggaaccacaaggcgcgccccaaaaaagggagagcccgctacattatacaaccacaagccagcggcgcgccccgcgttgtttctaacaaacacacgcgtggtgcactggcgcgacaaaccattccgtctacaagacggcggcacaactctgtgggcgggagagacggaagcaccacccactataattcgcacagcgagggagggggggcagcgacaccacatttgtggtgtgggaaaacaaacactcactctccccgctagacagagagatactatgcataggacggcctctccaggggggaacaaacatacatcagcaactttcatcagacgcggcgtatcattcatggtggcgttgcatacacacaaccacaagccgaatattcttgctgctcggcgtagagagaacaactgtttgtctccaagcagagaatctatttcttcaaacaccnttttaccacg

SEQ ID NO: 117795 - DNA, 439 bp, Homo sapiens
gaacagattattctgacagaaaatcagcaacaaccacaaaattggagttaagctacacacttgaccaaatgagtctgacatttacggaacatgtcactcaattgcttcagagtacatataattctcatcagcatgtgaaacattctccaggcctatataataggatacaaaataatccttaacaaatgcaaaaaaaagtcaaaattatatcaagttttttttaaccacaagagaaaagaacttgacaacaataacaagaggaaccttggaaactacacaaacacatggaaattaaaaacatgcttctgaatattcagtggttcattaaattaaaaaatttttggaaacaaaaatagaaacacaatatacaaaaaaactgaagaatacaacacaagcaagtgataagagggaagtttatagcaataagtgcctacattta

SEQ ID NO: 117796 - DNA, 397 bp, Homo sapiens
ggggaggcctcacaatcatgttggaaaacaaggaggagcaagtcacatcctacgtggatggtggcaggcaaagagagagaatgagagccaagcaaaacgggcttccccttatcaaaccatcagatctcatgagactcattcactatcacaagaacagtgcaggaaagactcgcccccataattcaatcacctcccactgggttcctcccatgacatgtgggaattgtgggagttacaattcaagatgagatttgggtggagacacagccaaaccgtctcagtcagagagtccttcctaggttttataatccacttcaggggagaagtatggggaaaggtaagaccaatggtccagtttctgctattttcttcaatatgacaagatgccatcttttgg

SEQ ID NO: 117797 - DNA, 268 bp, Homo sapiens
ggaggtagtgcttgttccccacagagggggactttacttgcagaggctccaggccctgaggaaaggagtaccacaatacactggtacttctttctcctcggtagtcagagcgtattattcaggtacatcacttgggtgcaggggcttgggtgagagaccagcaggagaggtctcctttgtgagtccctctttccaaaagtgccgctgtacccggaggtctggaagactttacaagtgtgtgactttcagagtgcaggaacccagcaca

SEQ ID NO: 117798 - DNA, 334 bp, Homo sapiens
ggacaatataacgaggcctcatctctataaaaaaaattaaaaattagctgtgccccaggtgtgttggctcacacctgtaatcctggcactttgggaggccaaggcaggtggatcacctgaggtcaggagttcaagaccagcctgaccaacatggagaaactgcatctctactaaaaatacaaaattagacgggcgtggtggtgcatgcctgtaatcccagctactagggaatctgaggcaggagaatcacttgaacccaggaggcggaggttgcagtgagccgagatcgtgccattgcactccagcctaggcaataagggggaaactctgtttc

SEQ ID NO: 117799 - DNA, 182 bp, Homo sapiens
gccctgccagacagcctctctggtagaacgtttcctccttagagtgagcaagcattcctctccctgaccttcccaccctcctgccctgcacctgacccttccatgagacagtcccttcaagacaaccattggctttttcacatgggcaccaggatgccaaggcatagcactcagcaggtgtc

SEQ ID NO: 117800 - DNA, 554 bp, Homo sapiens
gggtaaatctgaaggacactacgctaagtgaaataagtcagacccagaaggacaaataccatttatagggggaatctataatagccaaactcacaaaagaacagtagaatggtggttaccatgagttgagggtggagaactggggaggtattagtcaaagggtataaagttacagttatacacgtgaataaatcctagagatctattgtccgacatactgcctatagttaacattatggtatacttaaaattatacaaagacactagatcttacgttgtgttcttatcacacacaaaaaaagaaagagtggggggaagcttttgaaggtcctggatatgtttatggcatacactgtagtgacgctttaaaaggtgtatacttattgccaaactcctcaatttgtatacattaaatatgcacaggtttcttttctttctttcttttttgtgtttttgagactgagtttcactcttgtcaccgaggtggagtgcaatggcgcaatttcggctcactgcaacctccgcctcccgggttcaagcaattctcctgcctc

SEQ ID NO: 117801 - DNA, 407 bp, Homo sapiens
tgtttttattggggtggttgacattacatcatcacgtagtctagaatgaatgtacaagtgattttaaaatgttttaattacgaaaattttgacagttaatttagttttgtggctagaactagagatgacttcatttccactttgcatttcaggaactgattaaaatttgtaattttcacattatctattcttaccttagaatgtgttttatttaccaggaaagggagatggaaaaacaaagaaatagaatgtcttttatttctattcactgtagaaataactatacgttggattctgaatacccactgatgtgtggggactagaagccctttctagatgatttataaatgactgaagtggaagccattttctcttacttttatcttattccctaaagactgatagac

SEQ ID NO: 117802 - DNA, 285 bp, Homo sapiens
ttcatcctgacctcccaccctagcttggttcatctttaaactggttgttttactttagggaattccatctgtctgctgaaaaatgaagacaaccagagtagatagcataactctgccagtgattcaaatactgaagctcttccatgttggtgggtgaaaagctgctcccccaagtccctcgagtgtccctgccccatctctgggccagggtctgagacctcctcacatctccatgacccagagacaaaagagttaatgcctggcaccacagggccctccaagact

SEQ ID NO: 117803 - DNA, 693 bp, Homo sapiens
ttcagttgctcccggcggagcaggggcatgcagctcagcggccaccgagcctctggggctcgcccggccgctcctcgcgctcccagacgcctgtgacgcctgttggggccaagctgctgccgttccctccgcagacagacgcgccgcgccagcctcacgagccctgcaccaacttctgcccgacaagcccaacttctgcgccgggttcggacttgcggagccggaacggcgcaccgcgcgcagcccgggcggcggccagggcggatcagcctcgccgagatgtcctcgcgactgtggctctggtgcttctgcctgggcggttgccggctggccgccaggaagcgccctacagctccggctgggcatgccaagtgtttgtgaagaacagcaagtgactgtggttggacttgcacacccatgtgtttgggcattcacacacattgtcaagctctgcaaacaaggctgtactggctcaagttggtatgtgagctatgaaagaagctatcgctgcagtgggaacttgtttcaatggaagaaaatgctcagatggtgaaggccagtagtgccagtgttcagagggatttcatggaccccactgtcaataacagtcctcttttccgtcttctcattcctgtggatctgtcctgtagcctttccacgctatcctcaggctcatctgttttctgaagatgg

SEQ ID NO: 117804 - DNA, 361 bp, Homo sapiens
gtactgtagaatagcaaatgccatctgcgtgaatttgcattgtgggatggaggaacgtgacctaagagtcaccagtggagtggaactaaaggaagaaataatttatgcacctgctgagggtgtggctagaggtaaagggactgtgacgaatgagtccttgattgccttcttggaagtattcagagatcattaaagaagcaggacgttctcagaggtcagtgtgtccaagggtgaaacaaaaacctaataagaaaaataggtccgtaagaaaagagacatctgaaaaggcctagaaattgtgaggtaagtacactttgttttgttcgtttttttttctggagttttttttttttttttttta

SEQ ID NO: 117805 - DNA, 490 bp, Homo sapiens
attagaggaccagaaatgtcttcttacagaacggttatttgacggctttgcttgtaaattaagacaccgttttagtgccagcgaactgctcggcttctgtggctctcgcgtgtgccgtggaagaactgtgaatgtctctcgaagttgtagaatggcgtgtgtgcttactcatttcgtgagatgatattctcattgaactgtcgggagtggaagggtgcgctgggacgtgaaggaagccagcacgtttatggataggctgtttctttggttcgggtgcattcacttagtaatagtattgttgtttggtgatttgtagtaaaaatagtagcgtgaactgaggcatagcagagctgggttgtgggaacccattgagctcttgacttgaatgtgctcttttcttgccccgctgtccttttactatgaaaatgattcagggccttcaacttgcctccatattttattgccagctgttacctagctatgataatcg

SEQ ID NO: 117806 - DNA, 738 bp, Homo sapiens
ccagaagtggctcaaaaaaacaagccacaacccagaactgaatcacaacagccttttcctttaacactatacttgctctatttaacctccgccatggccaattcaatagattcacagaaaatatcagcaggacgccttggttctcaacaccaagtctggaaagctgggtttacacgccccacctgagcaagcctgatcggtgattgtgttgggctcattcctcacttggccccttcaagcagagataggccctgcaagaactctctctaggaattgttttctcaatattttaaaatccacttttcctatatcctatcaatgggcacggagtgagagtgatacaggcatgtggaatttcacaaggctagatgtgccagcttcaagactactgagctttaggtatacacttgttatggtttggatttgtgtccccacctaaatctcatgtcgaatcgtaatctccaaagttggagaagggccctggtgggagatgattggatcaggggggcagatttcccctttcctgttctcatgatagtgagtgagttctcatgagatccggttgtttaaaagggtgtagcacctcccccttctctctcttccccctgctctggccatgtaagacgtgcctgcttccccttcaccttccaccatgattgtaagtttcctgaggcctccccagccatgcttcctgtatagcctacaatagagtaagccaattcaacctcttttatttat

SEQ ID NO: 117807 - DNA, 519 bp, Homo sapiens
tgaagtctaaaattaattaattttttaaattaattgagactaactttttagtgctgatatgattttaggtacatgtgaattggtgataacacattgtattctctctcctagattgcttagattgagattgataacatattagccttcttactcatttaaaattctttgtctggggtaggggaaatgggaagatactgctcaaaggttatacattttcagctgtaagttgaataagttctagcaatctagtgagcagtatggtaactgcagttaataataatgtatgatatacttgaaatttgctaagggagtagatcataagtgttctcaaccacacaaaacgtgtaactatgtgaggtgatggttatattaattagcttgattatgggtatcatcacagaaggtatacttgtatcaaaacaccatgttgcatactctaaatatatacagttttttatatgtctgttatatgtcgataagtcttgaaaaaacaaaaatattaaaaaagattctcaagtt

SEQ ID NO: 117808 - DNA, 406 bp, Homo sapiens
gactattatcaggcaggaaaagcacctggcacagtgcctgtacacaggtgtgaacagaggttagtgtctgctcccccaaggtggtgttgtgatgtgatgtcatacgtgattgtttacactctcacctgatgggcgagactattccattctcataggactcaatgagagagagtttgtcccaggattggggtgaatgtttcacctatatcatcctcttgggccttctccacctgaaatgtagcctagtttgataagcagtggtagaatacagagacaggttaggaacctggtgggggtagagggtccatactggagctctgggatctaattggagagtggaggagcgaccctgggctcaaaggtatggctgtcttcatccatttgggctgctgtaacaaataccaca

SEQ ID NO: 117809 - DNA, 108 bp, Homo sapiens
tggtgggaggcttttgtaacaatcctggagattactgcaacttggacaggttgtaggtagcgagcagtgcaggtggtgagaggggtcaggttttgggcaccttttgat

SEQ ID NO: 117810 - DNA, 314 bp, Homo sapiens
accgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccata

SEQ ID NO: 117811 - DNA, 380 bp, Homo sapiens
aggggatgcactctaatctctgagtaggtcagatatgatgaaaattctgtggtatttataaaggcttccagcaggtagaggttaaagccagaaaaagtcagacaaaagctgactaattttatgattctacaacacagacataaggcagaaagctctcgttttcaccctaaaaactagttcatttgaagctaaatctcactaaaattgaattacatgcataactcattttattgttcttttccttgagacaggggctggctctgttgcccaggctggagtgcaggggcatacaatctcggctcactgcagcctccacctccctaggctcaggtgatcttcctgcctcagcctcctgagtagttgggattacaggcacgtgc

SEQ ID NO: 117812 - DNA, 220 bp, Homo sapiens
gtgcaatgctgcataagctaagggtcagtgcattgcaggtgataagaagacatgcaaagattcaccataagggtggaagaattcaaacaaaacagcaactatagtgtgatcaatctgcaaagctttactgaaaaggaagattaccagggctttaaattatactaaggctatagttaccaaaacagcatggtactggtataaaaataggcacgtagaccaa

SEQ ID NO: 117813 - DNA, 395 bp, Homo sapiens
agcacacttcaagtgcatatttacaacactgctgaaagaaaaggcaatactattggagaatagacttaaatgacttattctagggcccacagtcacccagtggctgagtcaaaggccaaaaaactaggtctcatgattcccaaggcagtgggcaaagtagagagacaaccacagacctgagaaacagacctgggtatgaattccagtgccacttcttactagttgtgtgtgtgaacttgggacagccactttactttctgacctttggcttgctcatctataaaacagggatgctgactgggagcggtggctcacacctgtaatcccagcactttgggaggccgaggcgggcagatcacttgaggtcaggagttcgaaaccaacccggccaacat

SEQ ID NO: 117814 - DNA, 247 bp, Homo sapiens
gcctgccctgcaccctaacagcgtagccacaggacatgagccccaaggcctcctatcccctgccacagtcaggagtcccacccagtcttcctgaaaggctcccactcttccttcttctcttgcaggcggaatggccttacctcacacacccttccttccgtttcaaatcaggtaccccttctccctcctgtttttaggatggcaaagacttgagcactttttttttttttttttaagacagagtcac

SEQ ID NO: 117815 - DNA, 560 bp, Homo sapiens
agtcattatccctggcagcacctttgctgctgtgggaaatgcaactcatttattaccaccctccattttatggtggttccttggaggcactcccccaccccaagtcattttaacctttgggaagggctgaaatgctgtgcttttagtcattagttgcatttatgtaactgtagctctaaggttgtctttcccgcacaaatgccggcaaagccagtattgcaggccttgtagataaaggttgacggatttcattctttttaaaaaattactccttgagcttttaacaggttcaaggcaaggagctctcaaggtaaacaaagatgaataaggcagtccctactttttataatctcaaagtctaaaattatggaaggtgccctcttactgtaaatataactcataaaaaatcatatgggggctttagggaggatgtagctgtctcccttctggcttctgttggcattccttggctgtagccatgtcgatctctgctctgtcttcacattgctctctcctctgtgtctaatctcctgcctctctcgtagggatatacatgatta

SEQ ID NO: 117816 - DNA, 350 bp, Homo sapiens
ttggttatatttaaggtcggtgaagtctttctgtacttactagaagatacaataaaatgctagtgttcaaagggtttatagatctgtttccaagttgtttcaggttagagcagtgtatttttgttttgttgctgtaacaggggtaatattgccaacttccaaagagtaaattttagcttgagaattcaagttgtataatttgaacatcagaagtttattgtaagcacatcatattatttttaaatttatttatgaaaaacatgaacccaaaaaacccttttattgataaagttttttaaataggaaccctaaacttgtatgaagtctcatgtatgataatttattttctg

SEQ ID NO: 117817 - DNA, 576 bp, Homo sapiens
cacaggaagcactcagtgtttgttgcataaatgaaaaaaatttacatttatttaaccgaagggaatgttactactgttgatatggtatattcaaagtatggagtctctaaatgttactgtctttggtttgtagctcaggcattcctgttcctactccaagttcattgtgttcatttgctggttcacccagagtttcttgtcatgttcaaatgggaagtttctcccaatgaacctttttttccccaaggtatcctttcttccttcctttccttccctccctccttccctccttccctccctcccttccttccttccttccttccttccttccttcctccttccttccttccttccttcctttcttgacggagtcttgctctgtcgccaggccgcagtggcgtgatctcggctcactgtaaccttccactccctggttcaagtgattctcctgcctcagcctcctgagtaccaccacatccagctaatttttgtatttttagtacagatggggtttcaccatgttggccagcatggtctcgatctcccgacctcgtgatccgcctgcctcagcgtccc

SEQ ID NO: 117818 - DNA, 466 bp, Homo sapiens
ggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaat

SEQ ID NO: 117819 - DNA, 939 bp, Homo sapiens
agaaaaagggaactgagctcagaaaaaagattagggaacggagtctcctgtgagactggagtctgcaactctgcataatgcatctgtcctggtgggcaggaaagccaagagtttaaaacaaacaaaggggcttgacgggttatagcctggtctgttgatacatggttgcagagtcagcctgcatctctggtgagggagtgacatctgtgggctctttatgagtgtcatgcggagacattactgttgtgtgtgaatatggacagggatggtgggaggtcagggggtgcacagttctggactaggacttggagtatgagaacattgcacttgtctctatatatatgagctgggaggacaagtgggaggtttggtgtgtgtgtgtttgcataaggaacagaggtgtgaatcaaagtgtgggtaaggagaaagtttggcagttgacacatctgtgggtgagaggaaggcatgtgtgctcatgtgtgtgtaagaagttaggttccagttgtccctaaggagggacagtcccgcatggttaagagcatgggcctgggtgttagaccagctatgtgtccttcggcaagttatttaaccaatctgagctgttcttttcatatgaaaaatggggaagacattagtatctaccttaagggttattgtaggaagtaagtgagacattgcccaggatatagtaagtgtaaaaatcatgactggtatgattgttgttagcaggccagagtttttgcctttgggttttcagagacaaggatccacctgaggggccatgaagaccctttagactggtgggcagcatccagggcccagtcttacccatgtggatgagctgggggctggggtagagtgtagggggctgatgtgagtagagcccacaaattgcactggcactgaactaagcacacagaattagaggaggccacccag

SEQ ID NO: 117820 - DNA, 339 bp, Homo sapiens
caagggaggtagtgaaatggaagttggagctcagcgctccctcacctccactgccctcaggccttctctgcctctttcccatcagtcagctgcttctgggcatggtcctggcagagacttggcctccttccagttcaagctccctcttagattgtgtcccacgccactgagtctctgggacactgggtcagttgtctagtctggcacaattggcaggaatcccaagaaacagtgtgagtgaggggacagtcgtgttgagtgccctccatctgggactgggaggcaggtctatgtcaggcctgcatttagatctctaatagctccagacaagccccttca

SEQ ID NO: 117821 - DNA, 246 bp, Homo sapiens
tagtcaacatcagtgatatgtaagctctaggagggcagaaattgtgtcttgtttgccatttggaagtgagcttgtggatgaacaagggcatgaggaaatgagacgatctggggattggagaatggatgggctggctaacagatggatggagagatagatatgtgaatcaatggatacagacatggatggatggatgaatgggtgacagtgactctagatatgagtggatttgatggatagaaaagt

SEQ ID NO: 117822 - DNA, 816 bp, Homo sapiens
acgcctgtaatcccagcactttgggaggccgaggcgggcagatcacgaggtcaggaaatcgagaccatcttggctaacaagaaacaatcagctatgccttgggatcaagatccagaacaatcaactggaaattacagtgaagatgaacaaaatggaaagcagaaatggagagaagaaggagaagcaggcagaaagagagaacgagaaaaagaagaaaaaaacgaaaaggagctgcaagatgaacaggaaaacaaaaggaaaagggaaaatgagaaacagaaacagtatcccgagaaaagattagtcagcaaatccctcatgcatactctctgggcaaagtttaagttaaacaggtgccccactatacaagagagtctatcactgtcatttgaatttgacatgacacataaacagataagtcaatggttttgtaaaacgaggaagaaatataataaagaaatgtccaagagaaagcataagaaaaaacatatgagatggagatctctgtgttgccaaggctggtctcgaactcctgccctcaagtgatcttcctattttggcctccagaaatgctgtgattacaagcatgagccatcgcactggctaagacattttacatgacaccattctcaccaataaatggagttctgaaaggataaacaagaaaacattaacagtcgttgattccgtggagtagaactaaatgaggggtatgcaaaggagtttttatgtgttttatttttaccctactgtagatttaaagtttttataatggatgttaattgattttatttaagaaaaaaaatcgagtcaagg

SEQ ID NO: 117823 - DNA, 586 bp, Homo sapiens
gttattcaacaaacacatttgcagccaaaatctggcctacttcttggcagagcgcttatacttggtgctacgagaaaatgattgctggacctgaaaagaacctgaggtcaaggttgtgctatttccttaagtcttagttgtaggctcttggtagtttgaaaacaagattgggtttttaattcatttgtgtatccttaaatcctcactagtttttgtggatttcttttttcagttataagcaactgaatgtggatgagctataaatatttagtacaaagaatgtaatttgtccactctgaatagaaagtaagcattaagaactcttgaatgtcttcaagggttactttgttacgtgtaagatgtctccccttccttcatagcagtttttattcctgcttaaaaagggaactaaatatgaagtcagtagattttaaggtaattttcagaatgtttctactttcaccgtgccttaataaggaaaaaaggccattttccaagcgaatggaaacaccctttccttgttttgtgcctttaatcagcgtgtaccttcattgttcctgattgccaaatccacgaacttcttgag

SEQ ID NO: 117824 - DNA, 289 bp, Homo sapiens
aaaacaccttaaaaactacctatctcatcagctgtctaatgtgtacagtatgtttgacaaatgttccttcaatctgtacttaaacttttggagactgataattccctctttttttgaaatatctcaatataaagatcttacctaacatacatcttctcttgcctagtcttaacacattagttccttttctgttttttgctaagtggtttccagtttcctcaccatattcatttcagtttgaggacctactaggatccatttgtatagggtagaacttgtatatttaaga

SEQ ID NO: 117825 - DNA, 109 bp, Homo sapiens
cagggtccattccagtggggcccagtggagaggacctcagttccatacacaggaacatgtgttcctgcccagtttctaattttgctacctcttaaagttgtttcttcta

SEQ ID NO: 117826 - DNA, 378 bp, Homo sapiens
ataaagtaggtaatataagcagtattcctgttttacagatgaagccactaatatagagctttcttttttaaatcatactttaaattctgggatacatgtgcagaacgtgcaggtttgttacataggtatacacgtgccatggtggtttgctgcacccatcaacccatcatctacgttaggtatttctcctaatgctatccctcccctagccctccatcccctgacaggcccctgtgtgtgatgtaaccctccctgtgtccatgttttctcattgttcaacttccacttgtgagtaagaacatgcagtgttaagttttctgttcctgtgttagtttgctgagaatgatggtttccagcttcatccatctccatgcaaag

SEQ ID NO: 117827 - DNA, 272 bp, Homo sapiens
gtgtgtcttggaaattctccttaataactaaaggttaaaattgacaaccagctggtcttaatttctccttaccattagaacactcagcgatcatattgttggggttttttgttattgtttcagtcgttctcccatcggatttgaccaactctacccaatttggtcaaatctgaatgagaattccaaatcatggggaaaaaggcctctgaattggctaaaattccttgcagctgaaaacaaaacaaaaacatatgtttagtttctgtgtctgc

SEQ ID NO: 117828 - DNA, 315 bp, Homo sapiens
ctgaggggcaggaggtggagtgtcatggaagagtctttacttcagggacctggggggtcctaaggtctatggcccccacagtggcctgggagcaggctatgatgggggcgtgaagccacagaagccaggattcgtggtcaggcatgggctgggaacccagccagggttcaggaccttcgcaggtgctgcagcccagccaggatatggaaacgggctgggagcagcggccttcccagtggccggagcccagtcaggtcctgccgctcaaaatggctttggaccaggcttttggagggggttggaaaaccccagaag

SEQ ID NO: 117829 - DNA, 484 bp, Homo sapiens
agggactacattgaaaatggaagcacaggtgagtgtgcatgtttagggggcaggagtctccctggactcccctgcttgcctcctgccatcaaatcacgcaacaccgctggacaacattgtgtttgcactaagctggtctagggctcagcttttgattggtaggcatggcagccaagaagagaaggggtggggtgatgttgacatggttactgattcagcccaggctctgcagtccgatggccagagaaacgacaagggtgaccagtaggctggaggcaagggctccaccctcaagcctgggaccatggtccaaagtgagaacttacacccctattttcctgctcaaatgttgccttttccaaaaccacccatggcccagcccgccccccatcctgtccccataaaaaccccaggctccatcagagagaagaggagaagcagctggacgttggaggctacagttggacattggagagaagtagct

SEQ ID NO: 117830 - DNA, 414 bp, Homo sapiens
gattggtggaagactggtaattggaaaggaacaggaaaagggaggaatctgaaagggtgactttcaaattcctcagttttgaacatgggtgactgaaaagatggatatcattaacagagtcagggaatagaagaggtaagatgacaggtttagcatagtcaaaatggagctgtaaatcacagctgacttctcttcacaaattgacatatctgatcctaaaatgtatccagaaattcaacccagaatagcaaaagcaatctcgaaacagaaggacaaagttagaaaactcaaacttctcaactttaaaacttacaacaaaactacagtaatcaaagctgcatcttgctggcatgaggacagacatatagattaatggaagagttcagagtccagaaattaacccccacaattata

SEQ ID NO: 117831 - DNA, 248 bp, Homo sapiens
gtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactac

SEQ ID NO: 117832 - DNA, 206 bp, Homo sapiens
ttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggca

SEQ ID NO: 117833 - DNA, 554 bp, Homo sapiens
ccacctcagcctcccaaagtgctgggattacaagagtgggtcaccgcgccctggccaatatttacttttatatcatgttttatatttttaattttgtgttccttgttttaaggaatagagtctccctcttccccgacccctaaataacattgtataagtatccagtctctaacaccttctctatggtgtaggaaacattcagattgtgtgtggaaatgcatgtgacctaaaagtatatatgaacacttgtaggaacaaaatgacacaaagaagctacagagttagaaaatcatattaaaagggagactttttttaaaaaacgtgaaggatggaaaagggttttaactgtttgcttctattagacctttctccagagaaaaccgtcaaaagcaaagctatcaaagagattctccagtagctctcagacagaacaacagtccaaagggctcttcaagagaaaatctaatgttgggaggctccttcttatagtgagggcacagaggagggctccttcttaagagaaggtcaactactctgcaagtgcctgaatttgg

SEQ ID NO: 117834 - DNA, 289 bp, Homo sapiens
gcccaaccctggcatcgagtttgagttctggctccctcgggagcgctacagccccttccaggctcgtgtgcaggccctgggctggcccctgaggcagcctcagccccggggggtggagcctcagccccccgcagcccctgctgtcacccctgcacagaccccaacgctggccccaggtgaggtggggacagccagggtgggggatgagtggggactgaggcctgtgcccctcacagcaccgcccatcccacagacccctgcccaccctgccctgacacccgcggccgcg

SEQ ID NO: 117835 - DNA, 728 bp, Homo sapiens
tcctgccctcagcgcccaaccagtgcgacctcaactgcctggctgaggggcacgccttctaccacagcttcggccgcgtcctggacggcaccgcctgcagcccgggtgcccagggggtctgcgtggctggccgctgccttagcgccggctgtgatgggttgttgggctcgggtgccctcgaggaccgctgtggccgctgcggaggcgccaacgactcgtgccttttcgtgcagcgcgtgtttcgtgacgccggtgccttcgctgggtactggaacgtgaccctgatccccgagggcgccagacacatccgcgtggaacacaggagccgcaaccacctggcactgatggggggcgatgggcgctacgtgcttaatgggcactgggtggtcagcccaccagggacctacgaggcggccggcacgcatgtggtctacacccgagacacagggccccaggagacattgcaagcagccgggcccacctcccatgacctgctcctacaggtcctcctgcaggagcccaaccctggcatcgagtttgagttctggctccctcgggagcgctacagccccttccaggctcgtgtgcaggccctgggctggcccctgaggcagcctcagccccggggggtggagcctcagccccccgcagcccctgctgtcacccctgcacagaccccaacgctggccccagacccctgcccaccctgccctgacacccgcggccgc

SEQ ID NO: 117836 - DNA, 564 bp, Homo sapiens
acaggctcctgagaggtcgcgggcagtgctgcggggaggcgcggggccctgctctgtagggctgaaggccgcccgaggttcgccaaggctctgggctctcgaaaggaagccaagaaaagaagctgcccaggtgaccagtcctgggagtgctctctcccaaggaagctccgagcgcccaggagcccttagccggggtctagtgccctttgaacaatctccagctcttcaaggaagtgggccgccgccgcctctcttgggacctggcctgggatcctttccccaaacgcaccccggcgatttttgcgcaccgggagccgaacccctgctgcgcgcagctggctgggctcaggcgcgcttcctcaacgtttcggagccgctgcccccagcgaagtccacattccaagctccaggggctttgagagagacgaccccaaggcaaggcgtttggagagctgctgaggagccaggggcttggaggagcgagaagacatgtattttcagctgagtctcagaaggggagaatctcctgtcaccaccagaaaagcaacagccccgaaatgtgat

SEQ ID NO: 117837 - DNA, 452 bp, Homo sapiens
gtcccatagcagagtgcggatggagccaggcctccctcaagatttcccacagccctcttccagcctcaaaccttctccaggacccgaaaccctgctacactgtgtttccatagctgcaaccccccaaaagagggtccccaaatcaaaggaatacaaaggaaaacaaaatagaaaggaaaagaaaggaagaggagagatggaatcctctctgtcattagttttctgtttgtttgttttttagggtctccctctgtcacccaggctggaatgctgtggcagctcactgtagtctcaaactgctaggctcaagcgatcctcccaccccagcttccctagtggctgagactgcaggcacacaccactacacccaatgttgtcattagtttttctctcaaacatttttctaatgccttgggtgcctgtcgtttcttgtctgctaggacagctcagta

SEQ ID NO: 117838 - DNA, 471 bp, Homo sapiens
tcccgtggcctggttcctctcatcaccatctgccttgtttggaggtcacacatgtgcttgtctgaaatgcttggagggcaaggacaggcaaggtcatccttgtttcaccacttgctcctgtacagagatctgggggcatttgatcagcatcaaataagtatcatttctttgtctaccatcttcccgctctggtgctatctccagccttttctctctttacgtttctttttcttttttctttgtcttttttttttgtttgagatggagtcttgctctgtcgcccaggctggagtacagtggcgtgatcttggctcactgcaacctccaccttccgggttcaagcagttctcctgcctcagcctcccaagtagctgagattacaggtgcccaccaccactcctggctaatttttgtatttttagtagagaaagggtttcaccatattggccaggctggtctcgaactcctgac

SEQ ID NO: 117839 - DNA, 307 bp, Homo sapiens
tccacactgagctctccattgccctgcatcctttccctcacactgccctttttcttttgctagaggtgagaggaaaagtgaaacgtttcttgtatccgtgtctctttgagaagtggaaaaaccaaagatagactgaaaggctccaagtagtaggagggcattttctttgagaatgtgaagaatattcttagtctttaatatgcaaatagagtgtccctatggtaagaatacaactcaaggggggctatttatgaaatacaccctacgttagagtttgagaccccagaggtagaccgtacagaaaccg

SEQ ID NO: 117840 - DNA, 308 bp, Homo sapiens
ggatgatccccctacctctttcacgtatccatatcaaactccttattttataggcccagttgtaggagtaataacatatccatggtaacatggctggatagtggtgaaattgagcatcaaacccaggttacctagtccagtattgttttcactatgttttatctctccttaaaactgaactttatttctaaatgtgccatctggtgtcatctgtagaaatacaaagtaagtggtcctcttcctatgagaaagttactccccaaataggggaattttaaagtagaaagtcaacgtgagaaaggaaggat

SEQ ID NO: 117841 - DNA, 187 bp, Homo sapiens
taatacagataaaatagttttggatatttaacccattcctgatatacttagtgtttttcatgattactattatagacacaaactatgagaaactcatagagctgaaagggctatgggatcaattattcctgttccttagttgaggaagactctgaacctatacaccaaacagcactcatcagcctag

SEQ ID NO: 117842 - DNA, 233 bp, Homo sapiens
cccctggaaaccagcatccctccaactgagccccatggggaggcagatacactaataaagatccccaaatatcaatcaaactcatatagccaacttctggccggctgtggtggctcatgcctgtaatcccagcactttgggaggccaaggtgggcggatcacttgaggtcaggagtttgagaccagcctgaccaacgtggtgaaacctcatctctactaaaaatacaaaaatt

SEQ ID NO: 117843 - DNA, 400 bp, Homo sapiens
tgagccactatgcccggcccggttctatcttacaaacgtcacaaggagaaagctaggagaggccgagatgggagtgtggtttaaggtcagggaagacacacatgcatttaaagttgaaaggaaaataaaaatggggatgagattaaagatatttgagagttaacatctgtgggagtaagatttcttagattagaatgaggctataaaacgtcaaaagagagatttagtgagaagcaatttactaaggatgataggaaacccacatgcattgtcaagacaagtgggaatttctctgccctttgatgagataatgatgatacctcagaatcctgtctagtaattctgaagggcagtgaaaaaattgtggagggaaaaaaagaatccctgccaaacctacttg

SEQ ID NO: 117844 - DNA, 1494 bp, Homo sapiens
ggaaaggacgctctatttccctcgtgtctctacctggtaggtaaatcggccgcagaaaagaccaatgctaactccaccctgcatttgcagagatccgtcgctcacaccttttcttgtcttccgttgaaaaaagagaatcgtgggagtaggacctatttgccaatctcctggtaacactatcacaactggccacttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtgagattccggaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccactcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccagtatggacacgatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatatattttctgttg

SEQ ID NO: 117845 - DNA, 1052 bp, Homo sapiens
aagcagctggtaccgtccggaattcccggatcgggactgaagatggcgccgcgaggtgagattccggaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccactcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccagtatggacacgatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatatattttctgttg

SEQ ID NO: 117846 - DNA, 1780 bp, Homo sapiens
ggaaaggacgctctatttccctcgtgtctctacctggtaggtaaatcggccgcagaaaagaccaatgctaactccaccctgcatttgcagagatccgtcgctcacaccttttcttgtcttccgttgaaaaaagagaatcgtgggagtaggacctatttgccaatctcctggtaacactatcacaactggccacttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtgagattccggaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccactcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccaggtactgctgctgagggaccatttctcatcactagagggttgggttcccatcccagggagggattcacgtattcttctgaagcctaaggggtctagaagacttttttctagagggaggaaggggtggctatgggattgcctttcctgtttagggtaggtagatcgtttcccactcagggaagatactctccctatcctttggggccaggaggcttggaatatagaacagtcgaggccagctgctctcattcactggtcttttaacattttctttctttctgccatcgtatggacacgatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatatattttctgttg

SEQ ID NO: 117847 - DNA, 931 bp, Homo sapiens
tgccttccagtcttcctgaccacttgcactattggactttggaaggaggtgcctatagacaacgatgttgaacatactctcatcgcagtggtctgtgtccctcggtgcaggatctaccagatttgagggacgaggtcaaggagatatgatagtcccggaagttgcttgtgccccctcagcagcgtgtcgctcgatcaccagttcgcattctcggacgcctccaactcgcagaacgccgtcgaagcttcgacggtgtcctgctaccatatccaacagctaacctagtactggatgtggtgatgctcctcctttatcttggaattgaagtaattcgcctgttttttgtatggacacgatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatatattttctgttg

SEQ ID NO: 117848 - DNA, 1417 bp, Homo sapiens
ggaaaggacgctctatttccctcgtgtctctacctggtaggtaaatcggccgcagaaaagaccaatgctaactccaccctgcatttgcagagatccgtcgctcacaccttttcttgtcttccgttgaaaaaagagaatcgtgggagtaggacctatttgccaatctcctggtaacactatcacaactggccacttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtgagattccggaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccactcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccagtatggacacgatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccatgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatatattttctgttg

SEQ ID NO: 117849 - DNA, 1662 bp, Homo sapiens
ggaaaggacgctctatttccctcgtgtctctacctggtaggtaaatcggccgcagaaaagaccaatgctaactccaccctgcatttgcagagatccgtcgctcacaccttttcttgtcttccgttgaaaaaagagaatcgtgggagtaggacctatttgccaatctcctggtaacactatcacaactggccacttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtgagattccggaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccactcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccagtatggacacgatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccatgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatatattttctgttgtgaaaattgcagacctttccttatggcacctgtccctagaattcatccactccaagagagggtcatgactatcccagcagtttgttctcaggagctttgcttagtgatacagtgtggacaaaaggcagtgatgaccactgattttcttccccaagctgcagcctaaattaaaccctaaatgcactgccatcctctgtatcttcaagtctctcgtcatgcaaaagactgcttatttgcttcactct

SEQ ID NO: 117850 - DNA, 270 bp, Homo sapiens
agttcttgtgggtgctgttatatgctgtttgcaaactctggcttttgtattggcaggtgtcctgctaccatatccaacagctaacctagtactggatgtggtgatgctcctcctttatcttggaattgaagtaattcgcctgttttttggtaagtgttgtccagagaatatttccactccttatgagacaagctggtatctgtaacttgattaacaagaaaagtacataacctaggttgactatcatagactggatctgtatatcctatt

SEQ ID NO: 117851 - DNA, 1540 bp, Homo sapiens
ggaaaggacgctctatttccctcgtgtctctacctggtaggtaaatcggccgcagaaaagaccaatgctaactccaccctgcatttgcagagatccgtcgctcacaccttttcttgtcttccgttgaaaaaagagaatcgtgggagtaggacctatttgccaatctcctggtaacactatcacaactggccacttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtgagattccggaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggaaaagcagaccatttggagatgactccatgggctgtgtctgacaggtacaaagggaaacctctgccagcgaaagatgccactcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccagtatggacacgatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatatattttctgttg

SEQ ID NO: 117852 - DNA, 1739 bp, Homo sapiens
ggaaaggacgctctatttccctcgtgtctctacctggtaggtaaatcggccgcagaaaagaccaatgctaactccaccctgcatttgcagagatccgtcgctcacaccttttcttgtcttccgttgaaaaaagagaatcgtgggagtaggacctatttgccaatctcctggtaacactatcacaactggccacttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtgagattccggaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccactcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccagtatggacacgatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatatattttctgttgtgaaaattgcagacctttccttatggcacctgtccctagaattcatccactccaagagagggtcatgactatcccagcagtttgttctcaggagctttgcttagtgatacagtgtggacaaaaggcagtgatgaccactgattttcttccccaagctgcagcctaaattaaaccctaaatgcactgccatcctctgtatcttcaagtctctcgtcatgcaaaagactgcttatttgcttcactct

SEQ ID NO: 117853 - DNA, 332 bp, Homo sapiens
ggaattcaaaccacaaagaatgctgatgttgcttacaagacattttgtcccagtgcatttgtttgctttctcctggcttgatttgaccttttatctctccctcttcccccacctctttgtttgctactgtgtttatttcacccttcattaccatctttctttagatgacttattcattcttccatttattcacctgcttttgttaagtatctactctgtgctaggttatggtgatgagcaaggttaaaaaaaaaacaaaaaaccatgatcactgatcttgaaggcttctagaatattttaagagatacaacctagttaaagaaaaaataatg

SEQ ID NO: 117854 - DNA, 414 bp, Homo sapiens
tgagtgattttggattctatcctgaaatggtaagaatgaaaagaaaatctgccaagtccatccgttcctacactctcactgcctccaagtcattctgcgctcttgagccagaacgacctggccgtttttaaaaatggagttttttgccttagtaattgacttgtgtaagagttctttattccacttgtgaattgttttttatacgtacataatgtaaatattttctccccttctgtgcctttcagtatgaatctatctgaactcgattctgctgttgtgtgtgtgtcttttcctcagtaccagatggtcttgattactgtagatatatagtatatgtcttgaaatcaatagggtaaattctctaacttttgttctttttattaatgttgctgtggctaatctgtctgctacatt

SEQ ID NO: 117855 - DNA, 466 bp, Homo sapiens
agtaaaactttatttacaaaaacaggtggtgggctggatttggtatataggctctggtttgctgacccttgatatagcagtctcttcatttttttttttcttgtctatccctttacatgtaatctgacatgattgcttaaaaattgtgtgagtttccggtgtatctgttttcaaggaatccagcctattagacgaaagccatacccataagtttctttgacacaaacccttctctatcttgggtcccctgtgaggttcctatgggacagcacttttagatcttaaatccttgccccttagatcctgccttttgaacaataagagtttctgttacacatttctttaagatctggagagtgccttttgtctgtctgaaagttctggaaggcactgcctaggtctttctaaagtcttagcaaaggattcatctccccccaccccaatcaacctctatgctttcttctta

SEQ ID NO: 117856 - DNA, 721 bp, Homo sapiens
attaggcctaggaagctggactgtaatattcccataagctctaaccacaccagctttgggtgaatcatgctaaaagctggaggttaataactgagctaataaaactgggaaattggagtatgcgaccatgggctgatatctaggaggggttgcagttttgagattgactgttctaactagaatcctttgaaatttagaaggtagtctggtcgtctggctcctgaagaagacgaccagtagggaagaggtattctgcggctatgactggtatgagaacattgaagcctactgggatggggcagtatcttagagggaatgatagactccaccgatttcgaatagagatatgactggtgaatttctagggatcgccatacctccttttctctttcatttttgtttttgggctttgctggtttagttttttgccaattcatggtcctgaactttctcagttaactttggaaatgaataacgtaggaaatgtcctctcatctccctcccttattactctaaaggacagaaccaggatccacatggaggtacttctctacatggatctgaaatatgggactatcctgattgtattctaaaggatcaaggtgctagaaagtgaccactgggcaatggattacatttggggatacaaatatatagtattggggctaagagaacaggttttttagtcagtctagcaaagtctagaactcagttccaccac

SEQ ID NO: 117857 - DNA, 210 bp, Homo sapiens
ctctttgaggagagaaaggggaattcaaagattcagcttgatagatccttcatctttgacctcatgtgtattctacttaggaattaaaacgtaagaatggcctaaaagtgtggaaacttgaagtgagaggtgacatgctctccttgtaaatttaacaccaccactaagaaatgtaagctgttcacttgcttagtgtctcacttgctgcaa

SEQ ID NO: 117858 - DNA, 419 bp, Homo sapiens
caacaggactggaagtgggcctgagacactgagttctaacaagctcctaggtgaaactaatgctgctggtccacaaaacaaactttggacagtgaagtactagaggattctgatgcaggtggtcaaaaacacttacctagacttgaggatcaaagagcatctggcaaggactgtttccaacacatacagctttatctcccaacactgacttttaggatttgtttccttgctgcctcccattctcaaatatgttccagccctgttctttatgtcttggcagtgctgaactacacatactcctgcaaacatgacaggaaaacagctgcttccatgcccttcctctgagtatccagcaggttaagtcctattcatctgttaactgagccattgctggtgtttctcctatgaagccctctctg

SEQ ID NO: 117859 - DNA, 271 bp, Homo sapiens
tagagagaatgtctctcctccatctgcgaagtgctgcattttaggtttgatctgacaatttgatgcaacggctcaggtatatatgacaaggaaatggaatttctatcctcgaaatcaattctgaacaataaaagctgagaggataagtttattcaaaggtgatttggtattgcgacaggctgctccaaatcagaactcagcaacctgattttgaaaaatttccaagttcatgaaaagaatcactttgtacataagggctttctacttgttt

SEQ ID NO: 117860 - DNA, 903 bp, Homo sapiens
  misc_feature (823)..(823): n is a, c, g, or t
ctcggtgtcagccatctttcaatgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttctcccggtatgggaagttctgaacgttaaatatttttttcccatggggtcaaagggtacctaagtatatgatggcgagtggcaaaatcggggccagaaatcaggtatgggcagttttcccatttccattgtgtgtgtgaattttaatataaatgcggagacgtaaagctttaatgcaagttaacatgtttcagtgaacaagtttcagcggttcacctttatantattataataaacctgttaaattttctgggaaatgcacggatttggcatttttaaacaagtaaattctaatagtgggaca

SEQ ID NO: 117861 - DNA, 761 bp, Homo sapiens
  misc_feature (669)..(669): n is a, c, g, or t
  misc_feature (678)..(678): n is a, c, g, or t
ctcggtgtcagccatctttcaatgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttctcccggtatgggaagttctgaacgttaaatatttttttcccatggggtcaacaggtacctaggtattnatggagtgnaaacactggggacgaacccggttgggagtttccatttcttggggggcgattctatataatggaacgtaagctaagccggtacg

SEQ ID NO: 117862 - DNA, 1114 bp, Homo sapiens
  misc_feature (1034)..(1034): n is a, c, g, or t
cgcgacacagccatcttgcgtcgggggcccgggcccgggaggagagcgagccccgtcccctgatcccggaggccaacaccggcgaggggctgccctgcacgcaggcggccggcccaggagtcttagcggatcaagttgtctacggcggactcgggccggtcccgcaggacccggccgcacttggccgagcgcgcaggcgggaaggaggccgtcggtccgcccctcccgctgccgcagcggccagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttctcccggtatgggaagttctgaacgttaaatatttttttcccatggggtcaaagggtacctaagtatatgatggcgagtggcaaaatcggggccagaaatcaggtatgggcagttttcccatttccattgtgtgtgtgaattttaatataaatgcggagacgtaaagctttaatgcaagttaacatgtttcagtgaacaagtttcagcggttcacctttatantattataataaacctgttaaattttctgggaaatgcacggatttggcatttttaaacaagtaaattctaatagtgggaca

SEQ ID NO: 117863 - DNA, 299 bp, Homo sapiens
tacttcctacctctggttgtgttgtccttaacctggcaggggaagcagctgtataaatggatctggtaaatatatagtagtgatataaactagtgtaatggtggcatagaggaaagtccggaaactcttcttgctagatttgacgtggggtggggggtgggcggttagggagagacagcgcatgaattataccttaaggacaagtggagttactgcagcaaggaggaaaagagaaggaggaatgttttgggcaaccgcatgatcatcagtacagatgcagaggtacgaaagagcattgc

SEQ ID NO: 117864 - DNA, 345 bp, Homo sapiens
cacagatggtggaccagatgggaagcaacagagacatgctgggagaggggcccaggcggggcctaagacgatggcggtgggggacacagggagaagtgtttgttcccagggctgaggggtggcaaagtttctcccgctccatggccttggttgccccctctcctctcttaatcagttatgggcactgtgtgtggagtcttgggctgctttctgcctggagggaatatcccgtcaaggaatcattaggcagatataccaggtatacaagagctctgtgccagctgagcatcctggtgcggggaagtctgaaacggagaggaaagtagagcctgatgacataaatct

SEQ ID NO: 117865 - DNA, 156 bp, Homo sapiens
tgtactggatctaaggaaatgggcactttaaattttaatagatactgaaaacttcgtctcctaaaagaatctaccaatttatcatccaaatcaatagcatttctctccacctcatcagcattagacagcattattctttttttttttttttttttt

SEQ ID NO: 117866 - DNA, 445 bp, Homo sapiens
gctttttctccctctgcactccctcttgtgggtgatctcattcactctttcactgaaatgctgtctccatggcagggactccaaaaaatttatatctccagcccagaactgtcttctaagcttcagatctgcataatccaatgtcttcttggtatttccgtacggcgtttgcttcccagacatctcaaacttatccaaaaccaaattcctaatcttaacaatctgatttatgcctgttgtctcctttcttcttaaaaatgtctcagtttggccgggcccagtggctcatgcatgtaatcccagctattctggaggctgaggcacgagaatcgcttgaacccgggaggcagaggttgcagtgagccgagattgcgccactgcactccagcctgggcaacatagtgagactctgtctcaaaaaaaaaagaagactaaaaaataagta

SEQ ID NO: 117867 - DNA, 160 bp, Homo sapiens
gccaaaaataatttttttaattacctttctggtgaatgagtctggggattctcttcagtgtgttattaataaaacacagaagtagagaggcctttctgcttctcagaagtttaaacagctgtgtgtgcagtggcttgcacctgtagtgccagctattcag

SEQ ID NO: 117868 - DNA, 457 bp, Homo sapiens
acacctttaaacagccagatctcatgagaactcattcaccatcacaagaacagcaccaagaggttggtactaacccattcatgagaaaccactcttatgatccactcatctcccaccaggccccacctccaacattgagaattacagtttgacatgggatgtgggcaaggacacagatccaaaccatatccacctagcagtggaattactgagtcatatgataacatttaaccctttgaggaactgccagactgtcttccaaagtagctgcacctttttacattcccagcattggggtatgagagttctaatttcctcatattcttgccatttgctattatctgccttttttattatagccatcctaactaagtacaaagtgatatctttgtgtggttttgatttgtattacctgatggctagtgaggttgagcatcttttcatgtgcttgttggcc

SEQ ID NO: 117869 - DNA, 303 bp, Homo sapiens
tgtaaatagctagatagtaaatattttaggctttgtgggccagaaagtcgtcatcacaactacttaactctgctattgtagtatgtgaaagcagccctagagaaaatgtaaacaaatgagtatggctgaggatagagaggagaaagtgctttttttatactctcaacaaccagtcaattctgcagtggacactggctgggtgtcctctaattcaattcagttcatacactatctacctggagatgttactgatggaagatatccgagttactggcagtgaatttgtaccggtctgcaacaacc

SEQ ID NO: 117870 - DNA, 829 bp, Homo sapiens
tttggaggcgatgggtccacctgtgagtggagtacagaacgtgggggaacagcttcccaggagtctggggctcaacctctccaggaggccctgaaggtggcctgagaaagttctgcctctcgggggggcagcgtggagcacaggagccgcagtgagtcctgcctggctctaagcaccactttccaagcatgcagctttggcagtttcttggcacgctggctgaagacatgttgcccacaagctgagggaggtccttacccgtggacgccaagctccgggaggctgcagtggcggcagctgagtctgcaggtggagaggtgcagggactgttttgcctccacctccttcaatacctacttttctttccagcaacagtcccttcccttacgctcccgaatccaccctggccctgaggctgcacctgagtaccacatcctgaccccacttgtttgcaagacgtctgcatgtccacaagtgcagcgttcatctcatctcaacaagcgatccctccggagcagacgggtgatccctaccaccttctgaacactcctactcatcatctcggtaacaccctctacctgttccatacctaggccagaggttttcaccccggccacacgtcagtaccacttaggaagttaaaaaaaaaaaaactatgccaatgcaagccaatgacagaaaaaaatcaattacccgattttaaaataggcaaagaacctcaatagacatttgtagcaagaaggtctaataaggagatgaaaagtgctcaaattaaaaccacaatgaggccaggcacagcagctcacagctgtaatcccagcacttaggg

SEQ ID NO: 117871 - DNA, 191 bp, Homo sapiens
aagcaatttatgcagaattcattgccagagctcctttatggacaagaactactggctcctgtttggagcctgatccagtccatctaatggagtcacacagaagggaatggtcttcatgagttccagaatcttgctgtgccgcagtttccttatctaaaggcactactctgcagagagattttgaagatgag

SEQ ID NO: 117872 - DNA, 527 bp, Homo sapiens
cttgagcctagaaggtccaggctgcagtgaactatgactgtgccactgcattccagcctgggcaagagggagactgtctttaaaaaaaaatttaaaaaatcaaccagtgaaaaatgattatatcatgaatgagaacaggcacagaagacgtttttggaaatttgaataaagaccatatattagatgacagggaattactcagttttataagtgtgatgatactattgtgagtatgtaagataatagtgtttttcttaggagatgtgcattgaaatatttaggcatgaagagtcaagatgtttgcaacttcaaatggagaaaaagaaattatttgtgtgtgtgtatgtatgtgtgcgtgtgtgtgagagacagagatagagcagggaaaatggcaatatgctaagaattactgaacccagctgggcgcggtggctcacacctgtaatcccagcactttgggaggccgaggcaggtggatcgcttgaggccaggagttcacgaccagcctggccaacatggcgaaaccc

SEQ ID NO: 117873 - DNA, 734 bp, Homo sapiens
tacccaatctaccatattttattggactctgcaaaacatgatgattttggacatcagcattctgcaaatatcacaagcaattacccaataagtaaaaattatcatgccataataaaaattattgtgccataatatgatagtaaaacttattagggaggtgaatctagtggtgatcaaatctttgcttgtgaaactgaataaaattaaataataattccaggtaagaagtaaaagtctaaaatctcagtaagcttcatgatgatgcctatactctttaagacagaatactataatctcaccatgtgccccaaatacaagaaaactgaaatggttttgaagaaatattcatgctttcatatagtcactgaagtgaggatcaaagcctttttggaggaaatagcatttaaactgagggaaatcaagtagctcttgggcaaataaaatgtttttttaacagagtttcagggaggaaaaaaatcatgtgaaaaagccataagccaaatgggactatgaaaaattttaaggaaaaaaaatgacattctggcatgattgttattctgggagtaaaggaggatggtgtgcaaagatagttttcttcgggacatagtagagccgcttacagattttggatatttaaaaaaaaaaatagaagatagtaacaaaaatgtgatgtgatcaaaatcaccctcattaaaatgtcattctagctgttgtagaggaaggaattggaagta

SEQ ID NO: 117874 - DNA, 549 bp, Homo sapiens
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117875 - DNA, 607 bp, Homo sapiens
  misc_feature (45)..(45): n is a, c, g, or t
  misc_feature (53)..(54): n is a, c, g, or t
  misc_feature (59)..(59): n is a, c, g, or t
  misc_feature (61)..(61): n is a, c, g, or t
ggagcgataccatttcacacgggaacagctttgacatgttccganttaatcgnntcctntnggaatttgccctcgagcccaaagattcggcacgagcagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117876 - DNA, 1573 bp, Homo sapiens
gttcgagaccagcctgaccaacatggtgaaaccctgtctctgctaaaaatgcaaaattagctgggcgtggcagtgcgtgcctgtggtcccagccacttgggaggctgaggcatgagaattacttgaacccgggaggcaagggtttccagcctgggcgacagactgagactctgtctcaaaaaaaaaaaaaaaaaaaaaaaaaaaaaaaaaaaaaaagattttttccccaaaaaaatatggaaatttttaattttaagaaacactgtcaaattgatgctttcaagcaactgtgcacatttgtattccccccaggagtcagtacaatatcatatatctggtatacaaaaaaaatcgctcattattttagccctaccctccatttgtctctcttctttctgggactcctattgattgcatgaccttctgaaggtcttgtgtgtgtcttacctttttttcataacttctcttaatttttttttttttttttttttagagtctttctctgtcacccaggctggagtgcaatggcgtgatctcagctcactgcaacctctgcctcctgggttcaagtgattctcgtgtctcagcctcctgagtagctgagactacaggtgtgcaccagtgttcccagctgatttttgtattttatgtagagatggggttatgccattttggccaggctagtctcgaactcctgagctcaggtgatacacacacctcagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctgaaagagactcttttctaacagttctgtagcattaattatactcatactgttgtgcaacaaatatccagaaatcttttgtcttgcgaaactgaacctcttacccattaaacactaactcccttttttttcaccctgaaccattggcaaccacaattttactttctttttctgtgagtttgattacttgatacttcatgtgagtggaatcatataatatttgtctttttgtgactgacattttatttagcttaatgtcttcaagtttgacccataccatatcatgtggcaggatttttccctttttttttttttcagacagagtaagactccatctcaaaaacaaaaacaaaaaaagacaagaaaataggattgttttcttagtttacttgccagattatttactgttagtgtatagaaatgcacctgatatttgtattaattttgtgtgctgcaattttgctgaatttgttcattagttttcaatcttttgtgatataataccatgtcatctgtgaataaatacttctttcctttcagtttggatgta

SEQ ID NO: 117877 - DNA, 594 bp, Homo sapiens
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaacaaccactagagcagggtccaggcctggggcggaggggaaatgg

SEQ ID NO: 117878 - DNA, 572 bp, Homo sapiens
gcagccgctactactactactaaattcgcggccgcgtcgaccacgaagacgacagaaggggcagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117879 - DNA, 1848 bp, Homo sapiens
  misc_feature (548)..(548): n is a, c, g, or t
  misc_feature (550)..(550): n is a, c, g, or t
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgatcgaatctacagatgcagaacccatggatacagagggccagcagtacactttgagaagtgtantngaatccccggggacatgtcctttttaactgcattctcctccgccaaaaaagtgaccaagcagagtctttctctgtcacccaggctggagtgcaatggcgtgatctcagctcactgcaacctctgcctcctgggttcaagtgattctcgtgtctcagcctcctgagtagctgagactacaggtgtgcaccagtgttcccagctgatttttgtattttatgtagagatggggttatgccattttggccaggctagtctcgaactcctgagctcaggtgatacacacacctcagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctgaaagagactcttttctaacagttctgtagcattaattatactcatactgttgtgcaacaaatatccagaaatcttttgtcttgcgaaactgaacctcttacccattaaacactaactcccttttttttcaccctgaaccattggcaaccacaattttactttctttttctgtgagtttgattacttgatacttcatgtgagtggaatcatataatatttgtctttttgtgactgacattttatttagcttaatgtcttcaagtttgacccataccatatcatgtggcaggatttttccctttttttttttttcagacggagtctcgctctgtcgcccaggctggagtgcagtggcgcgatctcggctcactgcaagctccgcctcccgggttcatgccattctcctgcctcagcctcctgagtagctgggactacaggcgcccaccactaaacccggctaatttttttgtatttttagtagagacagagtttcaccatgttaatgaggatggtctccatctcctgacctcgtgattcgctcgtctcggcctcccaaagtgctgggattacaggcgtgagccaccgcgcccggccatgatttttcttcttttttaaggctgaataatatctcaatgtatgtatatataccactttttaaaaattcattcatctgttggacatttagattgttcccacctcttgg

SEQ ID NO: 117880 - DNA, 253 bp, Homo sapiens
cattgcactccagtctgggcgacagagtaagactccatctcaaaaacaaaaacaaaaaaagacaagaaaataggattgttttcttagtttacttgccagattatttactgttagtgtatagaaatgcacctgatatttgtattaattttgtgtgctgcaattttgctgaatttgttcattagttttcaatcttttgtgatataataccatgtcatctgtgaataaatacttctttcctttcagtttggatgta

SEQ ID NO: 117881 - DNA, 712 bp, Homo sapiens
  misc_feature (619)..(619): n is a, c, g, or t
  misc_feature (621)..(622): n is a, c, g, or t
  misc_feature (625)..(625): n is a, c, g, or t
  misc_feature (630)..(630): n is a, c, g, or t
  misc_feature (632)..(632): n is a, c, g, or t
  misc_feature (637)..(637): n is a, c, g, or t
  misc_feature (650)..(650): n is a, c, g, or t
  misc_feature (662)..(662): n is a, c, g, or t
  misc_feature (669)..(669): n is a, c, g, or t
  misc_feature (674)..(674): n is a, c, g, or t
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaacacaacacaaaaaaaaaaaaaaaaaaaaaacaaaaaaaaaaaaacaatgatttttgattgngnnagnttttncntgggnccgaatttgggcntattggccattncccttanggggnggtttacaattactgcccgcgttttaaaggctgggtgg

SEQ ID NO: 117882 - DNA, 680 bp, Homo sapiens
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaagaaaaaccctattataccctatatggcggttctgtctattactcggctcccgctttaaacagctgtgccttctaaaaccccatgggaatcccccatttttgtgggcggggcccctaaatttattcct

SEQ ID NO: 117883 - DNA, 587 bp, Homo sapiens
  misc_feature (560)..(560): n is a, c, g, or t
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaacanttttattattttcttaacaaaacatgt

SEQ ID NO: 117884 - DNA, 605 bp, Homo sapiens
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaccctttccccttaccttcccatctcctcctccctctttctctcttcccccccctcc

SEQ ID NO: 117885 - DNA, 708 bp, Homo sapiens
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacttcagaacaacacatgcaattcgcaacacttcccccaccgcctgccctcccctccttacctcactccccccccgcaactactctggccccttttcccacaatcgaccctgagcctacccccgctttcaacctcgctggcccctcctcggcccactcct

SEQ ID NO: 117886 - DNA, 495 bp, Homo sapiens
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagacacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117887 - DNA, 670 bp, Homo sapiens
cgcggccgcgtcgacacggtgcgagaagacgacagaggggctgagagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaacaacatgttggccggctgggccaagtcgacttagactcgggcagccttatcatgcggcccgaaatcgggtccactcggccttcgccctatagcgaggggtattcctcctggccg

SEQ ID NO: 117888 - DNA, 599 bp, Homo sapiens
gggaattcggccattatggccggggagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacaaaaaacacacccaccccccccctcccccccttctctacaccccccccccacctcacaccttc

SEQ ID NO: 117889 - DNA, 432 bp, Homo sapiens
  misc_feature (34)..(34): n is a, c, g, or t
gctacttactatctaacattacgccggccggttncgaccgcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117890 - DNA, 708 bp, Homo sapiens
gcagccgctactactactactaaattcgcggccgcgtcgacccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaacttctgttggtttttattcagaatactggcagattttaggaatataaaggtgtactatgagacttccacttttcaggtggaatatatgggtatcttagagtggtctatcctgttttcgttgtcgtttgagtcatttgaaaactggattccgttaactacataatatgtgagacctgactggttttattggacactggcagtttataactttggcatactctagataaattctgattggtatggggtgttaaggtttctggggcgtttgtaatgcacacccatggttgagaacctagtgcgctagtaggcacgtgttaaaaagctagtaactaatatt

SEQ ID NO: 117891 - DNA, 370 bp, Homo sapiens
gcagccgctactactactactaaattcgcggccgcgtcgacccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117892 - DNA, 639 bp, Homo sapiens
  misc_feature (560)..(560): n is a, c, g, or t
  misc_feature (562)..(562): n is a, c, g, or t
gcagccgctactactactactaaattcgcggccgcgtcgaccagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaacaaananaatacaaactttattatggaatactaggtaaccgagaattcgatggagcggccggaattgggctccttgccttcgcc

SEQ ID NO: 117893 - DNA, 717 bp, Homo sapiens
  misc_feature (717)..(717): n is a, c, g, or t
gtgacgcgtgggtcgacccacgcggtcgcagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaatctcccaaactcttttactccaaacccctttccaatcctctcaaattcaaaacggggaaacaaaaaccctaaaaaaaacactgtggcccctttggcccagtcgacttggatctgggcaagtttttcatgcggcccttcgggcccattggccttgcccctatgggggcn

SEQ ID NO: 117894 - DNA, 539 bp, Homo sapiens
gtgacgcgtgggtcgacccacgcggtcgcagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117895 - DNA, 555 bp, Homo sapiens
cgcggccgcgtcgacacggtgcgagaagacgacagaggggctgagagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117896 - DNA, 332 bp, Homo sapiens
aagcctcgctcatgtccctggctttttgctttttgaggaagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaaggtagtcagatcgagccccgtagtcagatcgagccgcgtagtcagatcgggccgcgtagtcagatcgagccgcgtagtcagatcgaccggcgtagtcacgtaa

SEQ ID NO: 117897 - DNA, 818 bp, Homo sapiens
  misc_feature (554)..(554): n is a, c, g, or t
cccacgctgtcgcggacgcgtgggtcgacccacgcgtccggacagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaancaaacagaaatataaactgtaattaggggaaacaaaaatgtgatgatccaatcccctttgggtgggcccgccggtggcctttaaattcctgctttaccccgccttttggattggctttttcccggggggctttttggcatgtccgtcatagcgggtattatggcattcaattggctggccaccccaaagggcttctttcccactttatggcgtcttctcagtataaaaagtttccaaccccccttggggggggccggtgagcaa

SEQ ID NO: 117898 - DNA, 553 bp, Homo sapiens
cccacgctgtcgcggacgcgtgggtcgacccacgcgtccggacagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117899 - DNA, 548 bp, Homo sapiens
aaaaggaaacataggctaggtacgaggctgggtgttgcagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117900 - DNA, 891 bp, Homo sapiens
  misc_feature (576)..(576): n is a, c, g, or t
  misc_feature (645)..(645): n is a, c, g, or t
  misc_feature (648)..(648): n is a, c, g, or t
  misc_feature (828)..(828): n is a, c, g, or t
cgacccacgcgttcggacccacgcgtccgagacagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaaaaaaaaaaaagggggggggggnaaaaagattcccccgggggggcccaagttttaggggttacccaggttttttggtacaagggggccccanatnaggggggcggtataaatagacataaggaaaggggcccgttttaacacaggtcgtacgtgggaaacacgggatccctggggattcttgggggagagaacccttcttctgggggggtgcacatattggacaactccctacagagataaggcatcaaggtaatatacaactttagggttatgnggtgtacaacaggatagtgcggtgattggtaccggatgagttgagatttagagcgttgaatac

SEQ ID NO: 117901 - DNA, 1121 bp, Homo sapiens
  misc_feature (45)..(45): n is a, c, g, or t
  misc_feature (53)..(54): n is a, c, g, or t
  misc_feature (59)..(59): n is a, c, g, or t
  misc_feature (61)..(61): n is a, c, g, or t
ggagcgataccatttcacacgggaacagctttgacatgttccganttaatcgnntcctntnggaatttgccctcgagcccaaagattcggcacgagcagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaaaaaaaaaaaaaaaaaaaaaacaaaaaaaaaaaaacaaaaaaaaaaaaaaaaaaaaaaagggggggggggggaaaaaaattccgggggggggccaacaattgtatgtatgcacccaggtttttgtattacaacaagggggggcccctacgaggggggggcgcactaaataaaacagcagcacgcgacggggcggcgcggggttaacaacaacaggctgggggagtgggggaaagaacaggtgcatatcgtgcagcacacctttgtggggacgaagaacaccccacatccttgtcgggggggtggggcaaacacatttggtgggccgacacaccacacccacgaagagaagattattaaaaacgccgccacgagagtactaaaataaaaactttgacagcggttaatatagggtgggtcacacacccagcaccgaattaaggcggctggaccaagaaaaaatggggccacggaagattatgattgtggagagatcatttataaaa

SEQ ID NO: 117902 - DNA, 552 bp, Homo sapiens
gcagccgctactactactactaaattcgcggccgcgtcgaccagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117903 - DNA, 799 bp, Homo sapiens
  misc_feature (758)..(758): n is a, c, g, or t
aattacgctaggtacgaggctgggtggagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaaaaaaaaaaaagtggggggttttatggggggggcgggagaaacagcagggtacatggaaattggggccaaggggtccatagctggtttcctggacccagttttcctgttgtcccacggggcgaggactctggccgggtctccccaaataggggagccggaataaattcgataaacgcaaggttaacctcgatagagtctcggagaaaaaanatcccaaaaaaacacaaaaaagaaaaccgaccaaaaacaga

SEQ ID NO: 117904 - DNA, 571 bp, Homo sapiens
  misc_feature (255)..(255): n is a, c, g, or t
cattcggctacagtatccctcgatcgtgccatacgctgatgctttacctcatgcgttgcattgatacaaagatgctggccccgtaatacgctgagtcggtataatcatctagtgcaactggactgctcgtattaacaaacgctgtgtgactcgggaagatagctgctatgcattcgggattctgtatgtcgaacgcgtaaccttacctgtactggtgtgtgtgaccattgagttgagagctagtgctactcgtancaggaagatatgaagagggctactaagagataaaatactatcaattgttgaaaggtgtactagattgtgtgtgaacttacgactgaactatgactagtcgctatgaaaagatattagtctctatgtgagttatgagttcattgaacgtgtgatccacaggagctaagtgatacacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117905 - DNA, 533 bp, Homo sapiens
  misc_feature (5)..(5): n is a, c, g, or t
  misc_feature (15)..(15): n is a, c, g, or t
cgggntcaggaattnggacgagcagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117906 - DNA, 425 bp, Homo sapiens
  misc_feature (1)..(1): n is a, c, g, or t
  misc_feature (4)..(4): n is a, c, g, or t
  misc_feature (18)..(18): n is a, c, g, or t
  misc_feature (21)..(21): n is a, c, g, or t
  misc_feature (36)..(36): n is a, c, g, or t
nttnaaggaaaacgcggncgnaagtgcttttggatncaccccccccaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117907 - DNA, 206 bp, Homo sapiens
  misc_feature (19)..(19): n is a, c, g, or t
  misc_feature (21)..(21): n is a, c, g, or t
acgagagaccgtgttgcantncacaactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagtgcaacacgggtctctcagggtacgcgagc

SEQ ID NO: 117908 - DNA, 738 bp, Homo sapiens
gcagccgctactactactactaaattcgcggccgcgtcgaccacgaagacgacagaaggggcagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaaaaaaaaaaaaaaaaaaaaaaagaaaaaataaaagagcaggtttatgcatggggccgaatttagggctaactgggacaatttgccctatagggggccgtatcacattcacgggccggcgtttacaccgggggacgggaa

SEQ ID NO: 117909 - DNA, 1398 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaaaaaaaaaaaaaaaaaaaaaaaaagaaaaaaaaaaaaaaaaaggggggggggggaaaaaaattccgggggggggccaacaattgtatgtatgcacccaggtttttgtattacaacaagggggggcccctacgaggggggggcgcactaaataaaacagcagcacgcgacggggcggcgcggggttaacaacaacaggctgggggagtgggggaaagaacaggtgcatatcgtgcagcacacctttgtggggacgaagaacaccccacatccttgtcgggggggtggggcaaacacatttggtgggccgacacaccacacccacgaagagaagattattaaaaacgccgccacgagagtactaaaataaaaactttgacagcggttaatatagggtgggtcacacacccagcaccgaattaaggcggctggaccaagaaaaaatggggccacggaagattatgattgtggagagatcatttataaaa

SEQ ID NO: 117910 - DNA, 1257 bp, Homo sapiens
  misc_feature (914)..(915): n is a, c, g, or t
  misc_feature (920)..(923): n is a, c, g, or t
  misc_feature (925)..(925): n is a, c, g, or t
  misc_feature (927)..(927): n is a, c, g, or t
  misc_feature (972)..(972): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaannggggnnnnangngggggggggaaaaaggggtcgaaggggccggggccaaaggggttnccgggcccttttttttggttccaaaggggcggaactccggcggggcccccccatattggggaggccgaaataactttcgcaaaagcccgggtaaccctgctttatgacctctgccagcacctcccgacagaaagagcacaccccgcaccacgcaccgaccacccatgacagccaccagcggcagagcaccagagcagcacaccacgaagcccaacggcagcgaagataacgcagcacaacacagcaccagcgctcacccgcacgactgccccagcaccggacgag

SEQ ID NO: 117911 - DNA, 1100 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaaaaccgcgcgggggctttttgtgtgtgggggggggggaaaaaggggttttgggaagggggctgtgggtaaaggtgtgttttcggggcccccttttttggtgcacaggcgggggtttgggggggcccccaaaagggggcggggataaaatgggaaaaaagccggggttcctggtagttttttgcagaaa

SEQ ID NO: 117912 - DNA, 1032 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaatctccggggctatctctactggggggggcgggaacaacagggtcaaggaaggggcccagggccaaagcggttcccggaccacatttccggtacacggggaaatcggggccccaataggg

SEQ ID NO: 117913 - DNA, 1405 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaaaaaaaaaaaaaaaaaaaaaaaaaaaaaaaaaaaaaaaaaaaaaaaaagggggggggggggaaaaaaattccgggggggggccaacaattgtatgtatgcacccaggtttttgtattacaacaagggggggcccctacgaggggggggcgcactaaataaaacagcagcacgcgacggggcggcgcggggttaacaacaacaggctgggggagtgggggaaagaacaggtgcatatcgtgcagcacacctttgtggggacgaagaacaccccacatccttgtcgggggggtggggcaaacacatttggtgggccgacacaccacacccacgaagagaagattattaaaaacgccgccacgagagtactaaaataaaaactttgacagcggttaatatagggtgggtcacacacccagcaccgaattaaggcggctggaccaagaaaaaatggggccacggaagattatgattgtggagagatcatttataaaa

SEQ ID NO: 117914 - DNA, 1106 bp, Homo sapiens
  misc_feature (1013)..(1013): n is a, c, g, or t
  misc_feature (1015)..(1016): n is a, c, g, or t
  misc_feature (1019)..(1019): n is a, c, g, or t
  misc_feature (1024)..(1024): n is a, c, g, or t
  misc_feature (1026)..(1026): n is a, c, g, or t
  misc_feature (1031)..(1031): n is a, c, g, or t
  misc_feature (1044)..(1044): n is a, c, g, or t
  misc_feature (1056)..(1056): n is a, c, g, or t
  misc_feature (1063)..(1063): n is a, c, g, or t
  misc_feature (1068)..(1068): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaagaaaaaaacaaaattaattattatatttttattaatatattttatatattttttggtataattttaatataatttttataaaaaacttgtgggccgccttggcccagtgatttttgattgngnnagnttttncntgggnccgaatttgggcntattggccattncccttanggggnggtttacaattactgcccgcgttttaaaggctgggtgg

SEQ ID NO: 117915 - DNA, 1223 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaacttctgttggtttttattcagaatactggcagattttaggaatataaaggtgtactatgagacttccacttttcaggtggaatatatgggtatcttagagtggtctatcctgttttcgttgtcgtttgagtcatttgaaaactggattccgttaactacataatatgtgagacctgactggttttattggacactggcagtttataactttggcatactctagataaattctgattggtatggggtgttaaggtttctggggcgtttgtaatgcacacccatggttgagaacctagtgcgctagtaggcacgtgttaaaaagctagtaactaatatt

SEQ ID NO: 117916 - DNA, 1016 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaagaaaaaccctattataccctatatggcggttctgtctattactcggctcccgctttaaacagctgtgccttctaaaaccccatgggaatcccccatttttgtgggcggggcccctaaatttattcct

SEQ ID NO: 117917 - DNA, 994 bp, Homo sapiens
  misc_feature (886)..(886): n is a, c, g, or t
  misc_feature (890)..(891): n is a, c, g, or t
  misc_feature (898)..(898): n is a, c, g, or t
  misc_feature (901)..(901): n is a, c, g, or t
  misc_feature (904)..(904): n is a, c, g, or t
  misc_feature (911)..(911): n is a, c, g, or t
  misc_feature (914)..(914): n is a, c, g, or t
  misc_feature (925)..(925): n is a, c, g, or t
  misc_feature (931)..(931): n is a, c, g, or t
  misc_feature (936)..(936): n is a, c, g, or t
  misc_feature (942)..(942): n is a, c, g, or t
  misc_feature (944)..(944): n is a, c, g, or t
  misc_feature (948)..(948): n is a, c, g, or t
  misc_feature (965)..(967): n is a, c, g, or t
  misc_feature (994)..(994): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaantgcnncaagtgnggngtntgttttnatntttgcccttgnttccgngccgntgctgncngtgnccttcaatgggtgactnnnttcagccagtgcctgaggagcccgtcn

SEQ ID NO: 117918 - DNA, 1079 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaacacaacacaaaaaaaaaaaaaaaaaaaaaacaaaaaaaaaaaaacaaaaaaaaaaaaaaaaaaaaaaagaaaaaataaaagagcaggtttatgcatggggccgaatttagggctaactgggacaatttgccctatagggggccgtatcacattcacgggccggcgtttacaccgggggacgggaa

SEQ ID NO: 117919 - DNA, 1263 bp, Homo sapiens
  misc_feature (1017)..(1017): n is a, c, g, or t
  misc_feature (1021)..(1021): n is a, c, g, or t
  misc_feature (1024)..(1025): n is a, c, g, or t
  misc_feature (1028)..(1028): n is a, c, g, or t
  misc_feature (1031)..(1031): n is a, c, g, or t
  misc_feature (1034)..(1035): n is a, c, g, or t
  misc_feature (1039)..(1039): n is a, c, g, or t
  misc_feature (1045)..(1045): n is a, c, g, or t
  misc_feature (1050)..(1050): n is a, c, g, or t
  misc_feature (1053)..(1053): n is a, c, g, or t
  misc_feature (1057)..(1057): n is a, c, g, or t
  misc_feature (1060)..(1060): n is a, c, g, or t
  misc_feature (1075)..(1075): n is a, c, g, or t
  misc_feature (1079)..(1080): n is a, c, g, or t
  misc_feature (1084)..(1084): n is a, c, g, or t
  misc_feature (1099)..(1099): n is a, c, g, or t
  misc_feature (1104)..(1104): n is a, c, g, or t
  misc_feature (1109)..(1109): n is a, c, g, or t
  misc_feature (1114)..(1114): n is a, c, g, or t
  misc_feature (1118)..(1118): n is a, c, g, or t
  misc_feature (1136)..(1136): n is a, c, g, or t
  misc_feature (1138)..(1138): n is a, c, g, or t
  misc_feature (1140)..(1140): n is a, c, g, or t
  misc_feature (1143)..(1143): n is a, c, g, or t
  misc_feature (1145)..(1145): n is a, c, g, or t
  misc_feature (1149)..(1149): n is a, c, g, or t
  misc_feature (1151)..(1152): n is a, c, g, or t
  misc_feature (1155)..(1156): n is a, c, g, or t
  misc_feature (1163)..(1163): n is a, c, g, or t
  misc_feature (1179)..(1180): n is a, c, g, or t
  misc_feature (1183)..(1183): n is a, c, g, or t
  misc_feature (1187)..(1187): n is a, c, g, or t
  misc_feature (1189)..(1189): n is a, c, g, or t
  misc_feature (1191)..(1191): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaaaaaaaaaaaaaagaaaaaaaaaaaaaaaaaccgtgtgtggcggcgcgcgccccgcgggccccgcggagaagagccttttctaagaacccatgcgcgtgtggggcgcgcgcgcggggccccngggntannggnganacnngggnccaaancgcgngtncccnagngggaaaccgggggcngagnnacangagggcgggggattntctcncccantatanaaanagcgccgcgggggggaancncngangngttntnntgnnaacaaantctccagagagggggnntcncggngngngcaccataacgggggattcttattaaccgggggggtgcccagagggaaaggctcggaagtaatataattaac

SEQ ID NO: 117920 - DNA, 949 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacaaaaaacacacccaccccccccctcccccccttctctacaccccccccccacctcacaccttc

SEQ ID NO: 117921 - DNA, 1044 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacttcagaacaacacatgcaattcgcaacacttcccccaccgcctgccctcccctccttacctcactccccccccgcaactactctggccccttttcccacaatcgaccctgagcctacccccgctttcaacctcgctggcccctcctcggcccactcct

SEQ ID NO: 117922 - DNA, 1043 bp, Homo sapiens
  misc_feature (897)..(898): n is a, c, g, or t
  misc_feature (900)..(900): n is a, c, g, or t
  misc_feature (907)..(907): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaatatnntnacataanaattatgactcattaaaacatttaaatttgttcaaaattatatacaggaaaaaaaaatcaacctaaaacaaaaccatgtgggcccttgggcccagtgaactttttcgaccaagcttttcaatgcgcccgatttgag

SEQ ID NO: 117923 - DNA, 959 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaatataataaatggggcagcttatgctgcgtcccaaattgagcttattggtcaattcgcctataggaggggattaa

SEQ ID NO: 117924 - DNA, 1515 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaggaagaagagttaaaaaattaaaaacaaaaaaaaaattaccttaaaaaaaaaaaaggggccgcggggcgcttcacacatgattttctcccccggaggggcgccaggagcttcgctcacaccggggtttggtcaacacgaggggccccacaattgtcgtggcctgtttcacagcctgtagagcaatgaggtccgagtcgtcttttaaacacgtcttttgttcttattgtgagtaaacacacgcgagccgtatgccgtggagcatatctttcgctgtagaaccgcgataaacaacttgtggctcaattagaggggggcgcattaaaaatgattccgtggtcccccataattattacccctatgaggagagaattatttgagagggcgccatataagagagagcgcagtaatataaaaccctgcggttttcacaaaaggggttgtatgtcgaataggtggcgtgttcttgaaacagaaattgcggccaaattttttttgacgggttggcttagctacccgttggggaagaattcttttgtgcggcccaaacgggtggaatatatggaccctatcgaaggaggccatatatttttgtattgcccctgagtgatctgttgctgtataaaaaactg

SEQ ID NO: 117925 - DNA, 907 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacataagaccacacacgtgcatc

SEQ ID NO: 117926 - DNA, 922 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaagtcgaccggccgcaaatttagtagtagtag

SEQ ID NO: 117927 - DNA, 913 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacaaagaaccacacaacgtgaatcacaag

SEQ ID NO: 117928 - DNA, 2184 bp, Homo sapiens
  misc_feature (884)..(884): n is a, c, g, or t
  misc_feature (886)..(886): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgatcgaatctacagatgcagaacccatggatacagagggccagcagtacactttgagaagtgtantngaatccccggggacatgtcctttttaactgcattctcctccgccaaaaaagtgaccaagcagagtctttctctgtcacccaggctggagtgcaatggcgtgatctcagctcactgcaacctctgcctcctgggttcaagtgattctcgtgtctcagcctcctgagtagctgagactacaggtgtgcaccagtgttcccagctgatttttgtattttatgtagagatggggttatgccattttggccaggctagtctcgaactcctgagctcaggtgatacacacacctcagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctgaaagagactcttttctaacagttctgtagcattaattatactcatactgttgtgcaacaaatatccagaaatcttttgtcttgcgaaactgaacctcttacccattaaacactaactcccttttttttcaccctgaaccattggcaaccacaattttactttctttttctgtgagtttgattacttgatacttcatgtgagtggaatcatataatatttgtctttttgtgactgacattttatttagcttaatgtcttcaagtttgacccataccatatcatgtggcaggatttttccctttttttttttttcagacggagtctcgctctgtcgcccaggctggagtgcagtggcgcgatctcggctcactgcaagctccgcctcccgggttcatgccattctcctgcctcagcctcctgagtagctgggactacaggcgcccaccactaaacccggctaatttttttgtatttttagtagagacagagtttcaccatgttaatgaggatggtctccatctcctgacctcgtgattcgctcgtctcggcctcccaaagtgctgggattacaggcgtgagccaccgcgcccggccatgatttttcttcttttttaaggctgaataatatctcaatgtatgtatatataccactttttaaaaattcattcatctgttggacatttagattgttcccacctcttgg

SEQ ID NO: 117929 - DNA, 2028 bp, Homo sapiens
  misc_feature (884)..(884): n is a, c, g, or t
  misc_feature (886)..(886): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgatcgaatctacagatgcagaacccatggatacagagggccagcagtacactttgagaagtgtantngaatccccggggacatgtcctttttaactgcattctcctccgccaaaaaagtgaccaagcagagtctttctctgtcacccaggctggagtgcaatggcgtgatctcagctcactgcaacctctgcctcctgggttcaagtgattctcgtgtctcagcctcctgagtagctgagactacaggtgtgcaccagtgttcccagctgatttttgtattttatgtagagatggggttatgccattttggccaggctagtctcgaactcctgagctcaggtgatacacacacctcagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctgaaagagactcttttctaacagttctgtagcattaattatactcatactgttgtgcaacaaatatccagaaatcttttgtcttgcgaaactgaacctcttacccattaaacactaactcccttttttttcaccctgaaccattggcaaccacaattttactttctttttctgtgagtttgattacttgatacttcatgtgagtggaatcatataatatttgtctttttgtgactgacattttatttagcttaatgtcttcaagtttgacccataccatatcatgtggcaggatttttccctttttttttttttcagacagagtaagactccatctcaaaaacaaaaacaaaaaaagacaagaaaataggattgttttcttagtttacttgccagattatttactgttagtgtatagaaatgcacctgatatttgtattaattttgtgtgctgcaattttgctgaatttgttcattagttttcaatcttttgtgatataataccatgtcatctgtgaataaatacttctttcctttcagtttggatgta

SEQ ID NO: 117930 - DNA, 840 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagaataaattgatgcccagttgtta

SEQ ID NO: 117931 - DNA, 844 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagatatcaccaacagatgttccggccagc

SEQ ID NO: 117932 - DNA, 1106 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggtggggaaacgcgggaagcttccggaagctgcctttctccagaagtggcagaccatttttggcttattgttctttttcatgtatctaataataggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117933 - DNA, 1308 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataagtataaaacgataaacacttggtttcctttgtcttttgttacagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117934 - DNA, 1365 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagacacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaaaaaaaaaaaaaaaaaaaaaaaaaaaaaaaaaaaaaaaaaaaaaagaaaaaaaaaaaaaaaaaggggggggggggaaaaaaattccgggggggggccaacaattgtatgtatgcacccaggtttttgtattacaacaagggggggcccctacgaggggggggcgcactaaataaaacagcagcacgcgacggggcggcgcggggttaacaacaacaggctgggggagtgggggaaagaacaggtgcatatcgtgcagcacacctttgtggggacgaagaacaccccacatccttgtcgggggggtggggcaaacacatttggtgggccgacacaccacacccacgaagagaagattattaaaaacgccgccacgagagtactaaaataaaaactttgacagcggttaatatagggtgggtcacacacccagcaccgaattaaggcggctggaccaagaaaaaatggggccacggaagattatgattgtggagagatcatttataaaa

SEQ ID NO: 117935 - DNA, 1600 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggggtcagtgcattcgttatgcgggggggagggggaattgggcgaaaagcgacgagctttactcgttaatgttagtgtagaaggtggactgcaagaactaaagtgacaagttacttaaaaaagtaaagcgtggcttaaaattgcttttactgtcatacagctggcgatgaggaggtacctattgtgttgagtaacggtgataattttatacgctattctgagccagcagaagtgaaggccttaagccgattttaattgtttcgattatactgagaggtcttttatttcctgtagtgtgtgctgacttgataagaggcgcaaaagaaaagaatctcaaagtgaaaggaccagttcgaatgcctaccaagggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataagtataaaacgataaacacttggtttcctttgtcttttgttacagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117936 - DNA, 786 bp, Homo sapiens
  misc_feature (690)..(690): n is a, c, g, or t
  misc_feature (786)..(786): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaanaactccttggtggggtttggggaaaaaaaaaaaaggggggggggggtcttttttttttccccccttttttaaaaattgcacagtccttctgagatn

SEQ ID NO: 117937 - DNA, 1821 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggtggggaaacgcgggaagcttccggaagctgcctttctccagaagtggcagaccatttttggcttattgttctttttcatgtatctaataataggcttttaaggataccggaaaaacacccgtggagccggaggtggcaattcaccgaattcgaatcaccctaacaagccgcaacgtaaaatccttggaaaaggggtcagtgcattcgttatgcgggggggagggggaattgggcgaaaagcgacgagctttactcgttaatgttagtgtagaaggtggactgcaagaactaaagtgacaagttacttaaaaaagtaaagcgtggcttaaaattgcttttactgtcatacagctggcgatgaggaggtacctattgtgttgagtaacggtgataattttatacgctattctgagccagcagaagtgaaggccttaagccgattttaattgtttcgattatactgagaggtcttttatttcctgtagtgtgtgctgacttgataagaggcgcaaaagaaaagaatctcaaagtgaaaggaccagttcgaatgcctaccaagggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataagtataaaacgataaacacttggtttcctttgtcttttgttacagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117938 - DNA, 1049 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaagtcgaccggccgcaaatttagtagtagtag

SEQ ID NO: 117939 - DNA, 704 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggggtgtgtgctgacttgataagaggcgcaaagaaagatctcaagtgaagacagtcgatgctacagacttgagatacatacagaaactctgtgtgagtcatagctgatcgacag

SEQ ID NO: 117940 - DNA, 885 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117941 - DNA, 930 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaacaaccactagagcagggtccaggcctggggcggaggggaaatgg

SEQ ID NO: 117942 - DNA, 943 bp, Homo sapiens
  misc_feature (908)..(908): n is a, c, g, or t
ctgatacttacgattcaagcatggaactgtttcatgtttacccgttcgtacagttaaaggatgccctgttactatatatgtggctttctagcatattactgattctgtacatatctttaaaagttggatatttgtaatagcttaaagggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaacaaacaagggggggccatccgatctaaaactatccgtgcccgcgctgccagcaagaaggtgtacttcgctgagaaggtgacgtctctgggcaaggatgggcacgggccctgcctggctgagagcgctggggaagacactgaccccggggggcacgcggagcacgaggcagcctatgcaaagccgtgtatgaatctcttcggacccaggagtgacccgtgcgggggcagtaattatgacgggaccgaggaaggcaagcctaggtacgnggcccagaagggggcacctggccaaacgtgggcct

SEQ ID NO: 117943 - DNA, 1051 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaaaaaaaaaaaaaaaaaaaaaaagaaaaaataaaagagcaggtttatgcatggggccgaatttagggctaactgggacaatttgccctatagggggccgtatcacattcacgggccggcgtttacaccgggggacgggaa

SEQ ID NO: 117944 - DNA, 1379 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaaaaaaaaaaaaaaaaaaaaaaagggggggggggggaaaaaaattccgggggggggccaacaattgtatgtatgcacccaggtttttgtattacaacaagggggggcccctacgaggggggggcgcactaaataaaacagcagcacgcgacggggcggcgcggggttaacaacaacaggctgggggagtgggggaaagaacaggtgcatatcgtgcagcacacctttgtggggacgaagaacaccccacatccttgtcgggggggtggggcaaacacatttggtgggccgacacaccacacccacgaagagaagattattaaaaacgccgccacgagagtactaaaataaaaactttgacagcggttaatatagggtgggtcacacacccagcaccgaattaaggcggctggaccaagaaaaaatggggccacggaagattatgattgtggagagatcatttataaaa

SEQ ID NO: 117945 - DNA, 1419 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaacaaaaaaaaaaaaacaaaaaaaaaaaaaaaaaaaaaaaaaaaaaaaaaaaaaaaaaaaaaagaaaaaaaaaaaaaaaaaggggggggggggaaaaaaattccgggggggggccaacaattgtatgtatgcacccaggtttttgtattacaacaagggggggcccctacgaggggggggcgcactaaataaaacagcagcacgcgacggggcggcgcggggttaacaacaacaggctgggggagtgggggaaagaacaggtgcatatcgtgcagcacacctttgtggggacgaagaacaccccacatccttgtcgggggggtggggcaaacacatttggtgggccgacacaccacacccacgaagagaagattattaaaaacgccgccacgagagtactaaaataaaaactttgacagcggttaatatagggtgggtcacacacccagcaccgaattaaggcggctggaccaagaaaaaatggggccacggaagattatgattgtggagagatcatttataaaa

SEQ ID NO: 117946 - DNA, 1233 bp, Homo sapiens
  misc_feature (918)..(918): n is a, c, g, or t
  misc_feature (987)..(987): n is a, c, g, or t
  misc_feature (990)..(990): n is a, c, g, or t
  misc_feature (1170)..(1170): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaaaaaaaaaaaagggggggggggnaaaaagattcccccgggggggcccaagttttaggggttacccaggttttttggtacaagggggccccanatnaggggggcggtataaatagacataaggaaaggggcccgttttaacacaggtcgtacgtgggaaacacgggatccctggggattcttgggggagagaacccttcttctgggggggtgcacatattggacaactccctacagagataaggcatcaaggtaatatacaactttagggttatgnggtgtacaacaggatagtgcggtgattggtaccggatgagttgagatttagagcgttgaatac

SEQ ID NO: 117947 - DNA, 1152 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaaaaaaaaaaaagcccgggaactagttccctctctccccccgggccaatcttgggggtggacctccctctcagttagggactccacgcggtttcctccctcccctctcttccttcccaatattaattccccattcctcccagatgctcccaaatttcttggccaattgagcgggccggggtgggagggggcgcagtggggctgttgccctggggtgttgcgctgatgtggggtgctagactagtggctctgacgcgaa

SEQ ID NO: 117948 - DNA, 1323 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaaaaaaaaaaactcgagtttttttttggttttttgtttttgtttttgtttttttttttttgtttttttttttttttttttttttttttttttttttttttgtttgttttttttatttgttttttttttgttgtttcttgtttgatccttggcacaaggcaggcgagatcacccaatcctgggccagagcggcccacagtaaaacggagcggggctggcgacaacactggaccaggtcttatataggaagccgggggcgcgccgccacgcattcgagggtggagacgtagacacgcgcaaaaaattcagagcagcgccagaaaatagaaacaccaggactcgcacaggagctctggaaaacacgcgacagaaaaaagcatccccacataggtaggaggagaagagtgacccccaaacaggagcagcaaag

SEQ ID NO: 117949 - DNA, 1214 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaaaaaaacctccggactctttctctcacccattctaatcgcaatggcattcctaatgcttaccgaacgaataattctagggctatatctacataccccataagtgcccaagcgttttagcccctaacgggctactaacaaccctttggtattagcccataaaagtctttcaccaaagagcccctaaaaaccggcaattttacattacctttaaattaccgccaaatttgtttcccctgctctttattaacccctccatatcacccttgacccacatcctctatttaccatctaccagtacctctaaggagacacaacccg

SEQ ID NO: 117950 - DNA, 951 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaagggcccattccatgtcggccgcttgggccaagcgtctttagccttgggcgtttatgcatgcgcccc

SEQ ID NO: 117951 - DNA, 863 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagcaccaccaactggtgaaacaatgaaaagacagtttacactgagata

SEQ ID NO: 117952 - DNA, 1012 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117953 - DNA, 2130 bp, Homo sapiens
  misc_feature (830)..(830): n is a, c, g, or t
  misc_feature (832)..(832): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagacacaagcgactcattgacttgcacagtccttctgagattgttaagcagattacttccatcagtattgagccaggagttgatcgaatctacagatgcagaacccatggatacagagggccagcagtacactttgagaagtgtantngaatccccggggacatgtcctttttaactgcattctcctccgccaaaaaagtgaccaagcagagtctttctctgtcacccaggctggagtgcaatggcgtgatctcagctcactgcaacctctgcctcctgggttcaagtgattctcgtgtctcagcctcctgagtagctgagactacaggtgtgcaccagtgttcccagctgatttttgtattttatgtagagatggggttatgccattttggccaggctagtctcgaactcctgagctcaggtgatacacacacctcagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctgaaagagactcttttctaacagttctgtagcattaattatactcatactgttgtgcaacaaatatccagaaatcttttgtcttgcgaaactgaacctcttacccattaaacactaactcccttttttttcaccctgaaccattggcaaccacaattttactttctttttctgtgagtttgattacttgatacttcatgtgagtggaatcatataatatttgtctttttgtgactgacattttatttagcttaatgtcttcaagtttgacccataccatatcatgtggcaggatttttccctttttttttttttcagacggagtctcgctctgtcgcccaggctggagtgcagtggcgcgatctcggctcactgcaagctccgcctcccgggttcatgccattctcctgcctcagcctcctgagtagctgggactacaggcgcccaccactaaacccggctaatttttttgtatttttagtagagacagagtttcaccatgttaatgaggatggtctccatctcctgacctcgtgattcgctcgtctcggcctcccaaagtgctgggattacaggcgtgagccaccgcgcccggccatgatttttcttcttttttaaggctgaataatatctcaatgtatgtatatataccactttttaaaaattcattcatctgttggacatttagattgttcccacctcttgg

SEQ ID NO: 117954 - DNA, 1353 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataagtataaaacgataaacacttggtttcctttgtcttttgttacagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaacaaccactagagcagggtccaggcctggggcggaggggaaatgg

SEQ ID NO: 117955 - DNA, 1177 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggggtcagtgcattcgttatgcgggggggagggggaattgggcgaaaagcgacgagctttactcgttaatgttagtgtagaaggtggactgcaagaactaaagtgacaagttacttaaaaaagtaaagcgtggcttaaaattgcttttactgtcatacagctggcgatgaggaggtacctattgtgttgagtaacggtgataattttatacgctattctgagccagcagaagtgaaggccttaagccgattttaattgtttcgattatactgagaggtcttttatttcctgtagtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117956 - DNA, 691 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagcgacgcgattccgccccgcacgccc

SEQ ID NO: 117957 - DNA, 1398 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggtggggaaacgcgggaagcttccggaagctgcctttctccagaagtggcagaccatttttggcttattgttctttttcatgtatctaataataggcttttaaggataccggaaaaacacccgtggagccggaggtggcaattcaccgaattcgaatcaccctaacaagccgcaacgtaaaatccttggaaaaggggtcagtgcattcgttatgcgggggggagggggaattgggcgaaaagcgacgagctttactcgttaatgttagtgtagaaggtggactgcaagaactaaagtgacaagttacttaaaaaagtaaagcgtggcttaaaattgcttttactgtcatacagctggcgatgaggaggtacctattgtgttgagtaacggtgataattttatacgctattctgagccagcagaagtgaaggccttaagccgattttaattgtttcgattatactgagaggtcttttatttcctgtagtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117958 - DNA, 1435 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataagtataaaacgataaacacttggtttcctttgtcttttgttacagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117959 - DNA, 811 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 117960 - DNA, 786 bp, Homo sapiens
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagttgacaaatcctaaaggcctgggggaggagtggtctgtctttttacaggggccaaaaagagtatttcttttgtgagggcccgttttgttgccttctcatgacttttagaatcccttcaagaaaaacctacctgtggtggaaggtttttaaacgagggggtcgtttttcgttttagcaatttaaaatctatttattgaacttgtccttgcccctttttgag

SEQ ID NO: 117961 - DNA, 646 bp, Homo sapiens
  misc_feature (533)..(533): n is a, c, g, or t
  misc_feature (608)..(608): n is a, c, g, or t
gtggtgtatacgacggtgcgcgcgcacggggtggtccacgcgtgttttcgcggcgccttcttggggttctctcatgcccacaggtgtggcttgccacgagcggccggttgtgcctgccccggggtttgagaggggcggcgggtcttttgtatgactatccttgggggtggcgttccatcgtaggcgtaggggggtgggtcgtgggctggctctcgggtggttgtattcggcgggcggcccgcgctggttgtttgtgtgggtgcggttcgttgatcggctcgttgttgtcgggcgttgttgtggctgtgagtgtgtgagtgtgtgatattgatgtggtggttgtgtggtctgtgggatggatgtatgttttgttttagagacgcggtcgtaagggctgaggatttttggtccgcacgctcctgctcctgactcaccgctgttcgctctcgccgaggaacaagtcggtcaggaagcccgcgcgcaacagccatgcttttaaggataccggatgtcatctttgtatttggattcanaactcattttggtggtggcaagacaactggctttggcatgatttatgattccctggattatgcaaagaaaaatgnacccaaacatagacttgcaagacatggcctgtatgaga

SEQ ID NO: 117962 - DNA, 2110 bp, Homo sapiens
agaagctctacattgacagttgtgcttgaagaaacctaggctccatcaacactgaattgcaagatgtgcagaggatcatggtggccaatatcgaagaagtgttacaacgaggagaagcactctcagcattggattcaaaggctaacaatttgtccagtctgtccaagaaataccgccaggatgcgaagtacttgaacatgcgttccacttacgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgttttttttttttttttttttttgactctaatcaacattccttttgttggtgacatttgtgattttcagtaatctgagtttttgatggccttttaaacaagactccagtatgtgaaggttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagcgtaagagcaagtataggatatggagaggcccctggcttcatgagaacaaaggcaggcccaggttataattacagctttctcctgccccttctttactttctctaccacagttttctccactgtttgttttcctcttgccacaatttgctaacatttaaaaaattttcctgcacccagtagtttcatatcctgtagacatcctcttaggacattctcaaatttcaaaataaaaaatattcatctatgtagttaattaaagttaaagtttttgcagatcaactactcaaactactaaatacatttacctgagaaaaaagtctctgagagcacttcattcctgttttagttcgtgtaaattctctgagaatgttctggagatagatactcatttacagtggtttctattaactaattaaagtacccatgattttttccttttctgctcagggatgatggagatttccttttaccttttttaatgtttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatataactagaataatttttttcctttcttttatggacctaaatctgccaattgggaattttgtgcatgaaatatgaagttactttttatagataatcagtgcttttaagtccctaaaaggctcctgctgaagtaatgatgatgttaataataaaagcctttgaaaggctgaaaacctacatagtggtaccatagtatttggagcttctataggagtggagaggggcagctcattgttgagagttgcatgctgcaacctaatggtcagcaatgaaataaatacttgtagaatgttca

SEQ ID NO: 117963 - DNA, 2284 bp, Homo sapiens
agaagctctacattgacagttgtgcttgaagaaacctaggctccatcaacactgaattgcaagatgtgcagaggatcatggtggccaatatcgaagaagtgttacaacgaggagaagcactctcagcattggattcaaaggctaacaatttgtccagtctgtccaagaaataccgccaggatgcgaagtacttgaacatgcgttccacttacgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgttttttttttttttttttttttgactctaatcaacattccttttgttggtgacatttgtgattttcagtaatctgagtttttgatggccttttaaacaagactccagtatgtgaaggttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagcgtaagagcaagtataggatatggagaggcccctggcttcatgagaacaaaggcaggcccaggttataattacagctttctcctgccccttctttactttctctaccacagttttctccactgtttgttttcctcttgccacaatttgctaacatttaaaaaattttcctgcacccagtagtttcatatcctgtagacatcctcttaggacattctcaaatttcaaaataaaaaatattcatctatgtagttaattaaagttaaagtttttgcagatcaactactcaaactactaaatacatttacctgagaaaaaagtctctgagagcacttcattcctgttttagttcgtgtaaattctctgagaatgttctggagatagatactcatttacagtggtttctattaactaattaaagtacccatgattttttccttttctgctcagggatgatggagatttccttttaccttttttaatgtttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatataactagaataatttttttcctttcttttatggacctaaatctgccaattgggaattttgtgcatgaaatatgaagttactttttatagataatcagtgcttttaagtccctaaaaggctcctgctgaagtaatgatgatgttaataataaaagcctttgaaaggctgaaaacctacatagtggtaccatagtatttggagcttctataggagtggagaggggcagctcattgttgagagttgcatgctgcaacctaatggtcagcaatgaaataaatacttgtagaatgttcactcacttcagtgtgaagttttgttatctagttaatttatatacatatatcctttgtagatacatttctatctaatcttgttgagctaattaagaaataaggggtggggtaattgtcaacaaagggagaagaaagtggtttaagatcagggcagcagaaaaattagagaacaaga

SEQ ID NO: 117964 - DNA, 298 bp, Homo sapiens
gattacaggtgtgagccactgcacctggccaactcagaacttttaatttcctacctcagtactttgatggccatgaaagaaatggtcagttttcttcatcattctagatactttcattcagaaaaccaagaagctctacattgacagttgtgcttgaagaaacctaggctccatcaacactgaattgcaagatgtgcagaggatcatggtggccaatatcgaagaagtgttacaacgaggagaagcactctcaggtatctaaaagcaatgagtcttatgaagaaatggttctcattcc

SEQ ID NO: 117965 - DNA, 379 bp, Homo sapiens
cagagtacaagatgaacctggaacttcttgttctagacagtaaggaattactcaaataatgatggggacatgtcaaaaggacacaggaaccagctggcaagaactcccactatctaaatgtggagagatctgagcatcaaaataatgatggtaacagactataacccaaataaaataaaaatccatcatccaaactgatgaggatttatggattaagtcaaataaagagtaagttgaaagtttatggaaagcagtctcaaagtacctgctcaaaacacacttattacaaagggaaaaagaagaataagtttaagtggggaagcctggcagatgctgccttatcaagtgatcaaagttaacaccaccagcaatgggacaa

SEQ ID NO: 117966 - DNA, 833 bp, Homo sapiens
gttagaaagaatgctgtgatttacctataggcaaaagtttaaatgccttaactgtagacaaaagttaaaatatcttacttttttaaaaatttcattgccaaattgctttcccaaagaattgtgccaatatgtgaacatggccatttcattctaccttccccatcgttggttttttttttaattgcttgctattttaatagtgaaaaatgatgtcacatttttattgcatttctcaattacgtggttggccatattcccatatattaatcatagtatttggtatcttgtaaacattctttttatgtcctttgcccatttattcattgagaattttaagatttttttctcatccgttttatgagctcctgattaacaacctcctttatagcatcttatttgaatatttttatcaggctggttgtttcagcataatggggatttggtatagaccaatctattgataatttcttggtgatggtctttttttctaattaaatagccttccacctgaagacttacaaatatttttaaattcttctgctggttttatgacttcctgtgtccatgtttcctttcacttggtcagtgtatcacatgaagtgagtgttaaactggaactttttttccaatttcctcatctcatttatggagtcttttcctttccccttgggtttctgattttctttccacagctaacaatgttcggagaatttacctgtgtgctaggcacctgttctaaacactttatcggattatctcatttcttctcacaacaaccctgtaggaaatagaggccagaaacctaattgctgaagtgacacagctagtaagta

SEQ ID NO: 117967 - DNA, 542 bp, Homo sapiens
gaaaagattgagaaatcggatggttgccgtgtctgtgtggaaagaagtagacatgggagacttttcattttgttctgtactaagaaaaattcttctgccttgggatcctgttgatctgtgaccttacccccaaacctgtgctctctgaaacatgtgctgtgtccactcagggttaaatggattaagggcggtgcaagatgtgctttgttaaacagatgcttgaaggcagcatgctccttgtttctttgttcacttgtttatctgctgaccttccctccgctattgtcctatgaccctgccaaatccccctctatgagaaacacccaagaataatcaataaaaaaaaaagaccctgtcccctccaaaataaataaataaataaataaataaataaataaataaaaagactgagatttgctaagcacaaagttctttgattatgacacaaacccactgcatgtgtagtattcatctggactgagtacaaacaagatgctcatgctgtgtgctgtgctgtgagtaataaagtcctttgtctctga

SEQ ID NO: 117968 - DNA, 542 bp, Homo sapiens
gggttatataaccttgcttgacattagtttcctcatctataaaatagggatataatggtatctacctcattgagatgttaggggaattaaatgagaaagtgtgtggaacgtgcttagcacaatgccagacattattaccatgatagagcagttgatgaccttccaaaggcatttgagagcctcagggatatggaaaagggcagagaccagtggattgggcaaaaaagatgttttaatcacctcctattcaccccatccgaagagagagggatttccactgtagggttatggggatgctgaacacatgacacctgacagtggacagatgagcttgacagctgtagtcacatatactcacagcctggaagctgggataccacacaccacgtaggcccacacgggagctgcactcgagagcagagtaagccaccggcgaggggctgtgggaagcagcctttgtagtgtcaagagcggatggtgccccctggttctggccagaggatatgattggcttgtttgaataattccaggggctggctggg

SEQ ID NO: 117969 - DNA, 441 bp, Homo sapiens
tttcactgtaccttgaacatacatttatatcatattttgtgctttcatgtctgtgactggcagatagtctagaaatgactgctaaaatgaacaaagaacatttagatctgtgacaacttacaaatggagtgaagcatgacttctctatgaccaatttattatttctggaggaatatgaagaaatatttagagcatgaatgtaagcacatgctaccctccatttacctgctttgtaggatatattcctatgaatattactaaccacagaaaggttatatgaaaatgaaaagcattaagcaggcccacaacaaatggaggttattttttcacaaacttacctatagtaactaatttaagttacttcaaatttcttttctttttttttgagacagagtcttgctctgttgcccaggctggagtgcagtggcacaatctcggctc

SEQ ID NO: 117970 - DNA, 250 bp, Homo sapiens
gttttgactatgtttcagggaatctcagtctttgaggagattttaatctcacatgcaaattcagtggcttagtcagcttccccaccctgcaacttcttcctacaaacttcctagaggaagaccatcagcctggagactattcgctgtaaagattataacggtgagaataagctctaaaataaaacttcttgttgtgctttacctgacttttctgaagcaaggacacccattctcccagaaaacccaaagg

SEQ ID NO: 117971 - DNA, 412 bp, Homo sapiens
ggtaccagttcggaccattgacagcctggctaattttttgcatttttagtagagacggggtttcaccgtgttagccaggatggtctcgatctcctgacctcgtgatccgcccgcctcggcctcccaaagtgctgggattacaggcgtgagccaccgcgcccagttgaaatgagggtattctctaagaggcagatgacagaacctactgcaatgaatttgtcaagctcaaggctaaggacacagtccctccacaaggcagccttcacttcaaatgccaggtgcaactggggattcctgggccaccctcacttctgaccgcttggctgcattgagggttcccactaccccctgtggttcaataattcactagaatgactcatggaactcaggaaagtgccccgcctcataacga

SEQ ID NO: 117972 - DNA, 739 bp, Homo sapiens
gtccatgtgtacccattattagcttccacttataagtgagaacatgcagtatttggttttctgtttctgagttagctcacttaggataatggcctccagctccatccatgttgctgcaaaggacatgatttcattctttttttatggctgtgttgtactcattttttaattggattgtttgtatttctgctgttaagttgcaagagttctttatatattctggatggtggacccctgacagatagataatttgcaagtatagaaaaacacccattctgcagactgtcttttcactctcttgatagtgtcctttgatgcacaaaaggttttaattttgctgaaatacaatttatctatttttccttctgttgcttgtgattttggtgtcatatctaggaattcattaccaaatccagttcatgaagattttcccttatgttctcacctgagacacttataaatagttttagctcttatatttaagtctttgatcagtttttttagttaatttatatatatggtgcaaggtaagggtcaaacattattctctgtcagaattccagtgacttttttttttttggcagaaatggaaaaatcgattctgaaattcttacggaatctcaaggaatcccaaataatcaaaataatcttgaaaaagaaaaagttggtggactcacacatccccattttacaacttacaacaaagatttagtagtcaaaacagtgtaggatataaaaa

SEQ ID NO: 117973 - DNA, 661 bp, Homo sapiens
ggctctgtcctccagcgtgtgggctctgtgttttctctctctctctctcactcacacacacgcacgcacacacacacacacacataggaagccaggctcccctctgccctcagccactcgtggttcacaaaaatggcaaataataggagcactagaataggagctctccatcctggttcgagtctttccagctggggcagtttagcctttgcagaatttctcaagggtaacatcagcataatgacctctgtctgtaagcccgtgagtgtaagcctgtaaagtgctgtgctcatgcgagggatcaggtctgacctgggaaactaaaagcatcttcatggagcaagggtgctcctccagtgggggcgctcagtgagttctgcggtatgggtgacagtattcttgtgtggacagtattcatgtggtgattggggtaaatggccctcttttgcctggttttctgcctcggtcattgtgcatctgctgactgaacctgccttttggtcctagtaaagtacagatttcaggaaaagtgtacctggccccgggggtggccaacctctgtgtgacggctttaagcacagtgtgtcttgagggggcctgactccatctgaaaagtgcctgtctggatgtacctgtctataaccatggacctgcctccaag

SEQ ID NO: 117974 - DNA, 337 bp, Homo sapiens
agcggagggaagccaagggaagaaaattgcgcagttagttggctttttacagcacttacaggcaagcaggccttgggagtacaatgtgcccacaatgaggggcgttcagagcacaaaagagcagggatcgtggggctgtagccaggggccacccccgatctcgctcaagctgcctggcccctcctagctcgttcattttaacatcacctttcgctctggttggggcacctttcggtgagcagcggggttttccctggagctgtgccctggctgtggcccggccagtttccaaggcctggttttcatttgctgagagctgcttcccgcagacagctcc

SEQ ID NO: 117975 - DNA, 571 bp, Homo sapiens
ccactagaggatccccccctggtatacccaccttaagactggatagtcgcacctttcccaggctctcataatgcccagtatttttccctacggtaacaccatattctaccattccccattagaactgagcctctagcataatacttgcttcgttgcacaggctaaataaataaaaaataaaggaatgactcttcctttataattatgacaagatatatattttggtaagaggggaaaaaattatgtaagtatttattggctccaacgtagggtttctacttcttatagaatttccagtggaatatatatataatgctccaggtctccataaccttttactcagagttctgggtaggatactctgaacttttaaagcatcctcagatcctcagggaacatagaatagggtatcacttctagatattcaactctaaaagtctgcctaagagtttttagaaaatacagaattgaagtcaatttttctctttttttttttttttggagacagagtctaggctggagtgcagtggcacgattccagctcattgcaacctccacctcccgggttcaa

SEQ ID NO: 117976 - DNA, 233 bp, Homo sapiens
tcactgcctccacagttctgtcttttccaggctgtctgtagttggagtcccagtgttgcaggcttttcagactggcttcttccacttcacaaccagcatttaaggttcctgcatgtcagttgggcacggtggcttacataatcccagtgcactgggaggccgaggcaggaggatcacttgagcccaggagttccagatcagcctgggcaacataacaagaccctgtctctacc

SEQ ID NO: 117977 - DNA, 728 bp, Homo sapiens
gcaagtttctacaaagttacaacagtggggaggcgccacaacttcactgccattttgtgaggtgctgccgcccctcctccggcaaggaaacaatgaccgataaaacagagaaggtggctgtagatcctgaaactgtgtttaaacgtcccaggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaaacgatttttttgaatccatcatcaagggaagcagcaagatgtattgagacgagactttgttaagcaccttaagaagaactgaacgtatgatttgagaatacttggtccctggaggattatcacacccaaatgcatatctcattaatgattgaggagagaa

SEQ ID NO: 117978 - DNA, 440 bp, Homo sapiens
cattgtctactgtcctgtggatggaaggctagactgacagcttgcctgcaagggctggacttcctgatgctccaaaattgaaatataacaaataaggatttggctattgaatttcaatttcataagaaaatgggacctgtaagagggagagaacaaactttcactgtagcccaatgagctcgtccttggaaaaaaaatgggcagctgtgtttgtaaggagtgttggattggcaaaagagtaactgtgaatatctctcaagcagcagaaaattacacatgaatatgtaatttattttttataaaatgtctcttagcttataagtttagattacaagttcagcatttagtattcaaatcttcaattgatgaaacttcacaataacgtttttcatcaaacttctggacttgggcactggacagtgtgtttataatctactttt

SEQ ID NO: 117979 - DNA, 217 bp, Homo sapiens
gctcccccttatccagtttcatttttacgatttcagttatctctagtcaaccacagtccaaaattatggaaaactacagaaatagtaaacaattcctaagttttaaactgcctgcagttctgagtagtgtgataaaatctcacaccatcctgctccaacacttgatctcatcatgtaggcattttatcatcccctatcatcccaagaagggtaaata

SEQ ID NO: 117980 - DNA, 531 bp, Homo sapiens
aggtgactcctgcgcccatctgtggtcctggtgatgcgtccattgctgtggggtgcccaccctcccatggctaggagtgggcacatagattgactgggccaactggattctgtcccccagagttttggatggagagaggcccagagggaaaagcagctccgattcgttccttctgtgcttgtgcctgagaaaattgcgctgtgccctcgcacctgcctcggttcctgtctgtttctgaccctggttcttcttccctgtgtaggcttctccgggtctgttaatctcccaatacttgctaacattacaggtctgtttcccgtgtgtcttctctgagccttgttcacattgatgtgcctgacgaatgtctaacatattatggcatgcagcagaagggtgatctagcagacctcacaaacctagagttgtccaggtcagacaggaagataaatagcggtggctgtctgcagtgttagtacggagagctgggggctggagccaaccggagatgtgtgcctcatcaaaggggacatg

SEQ ID NO: 117981 - DNA, 497 bp, Homo sapiens
agcccagactttgggcagtgtatatgtgggagttggcgggttggtggcaggaaccttcctggaagcagtggtttctatgttgagtcctgtaggatggggaggagctaagaaggcatcagcagacaggggttgacagggaagggatgtgctctgcagaggacggagcatggtcagaagccccaggcagacatcatggggagtgtgagtgatgaggctagagtgaataggggcagggtctgtgctgaggcttggactttattctcagggcagtgcggagccactgaaatcttggatgtcggggagtgacatgattggatgtgcatggtcttaaggccaccctgatgtcatagcagggaatgggtcagagagaggcaagactagacaggccgtgggagcagttaggagaccattgccatagcccaggtaggagttgatggtgacctggatgaagtaggtagcagtggggacagtgagatgcaaaaggatttgggagctct

SEQ ID NO: 117982 - DNA, 664 bp, Homo sapiens
ctacggagcctgaagatgaggctttaattgctgtcagtgtttatgatttagtaggacttggtgtcctttttagacccagaagtcaaagccatgtaactcaatggcacaggtactttgaacatatagaaagatacatgaatgttaataaccttaattaaaaatttttttttttaatttcagcttttttccccaagcaaaccaaactgaatcataatagcatagaattgtttcaataaaccataaaatatgttagaccagttactaaaaggcaacagaaaagacctgcactgccagaatattatgttggaagaaaacatttcctttggatattcatgaaaacattgttagcatcaggccataacaaacagaacttgaggaaaaaaacttaatatgagctgaaaatgagttgaaagagagtgttacaatttcacaccctttaaaaggagagagaaaactaaaaacagtgagatgcaataaaagttgaagtttgggttagaaaaaaattaaaatctcttataatttattaaacgtgaatcaataacttaagaaaatgtcattgttttaaccagtgatttagtgtgtgtgtatatatatatagacataattttttttacatcaagtccaatcatctctagaaagaccattttaatttccctttaattat

SEQ ID NO: 117983 - DNA, 160 bp, Homo sapiens
aagcggccctacctctgcctgaagagagagactcccacctcaacagccagctttctgccttctagtcacgcctctcaattaggggtaaaaagaggggtcttcttgttttttgtagtggggggtgtctcactgtgttgcccggactgttctctaactcctg

SEQ ID NO: 117984 - DNA, 218 bp, Homo sapiens
gcacgagattggctaaaatattagtcatctttggttacaagttgatggctgagcagtttttcattccacagtgttgagaaactagactggaatcttgagctgataaaccagaatgcagatgtggtagatattggagtcttggaatcagcagacccatgccctagttctggctctgaactcattcaacttctacatgatttctgagaaacccgtaatta

SEQ ID NO: 117985 - DNA, 297 bp, Homo sapiens
gcatggtgggtgacgtgtgcctgtaatcctagctacttggaaggctgaagcaggagaattgcttgaacctgggaggcagaggttgcagtgagctgagatggcgccattgcactccagcctggtgacagagcgagactccgtctcaaaaaaaaaaaaaagaaagaaagaaatcatgcagctgatagacacagcgcattgtgactttcttctaccttggccagtctggagcagaacacagccagtccctcatgcagggtccgcatcagctctcattttccacccacacatttctaggtg

SEQ ID NO: 117986 - DNA, 209 bp, Homo sapiens
gttactctgggtgtagagagaggccttgcctaaaatccaaaattgtcgggttccttgattcttaatgacattagcaaaatcagttctgaaacaccactctccaagcaaagtttggatcaaattaacatttcatctctccttcagccagttactaaaaaaggcattttcagtcttcacgtacaaaccccaaatataagtgccaatggata

SEQ ID NO: 117987 - DNA, 846 bp, Homo sapiens
cattttcttaaatttgtgatgaatttctttgccatgtattcttttcacattacagcagtttctcaaaaaacaattccaattaaccaagggaaatatatttagtaggattttaggttattaagattttattgtaccatgtaatttgctgcaacttatatatttattgctgaatgattatagtacatttttctcaatgtagggcattgagtatttctagtattttgcttctctgttttgaagagtaaagttaggttaagaataatggtcatttttttgccgccatttagttgagataatagcttctttactcttttggtgcatgtttgggatggaaggaaagctatgaatcaaaacatacatagagaaactataatgtgtgaatcacagttgaatatatgttggatgattaaaaaaatacatagacacttgacccagtttctcctaatggtaacatcttgtaaaattatagacaaatgtcacaaccaagatactgatgttgatacaacccaccaatcttactgtgacttctgcagttttgcttgtacagtaatttgtgtgtgtgtgtgcatgtatttttattcaattttatcaaaagtgaagattcatatatctgccaccacagtcaagatatggaacagttatataccacaagaatctcttgtgttgccctcttaaaaccacacatacttttctctgtcccaccccacccatccattcctaacccatagcatccatgaatctgtttttcacttccaaaattttgccatttcaaaaatgttataaaaatagaatcatgcaatatgtaaccttctgggatcggccttactcagtgtaattctttcaaga

SEQ ID NO: 117988 - DNA, 756 bp, Homo sapiens
atgcgcgggctcgggccttcccggcatctccgcgcaggcctcggggaagcggggtccgggggagccgtggtgcggtgggaccgcgtgggtcctggaagagctgcagaggagagtgacggctttggatgcgctttgccccagggcctttcttcccggagttggccttttccctgcccttctcttctcctggcgtggtgacctgcctcccttctcctggatcgctttgctggcagccaccttgtaacacctcagactgcagcccgtgctgatgactgtggctgtgatgaattcgtgcctgtgaccacagctgctctccaggtgctgggtggctcctcccttgacgcccatccattctgtctcctgcctggccttgttcactgtcgctcatctcgctcagctgaggtccctcctcctccgctgtttggtgtccttgccagttaatcacccttaggtgctgggccctggacttacggacaacatggagcctggcttgttgacaggacagtgtctgcgcctctccgtctacacccccacaacaggggttactggggaggcggcgtctgggagtgacagagatcgctgtggggtctgtgtgaccatcagctgtccctgtagctggggaatggtgctgcgcggcgggcgggtggcacagtgagcagccctgggtcctcactgagtaagggagtggctggggagtggggaggcttgcctttgtatcctgggtgggcatggggctgggggagtcacggagacctg

SEQ ID NO: 117989 - DNA, 337 bp, Homo sapiens
gcctggaaactgtcacaggattgcaggacagccaaatgctgttgggtggctgaggaaaaaggagatagttcaaggactaaactcagccaatgtggcttaggtctgcttatgaattgtaaggccagggccactatgtcattaactctgaaatgaacaagcaggtgtccctggacctgcatgtcaagcatcccattgtgggaaacaacctcagactgggcgtcaggatgtcctctcaagtcaatactttccctctctggacctctgcttcctgcatcataagaaatcagagagtactagtccattacccacttttttttttttttttttttttttgaga

SEQ ID NO: 117990 - DNA, 108 bp, Homo sapiens
tcaaaatttccaatccttcagtggagccaatctaaggaaaggaaaagcaatttgactccatttgtgcatttatatatgaatgacccttactgaccattccagaggtgc

SEQ ID NO: 117991 - DNA, 247 bp, Homo sapiens
gtttggaggctcaaatcattaagttggcagtagaaatatgaatagaaactcagctggagagttgactcctcgcactcctgtttgtcttgactgtgcctcagatggcgtctcgcgcccgtttggttttgtctttcacagacgtttgccagggaccatgtttttccatctcccctctgttttaacacagcgccttaccaatcacacaccaaattagtgcagtgattttgtgagcgtggagagagtaaat

SEQ ID NO: 117992 - DNA, 411 bp, Homo sapiens
gcaccagtgggcactcttaacagtcattattactcagtagttattagtaaatcagacaaaattgccatcttagttttgagtgtctaaattaggtgataatggttattataatttggttattttgcatgactcaagctagtaagtaaatacactctgtaatctcaaccaattttttaatttgttaaatactatcattgtcaatatcttttttcatttgcttcagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaaggtatgttttggacagggcattgttaaaggataaacagtgtttgtt

SEQ ID NO: 117993 - DNA, 818 bp, Homo sapiens
atcgtggggggcagcgcggcgccgcccggggcctggccctggctggtgaggctgcagctcggcgggcagcctctgtgcggcggcgtcctggtagcggcctcctgggtgctcacggcagcgcactgctttgtaggcgccccgaatgagcttctgtggactgtgacgctggcagaggggtcccggggggagcaagcggaggaggtgccagtgaaccgcatcctgccccaccccaagtttgacccgcggaccttccacaacgacctggccctggtgcagctgtggacgccggtgagcccggggggatcggcgcgccccgtgtgcctgccccaggagccccaggagccccctgccggaaccgcctgcgccatcgcgggctggggcgccctcttcgaagacgggcctgaggctgaagcagtgagagaggcccgtgttcccctgctcagcaccgacacctgccgaagagccctggggcccgggctgcgccccagcaccatgctctgcgccgggtacctggcggggggcgttgactcgtgccagggtgactcgggaggccccctgacctgttctgagcctggcccccgccctagagaggtcctgttcggagtcacctcctggggggacggctgcggggagccagggaagcccggggtctacacccgcgtggcagtgttcaaggactggctccaggagcagatgagcgcctcctccagccgcgagcccagctgcagggagcttctggcctgggaccccccccaggagctgcaggcagacgccgcccggctctgcgccttctatgcccgcctgtgcccggggtccca

SEQ ID NO: 117994 - DNA, 109 bp, Homo sapiens
ctccttctgtcaattctgtacagcagaggatagccatactgcacttctcaaaaacgttagtgttttcttcaataatgcatgcctccttggatgcagaaacccaggtatt

SEQ ID NO: 117995 - DNA, 810 bp, Homo sapiens
agaatgaatatggaaggtacttgaccgcatcagagggatttggaagcaggccttaaaaagcttctgctttttaatatggtgcttctccaggtgtgatctggggagctccggtcatcctccagcactttcaaggggtcttgggggtcaaaaatcttatcaatatggagacgttactggcctttttcactctactttcacaaatgcattgtagagttttccagaggtggtgtggcgtgtgagataagaacggactggatacagaagcagatgggggctccagcggacccctatcaagccagaccctaaagagatttttagaatactatgcagtccagattttccatgatgccacaaagcatggcaaattcgagtgcaacctggaagcctgcacgagactgcccatgatgtacattgacgactgcctcagagccaccctggaggtcatggaggccccagctgagtccctttccatgaggacctacaatgtcagcgccatgagcttcacacccgaggagctggcccaggaggtcctcaagcacgtgccggaattccagatcacatacaacgtggatgccgttcgccaggccatagcggatggttggccgatgaactttgatgacagcaatgctcggaaggactgggggtggaaacacgactttgatcttccagagttggtgactgccatgttgaacttccatggttctgaaagcagagttgcccaagccaactgaaagaatctggaagaggagctcctgtgtcctggtccactgtcaagggagaactgtcacaactccaaggttatagactcca

SEQ ID NO: 117996 - DNA, 700 bp, Homo sapiens
cgaggtggctcacgcctgtaatccccacactttgggaggccaaggcaggcaggtcacttgaggtcaggagttcgagaccaccctggccaacatagcgaaaccctgtctctaccaaaaatacaaaaattagccaggcatggtggtgcatgtctgtaattccagctacttgggaggctgaatcaggagaatcgcttgaacccggaaggcagaggttgcagtgagccaaggtcgcaccactgcactccagtctgactccatctcaaaaaacaaaaaacaaaaaaacaccacattattttccagactacaatctactacagaatatacaccaaacatactcatactattgggggcggggtacatgtggatgtgactgaacatccagactaccatttaaagtggaaactataacttgagcacccatccaaaaaggaacatattcagaataaggaaaggagccctggatgaagattaagattttgttctaatcctgacactgctgacaatgttaaacaataccttactcctctctctctacgtctgtttacttatttgtaaattgagaggtgttgggataaataatcactaagatccatttgagacttcctttactttttccctccttccaaactagaatgttgtcctagaaaccaaaaaccgttcctagaaaaccaaaaactacagcatcaataaatgtgagaac

SEQ ID NO: 117997 - DNA, 217 bp, Homo sapiens
gcctgcaggcagcagagtttgaaaccatatttctgtttcatgtgctgtagctcctgatgtctagagccacagcccctgtgctagttacagcaaccactgtccagttctgttgagcaccagccagttctacccagcctttgaccgacatgaagctctctcagagcccctggcccagcccttccctcttcatacctgatatttaactccttctgtttag

SEQ ID NO: 117998 - DNA, 430 bp, Homo sapiens
ggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctctggtgcaaagggcagtgatggcccttcaatcccaggcccacaagcaccacagccaggagagtcaaggttggatatgaagagggacttcctgaaagcaggcacaggaagggatgggagctcagctcaccgggtgctagacaagggagtgtgtctctttccccatgagtgacagcagccacaaggggatgcccagcattgggggtggggtgggggga

SEQ ID NO: 117999 - DNA, 506 bp, Homo sapiens
atatcttaagactaggtttaagcacttctttaagttactgaggggacacgcttccctcttccctctacggaggctgctgctatgacttggtgtcaggctccaggaccagccctgaatggtgccaagtcggatagcacagaggtgggaagagagactggcaggtgtgcaggataagcagagaactcttcctcccttacctcatctcagtatggaatttaacagcatttagcagagaatgtcatataaaaagatgacacgctgcatgtgaaaaaaaaaaaacaagcattttcaaattgcggaagaactcgctctagaatgacgctcccttctgtgctgcaatcatctattcaaactgtcttccaaaagtagcatcgtcgatcatttccatcatgatacaaagtggtaagaagtcactcactatctgattccaacctcgattcatgccactgcctgtgcttggtatctgctcaacagcagctgcaaattattctcaaagggtacagcgt

SEQ ID NO: 118000 - DNA, 1014 bp, Homo sapiens
caccattttcctgatgccaaactgaggctcagagaggtgaagtaacttcttcaagtcacaacacaactgttgtccaggaatcaggcagtctggctctgctaacccagttttacccactgcattaatgtaccgcatccacttgttcactcagtttcacctgacaaatactaattttgtctctctgtggaacaagttctttgctgggtgcagggaataaagcagaacaccgttcagttcctgccttcccaacgcttgtaaatctagtgcaggtcattcatggccgggctgcagggtgtccatgaatcctgctaaaatcatttgcgaaatgttgtgagcgtgggtcttttcttctggaaagagagtctgtgactctcaggttctgagttgatctgtgatccaaacagaggtgtgaagaagtgttgttttagcagatctgtgcctagtatgcctgatacacagcttgaacttcaaacaaacagcaacaaaattcctactggttggaagaatgaagaacttgtaagagcataataagtgctgcagtagcgtccggagcagggtgctgtggaagagcacacagaaggccacctgcccaggaatgcctcctagaggcagtgaaggcagctgggtgaaggatagggaagcagttcattggaacactgtggtgaccagtctgtccatgtagtgttgagacagaaacaacacgtgaacagctgcagctgttgtaccacttgtgcgcaagtgtaaaagtccatggtgccatgaaatcatgtaatggggacaggaggcttcatgtattcgtgaaggttagaaaagtttccttgagaaagtgacacttaggcctaaaagttggagcattttgggcatggaatctggcccacagtcttcaaagaccacatggtagaaaccagtagagcaccagggactgacaggaagcaaatgcagctggtgcaggagagggaaatgggaattagggtggtggcagagcccaaagaggccttgtaggccatggtaagg

SEQ ID NO: 118001 - DNA, 312 bp, Homo sapiens
atgaacttgttctgtagggagcatctggtgaaaaggaggtagaaagttataattgcacttccagagggctaagtaggaagtggggaagaaggggaaatggagaaaaaagaagagaaaataatttttaaaaagtaacttactctctttcacttagaaaaatgggggtactcggttatacttccaccccctctccattagaaatacaacttaatccaaacaaaaaaatcaccacatatacagcaagtaaattccatgtgaaggtcctcatgctttattcatgcttttggaatgggaagagcaattgtaacattt

SEQ ID NO: 118002 - DNA, 593 bp, Homo sapiens
gcagtggcgtgatctcggctcactgcaaccttcgcctcctgggttcaagcaattctcctacctcagcctcccgagtagctgggactacaggcacgtgccatcgtgcctggctaattttttgtatttttagtagagatggggtttcaccgtgttagccaggatgatctagatctcctgacctcgtgatccgcctgcctcagtctcccaaagtgctgggattacaggcgtgagccaccacgcctggcaactctctattgttaatacagtcataaccagaataacacttctctgcttgcttagttattcagggacttcctttgcttaactttgtacttatagtacatgtaaagattacaaagtcaactgtgctgcttgcaaagttcctagattttttttaaaaaaaatgaaatctggattttaaaagatttataattacactgttcaattttcctttgcattttgaaatatagcattaatattcccataggctagagggaaatctgaagaaagttttcttgatatgaagagtgaagggagatagttcactgtacttcatgaaattttttttaattctgatgaatattacaacttgg

SEQ ID NO: 118003 - DNA, 438 bp, Homo sapiens
agtaggaaaggcacagtcatgggagattatgtgatccttggatccagcttgaacaaaagtccccagagaatggcttgatcaggggagaagacattgagaaggatgagaacaacatcgctccttctaaattaagatgatgtaatatggccatggaccctgctaaggtttaatcagcacctgacttttagttgtgtccacacaatggagtctgaccattgggttggtggtctcctacgtcatgaagaatattgagaaatggagttaacagtttaccagaaaaagacagtctttacaaacacctgagtatgtaccaatggctggctctttcctctgctctaatacactgtctaggccagtcattcccaaacctgtctgtgcattggaatcaccagggtagcttcaaaacacactgaggtctgagtctcaacctgagattag

SEQ ID NO: 118004 - DNA, 2021 bp, Homo sapiens
aggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaactccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacacgcaccaccgccatcacctacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtactggcacctgacacccatcactccatgggccatagtccctgtgt

SEQ ID NO: 118005 - DNA, 3225 bp, Homo sapiens
aggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaactccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacacgcaccaccgccatcacctacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtggcgggcccggcagctggtgaagaacatccccccttcagacatgccccagatcaaggccaaggtggccgccatgggggccctgcaagggcttcgtcaggactggggctgccgacgggcctgggcccgagactacctgtcctctgccactgacaatcccacagcatcaagcctgtttgctcagcgactaaagacacttcgggacaaagatggcttcggggctgtgctcttttcaagccatgtccgcaaggtgaaccgcttccacaagatccggaaccgggccctcctgctcacagaccagcacctctacaagctggaccctgaccggcagtaccgggtgatgcgggccgtgccccttgaggcggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtcagccctcctgctcgccgctcccgcctcacccgcaggggctccggccgcctcctcggtcaggtccacctgc

SEQ ID NO: 118006 - DNA, 1587 bp, Homo sapiens
aggggtaggagcagagggtccccaaacagcacgtcgcaaacatcgatacaagcaggaaccagcacgctgctggcctcaagacaccaaaatatctgggaagacatgtgtgtgagcacatgcatgtggggacatacaggtgggaacatgggtatgagggctgtgtgaggacatgtatgtgaggacatgtgtatgggaagacatatgtgcacaggtgtcataagtgctccaggaacacactctgtatccctgccatctccccaggtgtggggtgggcagggtgggctccatcatctctcccccaggcctgggccacactgccctgtcctgtggtgacaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtggcgggcccggcagctggtgaagaacatccccccttcagacatgccccagatcaaggccaaggtggccgccatgggggccctgcaagggcttcgtcaggactggggctgccgacgggcctgggcccgagactacctgtcctctgccactgacaatcccacagcatcaagcctgtttgctcagcgactaaagacacttcgggacaaagatggcttcggggctgtgctcttttcaagccatgtccgcaaggtgaaccgcttccacaagatccggaaccgggccctcctgctcacagaccagcacctctacaagctggaccctgaccggcagtaccgggtgatgcgggccgtgccccttgaggcggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtcagccctcctgctcgccgctcccgcctcacccgcaggggctccggccgcctcctcggtcaggtccacctgc

SEQ ID NO: 118007 - DNA, 2789 bp, Homo sapiens
aggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaactccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacacgcaccaccgccatcacctacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggccactgacaatcccacagcatcaagcctgtttgctcagcgactaaagacacttcgggacaaagatggcttcggggctgtgctcttttcaagccatgtccgcaaggtgaaccgcttccacaagatccggaaccgggccctcctgctcacagaccagcacctctacaagctggaccctgaccggcagtaccgggtgatgcgggccgtgccccttgaggcggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtcagc

SEQ ID NO: 118008 - DNA, 515 bp, Homo sapiens
agatgaaggatagctatgctgattcacagacagctgctatcaattgagtctggtcccatgactcaatcccaagcagcgccccctcccctccatctgtcctcaggccactgacaatcccacagcatcaagcctgtttgctcagcgactaaagacacttcgggacaaagatggcttcggggctgtgctcttttcaagccatgtccgcaaggttagacaagggacaaggatggcttcagggctgtgctctttttctagccacgtctgcaaggttagaagctggtgcagagttttgggggggcacttgggagaaaatggaggcaaccccagcccaggcccagctgctcctgacactcccaaaactgtcgccagcggggaggggaggcagtagggactgccgaagcctggggccctggtgggtgacagggcagcaccagcctgggtccagccacctctcccacaggtgaaccgcttccacaagatccggaaccgggccctcctgctcacagaccagcacc

SEQ ID NO: 118009 - DNA, 501 bp, Homo sapiens
cgctccccgggtgcggttgggggttcggcagaggcttcctggggagggggtgagtccggctaggctggggtgcgggttgaggcggctgcactctgaccccgcgctccgctcaggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtcagc

SEQ ID NO: 118010 - DNA, 3158 bp, Homo sapiens
aggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaactccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacacgcaccaccgccatcacctacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtggcgggcccggcagctggtgaagaacatccccccttcagacatgccccagatcaaggccaaggtggccgccatgggggccctgcaagggcttcgtcaggactggggctgccgacgggcctgggcccgagactacctgtcctctgccactgacaatcccacagcatcaagcctgtttgctcagcgactaaagacacttcgggacaaagatggcttcggggctgtgctcttttcaagccatgtccgcaaggtgaaccgcttccacaagatccggaaccgggccctcctgctcacagaccagcacctctacaagctggaccctgaccggcagtaccgggtgatgcgggccgtgccccttgaggcggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtcagc

SEQ ID NO: 118011 - DNA, 3507 bp, Homo sapiens
aggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaactccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacacgcaccaccgccatcacctacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtggcgggcccggcagctggtgaagaacatccccccttcagacatgccccagatcaaggccaaggtggccgccatgggggccctgcaagggcttcgtcaggactggggctgccgacgggcctgggcccgagactacctgtcctctgccactgacaatcccacagcatcaagcctgtttgctcagcgactaaagacacttcgggacaaagatggcttcggggctgtgctcttttcaagccatgtccgcaaggtgaaccgcttccacaagatccggaaccgggccctcctgctcacagaccagcacctctacaagctggaccctgaccggcagtaccgggtgatgcgggccgtgccccttgaggcggtgacggggctgagcgtgaccagcggaggagaccagctggtggtgctgcacgcccgcggccaggacgacctcgtggtgtgcctgcaccgctcccggccgccattggacaaccgcgttggggagctggtgggcgtgctggccgcacactgccagggggagggccgcaccctggaggttcgcgtctccgactgcatcccactaagccatcgcggggtccggcgcctcatctccgtggagcccaggccggagcagccagagcccgatttccgctgcgctcgcggctccttcaccctgctctggcccagccgctgagcgcccgcacccgccgcaccccgaggccgccaattgtccgccccgccagcgctgcaaataaaccttctgagtcagctcaaaaaaaaaaaaaaaaaaaaaaaaaaaaaaaaaaaaaaaaaaaaaaaaaagggggggaattgggggggaaaaaagtgttatgagagggcatgtaggtaatacgtgatttgggcccgaatttttgtaaaggggagaaatggggagcacccaatgagggataaattgaacgcgggttctgttttttgagtgtaatgagatgatgaaaaggaataaggattaaagcacataagaggaaggaaggaaaataaagaaaataagagagaagatgacattgagaaatatagagagtgataagtaagaagggatagaagataggatgaagtaaataaaaatgaaataaaatcatg

SEQ ID NO: 118012 - DNA, 2208 bp, Homo sapiens
aggcaaggtgtttccagccggcaggatggaggacgaggaaggccctgagtatggcaaacctgactttgtgcttttggaccaagtgaccatggaggacttcatgaggaacctgcagctcaggttcgagaagggccgcatctacacctacatcggtgaggtgctggtgtccgtgaacccctaccaggagctgcccctgtatgggcctgaggccatcgccaggtaccagggccgtgagctctatgagcggccaccccatctctatgctgtggccaacgccgcctacaaggcaatgaagcaccggtccagggacacctgcatcgtcatctcaggggagagtggggcagggaagacagaagccagtaagcacatcatgcagtacatcgctgctgtcaccaatccaagccagagggctgaggtggagagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaagtctcgggtcctcaagcagcacgtgggtgaaagaaacttccacgccttctaccaattgctgagaggcagtgaggacaagcagctgcatgaactgcacttggagagaaaccctgctgtatacaatttcacacaccagggagcaggactcaacatgactgtgcacagtgccttggacagtgatgagcagagccaccaggcagtgaccgaggccatgagggtcatcggcttcagtcctgaagaggtggagtctgtgcatcgcatcctggctgccatattgcacctgggaaacatcgagtttgtggagacggaggagggtgggctgcagaaggagggcctggcagtggccgaggaggcactggtggaccatgtggctgagctgacggccacaccccgggacctcgtgctccgctccctgctggctcgcacagttgcctcgggaggcagggaactcatagagaagggccacactgcagctgaggccagctatgcccgggatgcctgtgccaaggcagtgtaccagcggctgtttgagtgggtggtgaacaggatcaacagtgtcatggaactccggggccgggatcctcggcgtgatggcaaggacacagtcattggcgtgctggacatctatggcttcgaggtgtttcccgtcaacagtttcgagcagttctgcatcaactactgcaacgagaagctgcagcagctattcatccagctcatcctgaagcaggaacaggaagagtacgagcgcgagggcatcacctggcagagcgttgagtatttcaacaacgccaccattgtggatctggtggagcggccccaccgtggcatcctggccgtgctggacgaggcctgcagctctgctggcaccatcactgaccgaatcttcctgcagaccctggacacgcaccaccgccatcacctacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaaggagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggctgcaaataaaccttctgagtcagc

SEQ ID NO: 118013 - DNA, 437 bp, Homo sapiens
atgggcagtagaaagttcctgaaaagaagtttcttccttcaaggcagtgtaatatagtgacgagaacaggggctttgaagctagcagacccgggttatcatctcagctctaccacttcctgtgtgactctgggcaagttacttaagctcccagtgtctcagttttctcttcagtaaagtaggcataatcttaccactggggttgtcaagggaataacatgtaaactgtttagtgtagtgcttggtacagaatgagcatttaataagaacagttactaatatgacattactactgctgttatttaaatagtttttaacagtattatcaaaacagcaagcacagttcatggtggtaaatgccctaatggaagtgttcatctgtcaccattgagaagggaactgttaatatccactgactgttactgacagcttcataag

SEQ ID NO: 118014 - DNA, 377 bp, Homo sapiens
ctctccctctcctgaatgtgctctactctcagaggtttgtgtatctggacatgtgtgaatctgtgttttaagaagcccatgaggccaggtgcagtggctcacacctgtaatcccagcactttgggaggctgaggctggcagatcacctgaggtcaggagttcgagaccagcctggccaccatggtgaaacccgtctctactaaaaatgcaagaatcagccagtgcgtggtgacgggcacctgtaatcccagctactctggaggctggggcaggagaatcacttgaacccaggaggcggaggttgcagtgagctgagatcgtgccactgcattccagcctcagcgacagagtgaaactctgtcttcaaaaaaaacaaa

SEQ ID NO: 118015 - DNA, 272 bp, Homo sapiens
caggcgcccgccacctcgcccagctaattttttttgtatttttagtagagacggggtttcaccgtgttagccagatggtctcgatctcctgatctcgtgatccgcctgccttggcctcccaatcctgctgggattacaggcgtgagccaccgcacccggccacctcatttgttttaacagttgtgttacattctgttgtgaggatgtgttactttattaaaccattctcctaatgatagacatttataacccagattttctgtggacgggtg

SEQ ID NO: 118016 - DNA, 439 bp, Homo sapiens
gatgcttgtgaggattaaatgaatatggtaggtggagtagggcttttttcccagtaagcgcttgataaacatgagctgtccattattgttctctggggagaatcctgtgcccccaggtgtgggttcccatcctgtctgtggcttcagagtccagacctaatgccaccgacctccttgcccttcctgcacccctaccatggatcaccattggaggagtggggttgggggcttatcaccccaggaagattagataaattgggaagtggggaagtcttgggcagactcaagacccctgagtcccagctttgtcatgctgtgaccctgggcaggtcccctcctgggaatccatttcctaatctgtgaaataagcacgactgttgctggtgtcacgagaacatggtcagtgccataaagcatgtggcgggtggacttccatcca

SEQ ID NO: 118017 - DNA, 469 bp, Homo sapiens
agagatgacacaagcagttaatctgatttaataaatcctttaattctgtcggtaaatactgggaaggaaaggggatcatggagaaagagggcccagaaatagacattaagccctttttccgtcgtcttcctacactttagtaatattaagacagttccttgagaaagagagcaatctctgccttgctcaggggaaaaagaattgggagtctccatggcctagttgaagagagagagagagagagagacagagacagagacagagacagacaatcatgtatgctttctttcatggtggcgtcctggctgctgcaatagttgcaactcagggaggttaggagcagccccctcctgcatgatcatgcattatcccatgaattctaccatccataatgcacattctctagttgaaggttttattttcccttttctttgttgtaatggaattttctattataccctaaaatatt

SEQ ID NO: 118018 - DNA, 262 bp, Homo sapiens
gtacgtaatctccctactcaacctcttgaaacaactgcacatatcagcacagctaacatttaaaaataatacttttttcactatcgcagtctcctcctccctcagattctaataacgtattacagtttcttttttctttttttttgagacagtcttgctctgttgcccaagctggagtgcagtgataaaatttcggctcaccgcaacctccacctcccaggttcaagcgattcttgtgcctcagcctcctgagtagctgtga

SEQ ID NO: 118019 - DNA, 579 bp, Homo sapiens
cagactctgtcaatcaccgctctttgttctgtctctacagatttaatttctttaagtagctcatataagtagaatcatacaatatttgtccttttgggtgctgcaagaatttaatgtatcatacctgtttaatttactgccttcatatattagagttggaagaaactaaggctcagaaggatgaaagtgagtgtgcatagacacataacacactgatggtccacttactctggaaagaaagaccgtttctttcctccaagatctgtgttctttgtactgcaacatgctgaattacccattttaccacttacagaaggaagtgttctagacttctaagtcaagaatgagtgaaaacatcacaattagactaaatttagcccaaacttatgtcatggcatggaatttgaaaagaatccttaatcatatgataatgtacaaaaagtcacacccacaaacttataagtaaattgtaatcatttaaaatctctctctattctctgttgaattatctgattgcatatatctctatttttggcaacctactgaaagaacttacactagcataagcatacaaacaaa

SEQ ID NO: 118020 - DNA, 124 bp, Homo sapiens
tgcctactggtggccgggcgggatgtaaccggctgctgagctggcagttctgtgtcgctagggttttgcccggccgccgccgcacataagccacgaggaggagctttacgacttcccggttttc

SEQ ID NO: 118021 - DNA, 809 bp, Homo sapiens
tggaaagcagcaggtcagatttactttctgactgcgactggcttagcagaggttagggcaggactgctgaggcagcacatgccctgagtatggcaaacagacttttgtcaaagaccagaagaaagtgtttttaaacaaaagcccagtagttcctaaagttgggcggttttggtttttagcttttttaaaaaaaatatttgatcgaaagtggaaagtggaatacttcccgactcattctctgaggccagcactacctgatacccaaaccaaagacaccgctagaaaatggcagaccctatccttatgactgtaatatatagtaagcaataggtaaaaaggattgtgcaccaagggggacttaccccatgcatgcaaggttagttcaacatacaagtcaattaaagtaatgtatctttcacataaaggacaaaacccacatgatcttctcaacaaatacaggaaaagcatttgacagaactcaaaactccttcacgataaaaacacttaaaaagctaagacaggcatggaacttcttcaacatgatggagggtacctataaaaaaccccactttaacatcatacttaatgatgaaagactgctctcctgctaagatcaggaacgagacaaggaggtctgctcttagtactgctgttcagcccggtgctggcacgccttgccaggacagttagacaagaacataaagacatccaaattggaaaggaagaaattaaattctatttgcagatgatgcaatcatatatatagaatatcctaaggaatcattaaaaactattagaagtaatacatt

SEQ ID NO: 118022 - DNA, 199 bp, Homo sapiens
tctgccaaccacccacactctgtatacgaatccattgtaatgcttccgttctgcacacttactaggcaccaggattaaatgttaattcatttaatcccccaacaagcctctggggctgctactaccagcagcccagttttgtggatgaaataactgaggcacagaaagattaagccacttgcccaaagtcacacagcta

SEQ ID NO: 118023 - DNA, 927 bp, Homo sapiens
ttttttttggtttgccaccattcagctgtctctttaggaactggagtaccaattcctgcatctgtgttctctgttccaacctttctgtgcctatggtgagacaagacacaacttagagtcacgtcggtgtgaaaatcaacttcttgtttaaaatctaagttaaaatatatccccctcacattggataggaatatctaatctatatcattttctatgttacatttatataatgcctctatctcaactgtcctcttaactcatctcatgttatgtccttgttgaaccgtatcccatgcagtgtcctgaaggctgcatttgctcacgtgataataatagtccatgtttcaattttgagtattcctaggatgcaatatttacattcggtttccccaactccaatgcctccttagaagagatctacttctatttgagttcttttgcttgaagacaaaatacttcgttatctttgttcctatatcactgctaacaaagccaagctatcaaggagcctggctttctagtgctggaaaacttgatctgatctcttagatgaagatccaggaaaatatgatcttactcatcatttccattccatctggctaccattatttctcataatagtaaatgatattgaccaagatagtgttaatcaaaatcctacgcttttggaggtgatagatatgtttatggcattgattgtggtgatggtttcttgggtgtatacttatctccaaattcatcaagttgtattaaattatgtacatctttttgtaaacaaaatatcctaacagtctctaggtggttattactcagtgtgcctacacaaacatttcttttaacatcaattgaaagttacattgttgttttatcatatagcaatccaattccttggatatgcgaagagaatttctagtctagtctagtcaa

SEQ ID NO: 118024 - DNA, 510 bp, Homo sapiens
gtgcctcctccttaatcatcacactgaggcctttgtcattccactgttctctgcatttgtttcttgttgtttggagccgagtcagtttacttattcaacattataggtcctattcaacattataggtcctcgaattatctggactgtcccttaatttctgctgataaactggaaaacttgtctgcgggctcatttctttcttgtaagatctttccaaatatagtcaaccacccataccattggcattctgctttccacctcttcccttacagccactggctcataggtgcgtgacctgccccgagttactgctgcccagtacatactccttctatgttggtttatttgcatttttgcagcttgcaactaaaaaatgtcccgaccgattgtctcatagcatttgtttgatttacccattaatgatcctccagttggtagatgttttcttcagctgacagatcgggtttgtacttcctgctgtatttaaaattaaactttttacatgcgaat

SEQ ID NO: 118025 - DNA, 403 bp, Homo sapiens
ttgttctgctctgccaaaaatatttcatggtttaccagactgttctccccagctttgtatcattttttaatgtgatcagcctaggttttgaaggccttgtgaaaaatcattaatgaaaacactgaactgagtgaaacaagggtagagccctgtgacataccattagagacctttcagcaggttggcatcagccacatgaaatcagcccttcttggttcctcactgtaatggttatgaaaccatttaatcatgctcttacccagctcacatttctctatcttatttatgggaaacagaggcaaagtttttgataatgcaagctgaacttcagatatccttatactacaaaattcctctctgtatcactcgtgtaaccctatcaaatatataaaaggcatttgtc

SEQ ID NO: 118026 - DNA, 580 bp, Homo sapiens
ggaaagccccagttttaatatctgagattgtgttatgaggcttaagtcagaacaaagagagctggatgatgataaaggattgtaccaataactgaaggtagtcttattccttattcttccctgtcctccgtaactacttgcctactagcccatctggccatccatccatccatgcagttcttgtccagggtctactgagtgccagtgctatgccaagtgtgaggccacagtggtgaaaaaaagacaggccgggcgtggtggctgacgcctgtaatcccagcactttgggaggccgaggcgggtggatcacctgaggtcgggagttcaagactagcctgaccaacgtggagaaaccccgtctctactaaaagtacaaaaaattagctgggcatggtggcacatgcctgtaatcccagctactgaggaggctgaggcaggagaatcgctttaacctgggaggtggaggttgcggtgagccgagatcgcaccattgcactccaacctgggaagcaagagtgaaactccatctcaaaaataaataaataaataaataaataaatataaaaataaaaatacagat

SEQ ID NO: 118027 - DNA, 278 bp, Homo sapiens
cacgggacataagctgtcacttcaggacgcagtctcccaggtgtgattgaccaagacatggccaccaggctgaagcctgctcagaaagccttcataggcttcgagggtgtgaagggacagaagaagatgtcagcagcagaggcaggacaagcatgggattacaggtgtgagccaccgcacccgggccgattgttgctttctttttaagaatgtgatgtcgatacctgttcctttttgaaaaattggaaagtatagaatagcacagaggaaaaaattaa

SEQ ID NO: 118028 - DNA, 259 bp, Homo sapiens
gcacgaggtcaacttttgcatgcatatctatttttctgggctccggatccatggccattcaaaaagtggtctgtgagcttaaaaatttttagtaatacccgctgggatctttcaaagactctgtagaagccaccaactttggccaggagtggtggctcacacctataatcccagcagtttgggaggccaaggcttgaagatcacttgagatcaggagttcaagaccagcaacagagtgagaccctgtctctattgttta

SEQ ID NO: 118029 - DNA, 316 bp, Homo sapiens
catgggtctacagtctgcaaggtacacagtcagtgagccttggtggcccagatgtcaggcttctgtcacatgggagatctcaacactgccaagctcaatggcccagagactgaaattcttctaactgggaattgattacaaaactcattattcatacccaaaaatgtttttctccttcaaagcttaggtcacctaacgtgaacactcatggaaacaggttttaaaaatagttctacttcattcttgagtaaacaaaacaccctataactggcacctggtaggtaatcaatgaatatctgattagataaaaaccaag

SEQ ID NO: 118030 - DNA, 674 bp, Homo sapiens
gcgagctgcgagaagccattgcggctttgggaggccgtttctgaacgtgaagttccgtttcttttctcataaagtgcagaggagaaaaggatacttaaaataaccatgagagtgatagaaattattatcagtagaccgctcgcacacttcaccctttgctcagtcctctcacggggtggagactagacatgtacttctgcaatttcacagatgagttgacattggtccctggaaagccgcagatgcaggatttggagcagattaaatgaacaaacactggaatgaggcggcataagggttgggggagaaagataaattggtgaaatgggatgtttttgtggccaaaggtgaaatcttgtgggatctgagaagttgatgagaatggagaatgttcgcacgtagtaactaacgatgttactactactgtggactgaaagtaaatgcaccgtttatttcttatcccctctccagttattttaagtcgatagacttttttttacggtcacagagaagccttagcggggccatgctgccaaccactcagcttttttggagaggcagtatcaaatagtagttttaaaaagtgttcactgccagggttcaaattttaaggctatcattaactactataaccctgggcaagttaacctgtgtgcttcacattactcaccggc

SEQ ID NO: 118031 - DNA, 297 bp, Homo sapiens
attgagcgccagtacagctcaatatacagtggtgaccaagacagacaaggtccctgctgtcatagggcttacattatagttggggagacagtccctgtaggagcaaatacacacctaagacaatttcagggaatctaagtgcccctgagggaaatgaaacagggtattgagactagttgggaaagaatgaatgaatgaataaatggtgagccatggaggcacccacccactgggctggggtgggagatgaggaggaggagttggggatcttagagcccagggcagggagcttggtca

SEQ ID NO: 118032 - DNA, 214 bp, Homo sapiens
taagtgcctccttaaggatcactataccttaaggatagtgatcatgaatttaaaatgagaccagagaacatggttgcatgttttttctctaaccatattcaagtctgccagttcaaatgtagagtgagtagagaaatttaactagggttagttttgccagggaggtaaagtacaaaaaataagagaatgaaaatggtaacagagtgcaaagttg

SEQ ID NO: 118033 - DNA, 495 bp, Homo sapiens
gtgggagcaaggccagccacccatgctgccccgggcagctgaagggacaagggcagatggtgagggcagacatttatggggccaggtgctctacccaacccttgacacccaatctcgcactccatcctcccagcacctgatgaagtaggactgcaactatccccacttcccagatgaggggaccaaggtacacattaggacccggatgggagcacagatttgtccgatcccagactccaagcactcagcgtcactccaggacagcggctttcagataaggtcacaaacatgaatggctccgacaaccggagttagtccgtgctgagttaaggcaatggtgacacggatgcacgtgttacctgtaatggttcatcgtaagtgtcaattgggctggggtatggtactcaaatatttagtcaaacactagcctggatgttgctgtgaagctatattttagagattaatattggccaggcacgatggctcacacctgta

SEQ ID NO: 118034 - DNA, 684 bp, Homo sapiens
gtgattagtaaattaattcaacaaattattgagcatctactgtgttccagacactgttctatgtgctggctttagattactcatagtctcctgtgagcctcttttatataaagagtgagttaatctaaattacccatcaattctgtctcattaactgaaacttaattttaaagctttcctgtagaatggagagtcagcattataaaaaggtagctgaaaccataggagtaaacaagatcatcctgggcaaaggaagagattgagaagggcatctagaacagagcccatggattatcaaattttagaaaatgggcagagaaggaccatccaagagggaggaaaagcacgagagaggaatattatggcaagccctaggaagagaatgtttcaaggagcagccaggtgtcagttgctgccaagaggtcaagcaacataagacttaacaaaagtctactaagatttgttgacatagagaccactggtgactttgaatacagtttcagagaaccagtgtgggtagcagccacactgcagttgggtgggaagaaaatggagactcccagtgaggacagtatgttcaagaagaatctgttaccatttactgaatatctttctgtgcacagccctgtactgggtgctgtggaaaaatagtttattctcttaaggagctgtggcctaagcaga

SEQ ID NO: 118035 - DNA, 531 bp, Homo sapiens
gtttgcctaacatctctcttttctggacattaccactttccattgttccacatgatttcaatgggagtgccatgctctcccaagcacaccccatccctttggccacagcgaattagtccagggattaaacacatgacccaagtgtgaccagtcagatcccctcgctagaaatttggaggctggaacagagcaatgagtttctttccatgtgcctggacaggagctgctggtaaccacattccactataggatcaaggaaaagaggaaggtagtttttagaaaagctaaaactgaagctgatgtgtagagaaaggaagagaaaagcaacagagaaagggtttcccaccagactcaagccccagactccagtccattcctaaactgctcctgtctcagagattctatggaagtctctgagacaaggtagagccgagctcggctctaccttgtctagatggatccaccagcatgatgttttctggtttgaggtcaagcgtggataagacctaggcttatgagtttcatcagggc

SEQ ID NO: 118036 - DNA, 516 bp, Homo sapiens
aatttttaaaaaagcgtaacagttgcttcaaaataatctgatgagcagggaaaggaaatatagggtcggttttacattaggcaagattatgtctcaattattgaagcaaagtgatacttaggaatttattatactctttgccttacttttgcatattttaatttttccaccaaaaaagactgaaaaatataatttttaaaaaggcctaacaaaaattatacatgttcatcctccatatggttgcagaagttcaactcaaattctggttgtaggtatgactcactccatcatttcatttaggtctctgctccaaggttattttggaaaggcctttccctgccagccttatatgaaatagcatagcatctggtcttgctgtactcatgtcctgctttattttcatttgtagtacttaactactacctgacatgataatataatcaacatttacttgtttatctaaccctttgactaggacaaaagccccatgaaggcaaaggctttgtctctttcaca

SEQ ID NO: 118037 - DNA, 954 bp, Homo sapiens
  misc_feature (954)..(954): n is a, c, g, or t
agcggaagagggagggccgggcgcgccgcggctgcttgcagtctccgcaagcggctacatcacagagctcagcgtgcggtgtcacaggccccgcggtcccgcccaacagatgcaccgagatgcgcgtgcgcagaaagcgtcccggggatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgacgggacgctgaatatgatgatcagaccagtcaaacgggagaacagaagatgatacaagtcttccctggtggaagccatacctcatgtctggcaggtcctgcaaagagacatggtccacctggcctctgacccactgatgccattacctactcatatctttctcatgtggacctggctacaagacttgaatctcaggactcattggagccctactagtatgtacgagcagggagtctggcgcaggcaaaccgacacagaccttgcacaccatctatactacttgttggctgtaattgatgaacgggaaacgttcggcactcagaaaacgacagaactccttgatgcagcgatagggatgctgcatctgctcggggcctggccttacattgcacacagtacaatgggtcatgtcacccaggtactctgccaggtattgtccacacctgctcaacactccccagggtctccacaattacgcaccagagttctgcactcagttcacaacagctcggcatctaacagattagccacccaatcctgcaatcctggccacggggcctcacn

SEQ ID NO: 118038 - DNA, 311 bp, Homo sapiens
atgcgctcttttgataatcatgtgtctggtgcgtatggggtgcctgcctttgatggggtcccaatctcattggggagacataaccataaaaatataaaatacagcatgtcctgccaagggttcaaaaagagctctgagcagagtgctctgaaaaaaagagggagaaataaattctctttgtgggagggaatcaaggaaggctgcagaggaggtgacaggtaagtggggttttgaaggatgagtagaagtttgccaggctgggggtgagaggaggagctggggaaaggctactttaggaaaaggcacttggc

SEQ ID NO: 118039 - DNA, 290 bp, Homo sapiens
tcctcatccagtgagtgccacgtggttccactcattttaacaagcgttttttgagctgtgctctgcgcaggccatgtgacaggtgtaagcaagacagacaggccttgggctaatggagtaaaactcctggcagtgcgtgggtgcaggaagaacagttggagtttggagaaactgaagcctccggaggctgaagtggtgtgtctgaggtctcagtcattctgggctctcatcttggggaggaggggccatcactgagcacgtggctgggggtcctgggccacaccagccag

SEQ ID NO: 118040 - DNA, 821 bp, Homo sapiens
catagatacatagtttcaggtcatatgattggatttctttttgttattgttaagctttgatatttttattatttgctcttgtttttctgataaccaaagtaatactttgcattgctataaagatatacctgagactgggtagtctataaagaagagaggttttattggctcacagttccgtaggctttacagaaagcatagtgctggcatctgcttagctcctggggaggcctcaggaatcttacagtcatggtggaaggtgaaggcagagcaggcatgtagcgtggtgaaagagagagagagaaaaaacaatgactaaatctggaaataagtcactattgtgaagacagcaccaagccatgagggatctgtccccatgatccaaacacctcccaccaggccccacctccagcactggggattacaattcagcatgagttttgggcaggcacacatatctaaactatattaacattcttattgtgaaaattttaaacattactgaaatgtataacttacctattaaaaggttctcataagcccaccccttcccaccagcatatgtgtcattgtatcacaattactcatccttcagaatcagaatcagcttcaactggcatctctttggggaagcatttccctgattctctatctcccaggctggggtcgattggcttgtaataggcaacattctacgtggtagttaccccttatacatgggccattgtcacttaaccaataggcctcattggaaattggcccctcaagctcacattcagggccaacttggtttacccatggttctaaaagtccagaaccct

SEQ ID NO: 118041 - DNA, 830 bp, Homo sapiens
catagatacatagtttcaggtcatatgattggatttctttttgttattgttaagctttgatatttttattatttgctcttgtttttctgataaccaaagtaatactttgcattgctataaagatatacctgagactgggtagtctataaagaagagaggttttattggctcacagttccgtaggctttacagaaagcatagtgctggcatctgcttagctcctggggaggcctcaggaatcttacagtcatggtggaaggtgaaggcagagcaggcatgtagcgtggtgaaagagagagagagaaaaaacaatgactaaatctggaaataagtcactattgtgaagacagcaccaagccatgagggatctgtccccatgatccaaacacctcccaccaggccccacctccagcactggggattacaattcagcatgagttttgggcaggcacacatatctaaactatattaacattcttattgtgaaaattttaaacattactgaaatgtataacttacctattaaaaggttctcataagcccacccttgaaggtaacagaaaagtttcatgtatcttaaaattcaacaaatgttttagtacccactctgtgccaggcaaatagcctaccctcatggagcttacattttaatagggagacagtcaataaagcaaacgaacatgcaaatagataatggactgtcagttggtgacaaatgccatagagtaggctaagatgctattttagaagggcttggaaagtcttctgcatagggtaatattggagcagagactaaatggtggaggagaggaatatgggactgttcagag

SEQ ID NO: 118042 - DNA, 824 bp, Homo sapiens
tgcgtcatcccagacacccgatgttacaagaccgttataacaaagtctcattttcactgttcttcgtgcctctaagtccattctttgggtttgaacgggtgagtgtgtttctcacaacctgagggcccgttcgggatctctgtgcctacgtggagtgggactccggctgagagaagagacatgtcccacccgatttttgtgccccactctgtctgggtgtcctggctccccacagaagccatagataaacccgagactgttattcaggagacggtggaggtgacgcagggagcaaaagcaggcactgcggcaaacaggcaacctcgtgcaccagccaaggttgggtatttccttcagcctattaaaggaattgggaacctgtggtacccagatccataagagtgacacggagtaccatctcttcaccttggcaagagcagatccttcatatctgtagttgaatcacacactctcagatatctgagcttgaattctacagggacacttatctcagcttttgagtctcacggagaaatagcctgcagaccaagataataccggcaacagctagtcttcctgcccaacgacacaagccagtttggtgaccatataacacatttatcgtaagcgggtgcaacgacaattatccgtattcaacactttggcagtaacaccatcgtacgcagatgccttggtttatcccttcaccttcccgccattgattcgtaagatctccctgacgccctattaccaagacattcctccctgtacaagacctgtacaactattctgacccctcaaattaacaaacaaaactccaataa

SEQ ID NO: 118043 - DNA, 437 bp, Homo sapiens
gccaagagtgaacagccgaggcagagggggcccggagctctgagggctgcgctctctgctgaccactggctaggctgtccggaggaagccgcctcagctctctgagcttgagtcttgggcctctgggggggcctgaatctcagctccccacctccctgctgtgtgcatgcgggtaggcctgtcagagccgttctctcatctgtgaagcagaggtgatgacagccctccctctagcacagatggacaaatgagacaagatgtgtccagggcccgggaaccagcaggactgcaggtggaggcccatagttggaggcccacagatggaggccatggtgattgctattgtctgtcccatgcattcccattctaggatgtatacagaaatgtcctgtgggcggctgggcacagtggctcacgcctgtaattccagcactttg

SEQ ID NO: 118044 - DNA, 791 bp, Homo sapiens
cctcccgggttcaagtgattctcctgcctcagcctcccgagtagctgggattacaggcatgcaccactacgcctggctaattttgtatttttactaaaaacggggtttctccttgttggtcaggccggtctcgaattcctgacctcagttgatctgcccgccttggcctcccaaaatgctgggattacaggcatgagccaccgcacctgacctcattagagttttaattcgcacttacttaatggttagtgatgttgaacatctttttatgtacttatttgccacctgtatctcctctttcgtgtagtgttttttctccttttttgctgattttccaattgtttggtttttattttttgttttttttgtgtgtgtttttttgaaacagagtctctgtctgtcacctaggctggagtgcaatggcatgatcatagctcactgcaggctcaacctcccagctgcaaaggatccttccaccttaggctcctgagtaactgggattataggcacgtgccaccatgcctggctgattgttttctattttttcatagagacagggtctcactattttgtctaggctggtattgaactcctgggcttaagggattccccccctcttcagcccctgttgggctcccaaagtgctaggtttacaggcatgagccaccatgcctggcatactgttgagttttgataggttgttaatagattttagatattagtccttatcctgaatgtggtatgtaagtattttctcatagtctgtagcttgtcttttcatccttttagcc

SEQ ID NO: 118045 - DNA, 643 bp, Homo sapiens
gtgctggggttacaggcgtgagccaccgcgcccggcctccttttttttaatggagacagggtctcactatgttggtcaggctggtcttgaactcaagtgattatcccacctcacttcctgagaagtaactgggattacaggcataagccacggcacctggcatctttctacttttgtcttttctttgaaaaggtcttttgaaggttatttctcttagatacagaattctggtgtgatggttagtattaagtgtcaacttgattggattgaaggatgcctaggtagctggtaaagtattgtttttgggtgtgtctgtcagggtgttgccagaggagactgacctttgagtcagtggactgggagaggaaaacccaccctcatcagtgtgggtgggcaccatccaattggctgccaccgaggctagaacaaagcaggtggaagaagatgggataagctggcttgctaagtcttttggctttcatttttcatccgtcctggatgcttccttctgttcctcctgcccttgaacatcagactccagattgtttgggctttggactcttgacttagaccagtggtctgtcgggggttctccagccttcagccacagattgaaggctgcactgttagcctccctgctttt

SEQ ID NO: 118046 - DNA, 660 bp, Homo sapiens
tgcatcacatggcacaaccccatgtggccctaaccccagcccagtacctttctacgtttcttcccactttcctccctcattctctgcctgtgtcttttaatactgaaacaccttcttgttcacatggtgaatctgttctgaggataggaactattattttcaacagttactctttccattctcatagtaaagaaacactctagcaatatattcctttatcttcagtgccacctcttatccccagtaaacaaacacattttgaaagcaatgtcaaattttaagatgcatgttatatttaagtatagttaaagtagtagtatgcacaatgaagttatagctttgacctaatctggaagtcactgtatgagaagttggaaaatgtcacctttgaacaatgttccacttactatggctggaaaatattgttaactagacatattcttgtgcagtggaattgtgtcgtgttcagaggcaataaatctcaaagaggccctgcttatcttagtttactgcaggttgaatatccctaattcaaaaaatgcgaaatctgaaatgcctcaaaatctgtaatttatcaccaggtgtggtggctgatgcctgtaatacctcccctgggaggccgaggcggggagatcacctgagttcgagagtttgagacca

SEQ ID NO: 118047 - DNA, 384 bp, Homo sapiens
atgaatgatgcagggagccctcagcaacaccctgggcccatgaatccccaacggggacagcaaggtgggagagatgagccccagctggaatccctgggaccaggtctgtctctgcccatacccagactctcttttctcttgagaaaggaggaagaatgaggagtaagaaggaaaaaaaaatccagtcactgtccctagttaagccatctccttagaagtgagggcccagtggggcaggtaggctgtgtatactccacgaggatccctaaggacctctgcctggagacatgagtcgaaaacagaggaagcccacagcaaacccgtagatgagcaagaagccagtgtcaaatgcttgggcacatggcttcggacgtggtggagtta

SEQ ID NO: 118048 - DNA, 412 bp, Homo sapiens
ccaaaccctgatgtgtaacaggtggcaatctaaatggaaattgtacgcagatggaaactcagaagggacccaccttgcaggagagtggtaaccaaaagtcctattttgaacacatgtattttttttttcacaaatggaattgtacattatgttttgctttgtgtattactcttttactgatgtcataattttttcatgttcataatagatatagaccataatttttacgctacatagctctcctttgaaaatcaaactctgactctaccatttaccactttttaacattgggtaagttacttaacctctctatgaaagttcttagtgcagcacctaaaacacagtaagtgctcaatcaaatttggcctccttttcttttcccaaggtactttacaagagcaggatattactg

SEQ ID NO: 118049 - DNA, 341 bp, Homo sapiens
aaatataagcagaagtgtcctgtgacagtttctaggagcactttgtcaggggacaagaggtgaggagagtaatgtgtagaaagaaaagacatgataattatcacaaatagaatacttgtattcattgttagtccagaccttaaggtttcaaatttgaaggtttaccacctaagggaggaatagaaaactgggagaggatttatgatgcaggaaagaaaagagatgtatgccaggtgcagtggctcacacctgtaatcccagcattttgggaggccaaggcaggaggattacttgagcccaggaggttgaggctgcagtgagccatgatctcgccactgccc

SEQ ID NO: 118050 - DNA, 377 bp, Homo sapiens
catcaaaatactggatgttaaagaaaaagaaaacattttttaggtatttaggcaaaaacaaaaacatgacctttatatcattaggagaataaaattatgttcttacactgatagtaatgctttatgccaggagaacatggactaccatgtttcagatatcaaggaaagcacatatgatccaaggacttcgtattaagcagaactggctttcaagtataaagggcatagcaagcagctattagcaattaaagaactcagaaaatattgttcccagcagttttccctaagaaatttagagaatgaggttcagtcaactagagtagggagattgtagtatgtgatggctataggatctgacaatgaagatagagtaaacc

SEQ ID NO: 118051 - DNA, 463 bp, Homo sapiens
acttcatttcagatgcttccccatgcactctatactcagtatgcccatcattgaactctcaaattttccctcccctcttcctccccagtcttctctatttcacacatccagctaatcaagaggctgaggaggagaatggcttgaaaccaggaagaaaaggttggttcaatatacgcaaatcaataaatgtaatccagcatataaacagatccgaaagaaaaaaacccaaataaccaatcaaaccgggcagagcacagaagcacaattcagaagataccaaatggctgacacaactttaaaagcatcctggccctagctaacagtcacataaacacatattttcatctctcagaatggaagaaaagatgaaggctgatcacaccaaaagtgtcaacaagggtgtaaagaaatgcacatatcattcactgctggtgggaatagaaattgatataagcttactgga

SEQ ID NO: 118052 - DNA, 4177 bp, Homo sapiens
caatgaactccatctctgacttccccagctcgggcaggtatgagtgggactctggccgcaggtggagctcctgggacctgcaggaggtgaggcatccaacgtcacataggagattgcggctctgagaactcccgaggccccgaccaccctctgcgccgagcatctactgcgcgccgtgctctgtatgatcctgccaggaaggtgctcacaggagcccacctcccacggtcccacagcagggcaggactccaatgcagcgctgccttccttcaggtccacattcaccgaggacatttacagggagggagtgtgctacggtggcactggaacaccccagagtgactgcccctcccttgctacggaccaccccaccgtccccacctggggctggctacaatgcagaatctccagtaccatctgaggcctactgagtcagactcggcattttaacaagatcattgggtggttcacaggcacagtccatccgggaaacgctgtgagcctaacacagataacagcacccgtgatgccatttccctctcacccacgcagggcagacatcgctggccgatcgcagaactcttgctgctgaacctggcctaaccaccttctcaactcagcctagcagcctggtgcagagactggagctgcccagtttccccagcgactggctctcctgaaccctcctccgcagtgtgcctagagagggcatggccttgcctaactaagcacaccccacggagctgggactcctggcctccacctctgaggctccaaccatcacccaccagaaagagcctgaatatgggccttgctgaaatgcttttcccagaggctaagcagggaatccacagctgttcccctcctgcacaagccctgcctggcctggccctcgccgtcccgccactgcactcctgccccagggcctttgcacctgctgggctctgcctggagcactgagacctcaggccctccatgtgagctcctccccttcctgtcatggtgcagatggcgcctccttgtcccaggccagaccacactacacccgcctgtctgctctctctccactgccctcccacgcgcttggtgacaacaggtgtttcctggccacctcccccacccatgaatgaacgcagggtggttcacctgtcttgttcatggctgtccccaggtactggcgcacagtaggtgttcaatcagtgcctgtagactgactgaatgctgcccactgcagcacgggctggggccgtgttgctggcccccccggggagcggggcagccacccctctgtgctcacctccctggagggccctcaagtccttgtccctccaaagctgggccccaagacatccccctcttcaaggcccagaacccagggcttcaccattacatggggcttggcaggaagcgcatggtgttttctcttaaacatgatagtggcactgcagtggctcaaataatgtcctcccaaaatccacggccactggaacctccaaatataacatcctcccaaaatgcacagccactggaacctcaaaataagaccttctttggacctagggtcattgcagatggaattaagctaagatgaggccatcctggattaggatcactgggatccttgtaacacaacaagagaacacagagacagacaaggaaatggccacgtgagacagaggcagaggcagaggcagagattggaccgatgcagccacagctgaggaacgcctgtagcccccagaagctggaggagacagaaaagcatcctccccttgagccttctgagggggcgcggccctgcggacgccctgacttcagatcacgggaatgcacttctgtggcttaaagccgcccagtttgtggcacgttgcgacggcaggcccaggaaaccaatccaggtacagaaggcacgctgcctcggcctcccctcctccagacgcctgcgcccacctgagttcaccagccccgcctgatctggggccctgggacacctccgtggtaccatgaagggctggggcctggtgcctcgacttctagtcctggctgagtaaacaagagcccatccctcaacctcgcagcctcagctgccccatctgagaaataggcacaactccccacacctcagccgtctccagcagaagctcctagagaagatgggagaaagaacgtggcctaccgatcccaagtgaatgcatggagagctggctctgacccagccctggccctccccttgctgtagtccctccagctccccaccccacctccctcccactccccacctccctctcaccctaccacctaacctgttcattcccttcccacctggatcaaggaaagtaaggctggcccagcacaggcacacaccagagggtgtcctctgccagctggagaagaaggaagaatgggaggagagggcaggggccccaggggcaccaggtgtggactcaaatcttcccacagaagcccagccctgctgcagcccagcttggaggtccccactgctgcctaaacccacagaggccactgaagttccacgctggaagtctgagggccacgtggctcttccctgctcgtcccatcctcaccccgagtcacgcccacgccaggtcaagggtgaacacacggcccgacaccccatcatttcacaggaccctgtgtgctcctgctctgctacgggcctctgcttctccatctgagaaggagctctcacgccctggacagggaggcagcaactctctcctcaccgttcattcccgggctggaactcagacagcagggagggcctccgccgctggggctggatgatggagccgggcgacaggtgggaggcatagtcgcgggagtggtgctggtactccaggagcccgacgtcctgcaggaggggacagaggagtggtgagcgtgggcgggcacgggcatggcggggcacggcagggcacagtgggcaaggccgtggactccctgctcaggctcgctcctgccctaggcagataagcccaagtcctgcagggaacctcagggaccgtctggccagaggctacccttggggccgaacaccaaggaggagaaagaacacagctgaacggccctgggctgcatccttcccacacagcatcccagggacccacgatcacgcccaccttccaaatgagaccgccaagcctgggaggtctgatggggctgtctgaggccacaggctaatacaggcctggaaccatcctaaccatggcctctgtctgccggccatgctggcgttgactggggggccagagtagaggaagctgtcttcgcttttctaccctcccaccccatcctacccctgccaggctgtgggtccctccagcctgaggagctgaagcttggaaatgcaggcctgggaagacaggactgaaggtgcatacggggcagcattatttgtaaaaacagaaatgcatttgcagcaacaactgggaaaaggcccaacctagatgcccagctcttggcagggtgggtaagtgatgcccacgcgagagaacgaggctcgggcctcactcgccaggagaaggatggatggtggcaagtgatggcgacaaacacccgacagccagcgaggcccaaagaccaggtttcagaacaaagcgacccctgaccccaaggccgccctgtaaaagaggaactccccgctcgtatcacagccagaagggtaagccttaggcagaccttcctcctttaataacacaccgtcgtccatttgacaaagactctccttgcccacacctgagtcaagctcctctgacccatcctctctctacggggcctcggccttggccttggccttgcggggctctgcccagctgcaggcatcctgctaagtcagtctagaggaaccccccaccctcaagcgctcctcttagtaattttccatccaccgacccctccctccgccctgcggctaggctatgaggccccagctgtcttggccgtatttggcgctgagcctggtctctctcccttatcgtgacagtcttgacgctgatagcacaattgtcctgtacggtcttcctgcttaacaagagtccaaatacttgtttctttaacacattatccattatcatagggggtaaaactcaatatcaacaaattagatgtataccaattgccaagtacacccagatttgagaaacattaaactgtgttt

SEQ ID NO: 118053 - DNA, 402 bp, Homo sapiens
gctcgggaccgttgggcacgcaccgtagtctaatagaaaacaaccgaaacaataattcaagcactgcttattacaattttactgggtctctattttaccctcctacaagcctcagagtacttcgagtctcccttcaccatttccgacggtgcgttggcccaacattttttgtagccacaggcttccacggacttcacgtcattattggcccaacacggtgcgttggcccaacgttgggccaaccaaccgtaggagaacctcgaaggcatcttggaggtccctgtctctgccaggcactccctccctgtcttctcagcaccctgctggcatcacaaggaaatgtgggccaaagaccctcatcccacactaagaatggtccaacagaaaccagcctggtcccag

SEQ ID NO: 118054 - DNA, 105 bp, Homo sapiens
aaatatagagcttttttgtgggggtgattcattgaacagttaatattggcttgctaggattataaaaggtaataggctgttaaaattaggaggggtgacatcagc

SEQ ID NO: 118055 - DNA, 604 bp, Homo sapiens
aagattccttgtaaattaaaaaaattattcaaccttaacatggtactatttatctttctaatatacacaacttcagatgttatgatgaaatactggaaatattctcattaaataaaaaagtaagataagtcttcccagtattgccactattattcaaaattattctggaactgcttcaccgtgcaataagtaaagaaaaggaaaaaaagagttataaatattggaaggaaaaaatgttatttcctaatgttgacattatcttcctaaaaaaccttaaaaattaaaaataaaaataattagagataattatctcctcccaagtggttttctaattaaacagacaaaagaaaaaaatgtgcttataagtggtataattacatttaaaaacaaaaaatgtactccataagtaacctctatcccttccttctccaacatatatagattaagttttgtcttagctctaggtcataatttaattaaagggagattgatcttatgactctgactctgttttaaaaagtaaatattttcctgttttttgcattataaataaactacctgtttattgtataaattttagaaaaatacagatgagattcacggg

SEQ ID NO: 118056 - DNA, 249 bp, Homo sapiens
tatctgtaaggtggcaatagggattctagtttcctgacacttgaaatggctggtataggagcacctcagaaacaagctaggctgctagaaagaagaaaggtattctctaaatttagaacattattccaatatttcagaaaaagggagagtcctaattataaggtagttgcgctgtgctttgtaatgccagggcagagacagcccaggtattaggttctcgcttgcttttgtgctctgtttggaagcacg

SEQ ID NO: 118057 - DNA, 371 bp, Homo sapiens
ctcagttggcccctggtcccattgtgtagggtggctgcccaccgctggcgagggcaaagggccagtgtgacaacctttctggttaccctcagttggtggatcctgagcttttgtccggtgtccaagaagaatgaggtcacactgacaattgaaggatggtgagggcagataattttactgagcaatgaaaacagctcttaatggagaggagagctggagagggaatgggactagcaggttgtcttccccaaactcaggtcgtctctctctgtctacccactgagtctggggcctttataggcacagaatagtggcagggcgggccacaggtagtattggaaaaggcaacattcagttggttgaaaggcatt

SEQ ID NO: 118058 - DNA, 676 bp, Homo sapiens
gttaatctttttcccagtcttccccaaagggacctacagccttctaccaggatgactgtgacttagagaaaagaaaattctcagatatttggggaattctggacactggctctgatttgacaggaattcccagagaccaaaaacatcactgtggtccaccagagtagggacttatggaggttagctggtggatggagtgtgagctcatgtctgtttcacagtggatccaatgtgtccctgaacccaccctgtggttggaatagacacatactcagcaactttcagcatccctacatttgttgtttcacctacggactgaggacaagtatgataggaaaacccagttatgagccactaggactggtttcacctagtaaaagagtaaaccaaaagcaagagtgcattgagtgctatgtaaatgctctccaaagggtggccttggcagagaaggatttcaataatcaagcagataggatgacctgttctgtggacaccactcagcctctttccccagccacccctgtcattgctcaatgggctcatgaatacagtggccatggtggcaggggtggaggtgatgcctgggctctgcaacatggacttccactcccaaggtaacctggctgtgactctgaaccacctccatcatagaagaggcagtgtcttgttctcactg

SEQ ID NO: 118059 - DNA, 613 bp, Homo sapiens
cttaatcttcaagtattaaggacaacctgtcctttttatacaagtcatacattagacatgtgcctgagattacaaaacactgtgatcgagttttcaaggctagggatacacctcaaactcagatgtacttctttggtgcctatttgtaagtcagcaaaatccagaactcagcaatatgttaattaatgtattaatacagaaaatatttttgtgcattatattttctgcattttagatatttgtgtgccatggaatatttgatgatttttggctttatttaggttaagtcaaccaaagcattttgaaatgctgctttttttttaacacatgtatttgtgggtttttgttttgttattgttgttgtttgagacagggtcttaactctgtcatgcaggctgaagtgcagtgtcacaatcacggctcaccgcagcctcaacctcccgggctcgggtgatcctcccacgtcagcctccttagcagctgggattacaggtgcccaccaccacgcccgtctcctttttgtatttttagtagagacggagtctcaccatgttgcccaggctggtctcaaactcctgggctcaagtgatctgccctcctcaacttcccaaag

SEQ ID NO: 118060 - DNA, 642 bp, Homo sapiens
agttgctgacttatttatctcccacgggacaaaagtaaccttctccaagccaagaagtgcttcttagaggccaagagtgcttctgtttctttgtagtttttgtttgtttccaatctgcacaaataagtggattgtaacaggaactcccatcacctagattccacagctgctaagattttgctacatttgtttccacttcatgtttgtattccacttccaccaaaacagtgcctaacactgccttgaacagcactttgaataaagaagccaggactctgggaaatggtgggaattcaggtttgcagaacagcctcctaggagtggcatgggatggggaagtgggtaacgaatataaaaagttgtccatgcctgagtacctattatgagccaggtgctttacaggccatctcatttcaccctcacaactttatggagtaggtactgttattatcccaattttatagagaaagaaatgaggttcagagaaggaaagggacctccctaggtcacccagataggcaatggcacagctgggatttaaatccaagccctgcgcccttctcactgtgccctgcagcttgcctcaaagggtgccaaacaggctgccacctgatctgcttctatttcacagtgtacatgaca

SEQ ID NO: 118061 - DNA, 276 bp, Homo sapiens
ggagtgcggtgatgtgatcctagctcactgcagcctcgctcctgggctcaagcagtccttccacctcagcctttcaactagctgggaccacaggtgtgggccaccactcctggctaatttaaaaaaaaaaaaaaatttacttttttaagagatggatcttgttatgctgttctggctggcctcaaactcctggcctcaagtgatctttccactttagcttcccaaagcacatactctttttgaaacattattttccaacaaacatttgtgtctact

SEQ ID NO: 118062 - DNA, 218 bp, Homo sapiens
taactttgacttatggacagctcacagccaagttaaggcccgcctttagcacatacataggatataaactgtagtgtatttaacttttctttcatcttattttccctgctctttccttagcccagattttttcacttaaaaagataacgtatttactgacttttacacatttttattagctacctggaattatttttgtaacacgttaagtgtaaata

SEQ ID NO: 118063 - DNA, 487 bp, Homo sapiens
gcaaaccctttgtcttcttcagccactaacacataggccccatccagttacttccaagtggtttgtgggctaaaaaaccccagttactaaaggaagtgtcctcaccaaaccccagaattatgcctaggcatcctgagacatgagaaacaacagggaggagagatcacacagctgacacggagctcccgctgagcttgtccagacagcttttccatgcacggctccagggccgctggaagccctcacccgggtcctgtagctctgggtgggttgtactgatttctgtgcacctccacggctagctcagattgttttaatgctgtgaatatccatagaaggcaactggcaagttgtcaaagtcagagaggctatagaggaaggcacgttactaaaattagagaggcctagtggtgtaatgaaaatcagggcccaccagggccgggattcccactcctcagcctcagcggctatgtgacttggaagaagt

SEQ ID NO: 118064 - DNA, 694 bp, Homo sapiens
gcatgcctgtagtctcagcttctggggaggccgaggtgggaggatcacttaaacctggggaggtcaaggctacagtgagccatgagttgtgagtgtgccactgcactccagcctgggtgacacagcaagaccttgtctcaaaaaaaaaaaattggtttcatgctagggaatctgtcttactagttacatgccagggaatcatggcattccatcaattcatgacaacccaacatatctgcatacgtgtctatatagcatatctgcagacatggtgagcaggcatgtgataacattcagcatccattctcacagttaaaaagttttttgagcagggcgtggtggctcaaacctatagtctcagctacttgggagaataggccggaggattgcttgagcccagaagttctgggttgcagtgtgccatgccaacagggtatccacactaaatttggcatcaatatggtgaccttcctggagcagggttgcctaaaaagaggtgtgaaccggcccaggatggaaatggaccaggtcaaaactcccatgctgttgagtagtgggatcatgtcactgcactgcagcctggacaccatagcaagggtccatctctcaaaaacaaacaaaaaccaaaaaacttttggggctgggcagggtggctcacacctataaccctagcaccttgggagactggggtggg
